United States Patent 10,160,976 (CHROMOBACTERIUM SUBTSUGAE GENOME) - sequence listing, part 5

SEQ ID NO: 4335 - DNA, 2019 bp, Chromobacterium substugae
atgacaaaccatcgccgcaacaccactcgccgagcgctgtacgaactgttcagctcgatgcgcttcgccatcggtcttctgaccatcctggccatcgcctccatcatcggcaccgtgctcaagcaaaacgagccctaccccaactacgccttcgagttcggccagttctggttccaggccttcgaacagcttggattgttcgacgtctaccattccgcctggttcctgaccatcctggtcttcctggtgctgtcgctgaccctgtgcgtgctgcgcaacggccccggcttcatcaagcagatgcgctcctaccgcgacaaggccggcgaaagctcgctggcggccatgtcgcacagccaggccctggaggccgaggccgccgacccgcagacgctggcggcctacctgcaagcgcagggctaccggctgcgccagcgcgaacaggccgacggcagcctgctgatcgccgccaaaaaaggcgccgccggcaagcttggctacttcttcgcccacatcgcgctgatcgtgatctgcgtcggcggcctgatggacggcaacgtgccgcttaagctcggcatcctggccggccggctggtgcccgagacccgcaacatcccgcaggcgcagattcccgagcacagccggctgccggtcaccaacctgtccttccgcggcaacgtcaacatcgccgaaggcaagagcgccgacgtcggcttcatcgactccggcaacggctacctggtgcaggatctgcccttcgtcgtcacgctgaagaaattccatgtcgactactacagcagcggcatgcccaagctgttcgccagcgacatcgtggtgaccgacaaggccagcggcaagagcaccgccgccacggtcaaggtcaaccacccgctgatcgtcgacggcgtcgccatctaccagtcctcgttcggcgacggcggctcgccgctgctgttccgcaagtggaacctggagcagccgcaggccgcgccggagccgttgcgggcggtgtcgctggccagccagccgctgcaggccggcggcaaggactacacgctggaattgggcgagctgcgggtgttcaacatcgagaacgtcggcaagcccggcgccgccgaccccaccttgctgcagcgcatgcacgacgcgcgcgaagtgaagcagagcaaggagctgaagaacttcggcccgtcgatcagcttcaagctgcgcgacaagcagggccaggcagtggaatacatgcattacatgtcgccgatccagcaggacggcgccagctacctgatggccggcgtgcgcagaaccccggccgagcccttccagtacctgcgcctgccgctggacgacgacatgggcctcgaacgcttcatgcgcctgtacgcggcgctgcgcgacccgacgctgtacgacgccatcgccgaacgcgccacccgccaggcgatgcagggcggcaagccggacgagaaactggcgcgcgacttcaaggacggcatcaaggtgatgctgcagcgcttcgccgacggcggcttcgccggcctggaacaattcctggaaaagcaggtgccggccgacaagcgccaggcggtggcgcagacctatatccgcatcctgcagaccgcggtggtggacgtgatggcggtggccgacgaaaaagccggcgccaagccgctagccgccgacgccgcgcattaccgcttcctgctggacggcctggtggccagcagcggcctgcgcgactacggcgcgccggtcttcctgcagctggacagcttcgaccaggtgcagtcgtccggcctgcagctgacgcgctcgccgggcaagaccctggtctatctcggttcgatcttgctggtgctgggcatcgtgctaatgttctatgtgcgcgaactgcgcctgtgggtgcgcatccacggccgccagctcagggtggcgatgacctcaaaccggcataaccgcgatctcgaccgcgacttccagcgtcatctagacgccatcaaacagctgacacggggatcatga

SEQ ID NO: 4336 - DNA, 603 bp, Chromobacterium substugae
atgctgttggcgatggcaaccctaaccctggccggctccgcgctggcggcggctccggcggccaagggggacccggcaaaaggcaagcagatcgtggataccgtctgcgcggcctgccacggcgcggacggcaacagcgtcgcggcggccaatccctccctggccggccagaacccgcagtatctgtatagccagttgaaggcgttcaagagcggcgaacgcaagaatcccaccatgttcggcatgagcgccggcctgtccgacgacgacatgcgcaacctggccgcctatttcagccagcaaaaaccgaaagagcgcgaagcggccgacaagcagcagatgccgctgggcgccaagatctaccgcgtcggcaacgcctccacccacgtgccggcctgtatgtcctgccacggaccggccggcaagggcctgcccgaccagttcccgcgcctgggcagccagcacgccggctacgtcgccaagcagctggccgacttcaaggccggcaccgaccgcaaaaacaccatcatggccgacatcgccagccgcatgaccgatgccgagatgaaggcggtttccgaatacatctccggcctgcgctga

SEQ ID NO: 4337 - DNA, 621 bp, Chromobacterium substugae
atgtcgatttttcagaacgcccgattttataccaccgtcaaccacatgaaagacctgccggccacccgcgccgaggtcgcattcgtgggacgctccaacgcgggcaagtccagcgccatcaacacgctggccaaccgcacccggctggcctatgtgtcgaaaacgcccggacgcacccagcatatcaacttcttcgagctgggagacgagtgttttctggtggatctgcccggctatggctacgccgaagtaccggaagcggtgcgcgcccactgggtggagctgctgggccgctacctgcagacgcgccagagcctgatcggccttctgttgattatggacgctcgccacccattgaaggagctggatcgacgaatgctggaatttttccgcgtcgccggccgtccggtgcacatcttgctgtccaaggccgacaagatgtcgcgccaggagcagagcaaggtgctggcgctggtgaagcgcgaactggccgactatccgtcggtcagcgtgcagatgttctccagcctgaagaagactggagtggaggaggtggagcaggtggtgaagggctggttcgacgcgctggagccgcagctcccgccggcggaggaactttaa

SEQ ID NO: 4338 - DNA, 828 bp, Chromobacterium substugae
gtggcctgttccaccgtgaagacggccagcgccacaaaccagtcggcttcgccgaccaacaagaagaccgtcgccaagaacggagcttatttccagaacgacggtccggccgatcatatcccggtcaacctgaatctggtgcccgacgccgtgccgcaggatgagccgctgatcaaatcggccaacctgccttactcggcgctgggcatgagcttccgtcccgatgtgcgagaaaagccttaccacgccacaggccgtgcctcttggtacggcaagcagttccacggacgcaagacgtcctcgggcgaacgatacgacatgttcgccatgaccgcggcgcatccgacgctgccgatcccgagctatgcccgggtgaccaatctgaccaacggcaagtccgtggtggtgcgcgtcaatgaccgcggaccgttccacaggagccgtttgatggatctgtcgtacgccgccgcgtacaagctgggctttatccagcagggcagcgccaagatcgcggtagaccgcgtctggcccgcagccgacaacacctactccgcgtccgcgcagccggccacccagccggcaagccgagagttgcgcgcaggcgacaatccgaagtatctgcaactggggactttctccacgctggccaatgccgaagcgctgttgcagaagacgttgggcgagctggacgatcattacgattccaagctcggcatcgtcaatcagcagggggtgtacaaagtgcgcctgggaccgttcccgtcggatgacgccgtgcgcaacgcggccgagaatctgcacgtggagaccgtgatcaccagcctgtag

SEQ ID NO: 4339 - DNA, 711 bp, Chromobacterium substugae
atgctgtcaaacctgctcaatgccttaattgacaattgctcatttattaatcaaaaatgcgcgctgtgcggcgcggccgacagccagcaggcgctctgtccgccctgccgccagatgctgccgcggctgcccgccgcgcattgcccgcgttgctcagaaccgaccccggacagcgcgctgtgcggccactgtcagcgtcatccgccggccttcgacgcgctacacgttccctatctgtttggctaccccctgaatggcctggtccatgcattcaagtacggcaaacgcttacaattggccgggacgctgaccggcctgctcaccgatttcgccgcttgtcaagcctgcaaatacgaccttgtcattcccgttccattggcaaatgaaagacttgcggaaagaggcttcaatcagagttccgagcttgccaaagcgttcgctgttacaataaacagccgtttttcggacgacctgtgttggcgaaaatgcaacacattgccgcaagcctcgctcggtcgcgccgcaagactgcgaaacgtgcgtcatgcattcggcgtaaaacgccgctgcgacgggctttccattgccatcatagacgacgtcgccaccagcggcgccaccctctcctccctggccaaagcgctcaaaaaacagggggcggaacgggtcgatgcatgggtgctggcccgggcgttttccccaaaaacttga

SEQ ID NO: 4340 - DNA, 984 bp, Chromobacterium substugae
atgcattcagtgacgatggagttcaagcgcccggccgccccgcatccggaaaaggccaattggagcgtcgacgaggtggaggtgctgctgggtctgcccttcatggagctggtgttccgcgccgccgaaatccatcggcagtttttcgatccgacccgcgtccagctgtcgacgctggtgtcgatcaagaccggcggctgtccggaagactgcggctattgcccgcagtcggtgcatcacgacaccccggtggccaaccagccgatgatgacggtggacgaggtggtcgccgcggcgcgccaggccaaggccaacggcgccgggcgcttctgcatgggcgccgcctggcgcggccccaaggacgccgacctgcagaagacgctggaaatggtcagccaggtgaaggcgctggggctggaaacctgcgccaccttcggcctgctgcgcgacggccaggcggaacaactgaagcaggccggcctcgattactacaaccataatctggacaccgcgccggacaagtacgccgacatcatccagacccgcgagtacgaagaccggctggacacgctgggcaaggtgcgctcggccgggctgtcggtgtgctgcggcggcatcgtcggcatgaacgagacccggcgcgaccgcgccggcctgatcgcccagctggcgaacctggatccccagccggagtcggtgcccgtcaacaacctggtcaaggtggtgggcacgccgctggagggcgcggaaacgctggactggaccgagttcgtccgcaccatcgcggtggcgcgcgtcaccatgccgcgcagctatgtgcgcttgtccgccggccgccgcgaaatggacgaagccacccaggcgctgtgcttcctggccggcgccaactcgatattttatggcgacaaattgctgacgacggggaacccggatgtgctggccgaccaggcgctgatgcaaaaactggatctgcaggcgctgtaa

SEQ ID NO: 4341 - DNA, 1155 bp, Chromobacterium substugae
atgcgcctacaagacctgtccgcagccctgctggatctggacgccagtcaccgccgccgccaacgcgcgtgcctcgagtcgccgcaaggcgccgagatcgtcgtcgacggcgaggaatacctgtctttcgccagcaacgactacctcggactggccgaccacccgtcgctggtgcgcgcgctgcagcagggcgcggaccgctggggcgccggcagcggcgcctcgcacctgctcaccggccacagccaggcgcaccagcaggccgaggaggcgctggcgcgcttcgtcggccgcgaggccgcgctgctgttcggctcgggctacgccgccaatctggcggtgatcaccagcctggtcggccgcggcgacgcggtgttcgccgacaagctgaaccacgcttcgctgaacgacggctgtctgctgtcgcgcgccgatttccaccgtttccgccataacgatctcaaccagctcgaacaattgctggccgccagcggcgcgcgcaccaagctgatcgcggtggacgcggtatacagcatggatggcgacgaggcgccgctgccggagctgctggcgctggccgaacgctacgacgcctggctgtacgtcgacgacgcccacggtttcggcgtgctcgggcaaggccgcggcgcgttggccgaacatgacctctcaagcgagcggctggtctatatggcgacgctgggcaaggcggcaggactggccggtgcttttgtcgccggcggccgtctgctgatcgagtggctggtcaaccgcgcccgcacctatatcttcagcaccgcccagccgccggcgctggccgccgccgtcggcgtcagcctgcgcttgatagaggaggccggcgacaggcgcgaacggctgcggctgctggcggcgcgctgccgcgcgcgcctcgacggcacgcggtattcgggcggggcttcccgtaccccgattcaaccatttatcataggcggcgatgcgcatgccatgagactggctcaaggtttgcgggaacaaggctattgggtgcccgccatccgcccgccgacggtgccggagaatggcgctaggctgcggatttcgctgtcggcccagcatgaggtgtcgcaattggacgccttgctggactgcatgctgcagctggccgaaagctga

SEQ ID NO: 4342 - DNA, 2844 bp, Chromobacterium substugae
atgaagagcacggctgaatacctggagactccggaacaggctgccggacgggcgctggcgctgctgtggcaggccggcagcctggcggccatcgccgcatgggggcaggcggacgggaaatggcggaggctggccagcttgggggcggccgacgcgctgccggcggccgaggctctggacggcgatcggctgccggggccggacggcggcgcgctggcgttgcgcgccgccggcaagacgctgggatggctggcgtggcgcgggcgggagccggcgggaatggccgatgtcgccgccttgttgaccggccatttgcaatgcgccgcgttgcgcgacgagcaggcggcggcccggctcgccaatgaaaccatgctggagatcaatctgctggccggcgaaagcggcgcgccggagcgcatgctgccgcggctgcaccggctgatgatgcgcttgatggatgccagcaatttccacatcgctttgtacgacgccgacaatgccacgctgcgctatcccttttacgccgaccggcgcgatccggcgccgccaggacccgacgcggtgtttgccgccggcgcggacagcggctcgctggcggcctggctgatccgcggcggcaagccgatggtgatgagccagcagcggctgctggaagtgtgcggccaggaggggctgacgccgccggcggcgttgccggcttgctggatgggcgcgccgctggccgatgccggcggcgagtggatcggcgcggtggtgctgcagcagtacgatgaccaggcgccgctctcctcggccgaacaactgctgttcatgttcgccgcgcgccatgtcggtttcgcgctggaccgggtgctgcatcgcggccagttggagcgccaggtctggctgcgcaccagcgagctggagggcgccaacgccaggctgcgggccgaagtgtccaaccgccgccgcgccgagcaattccaggacgtgctgttccgcatcgccgaactgtccaataccagcttgtcgctggaggcctttctcagcggcctgcaccggttgctggcggaaatggtgccggcgcgcaactgcatggtcgccttgtacgacatggtcaacgaccgcatcggctttccgtactgcgccgacgagtactcgccgccgctgcagccgcgcaaacccggcaagggcttcatcgagcaggtgctgcatagcggccggccattgctggtggacccgcacagcccgctgcaggcgcaaatggaagacgtcggcggcatgcggccgcaaagctggctgggcgtgccgctgtattgcggccacgagctgctgggcgtgctggcggtgcaaagctaccagagcgacgtgtcctacagttaccgcgatcaggaggtgctggaattcgtcgccaacaatatcggcgccgcgctggccagggtgcgcgcgctggaaagtctgcagcaggcctacgccgaactggagcagcgcgtgcgcgagcgcaccagcgagctggacgcggtcaacgcccagctggaattcgacagcctgcacgacccgctgaccaagctgcccaaccgcacctatttcgccaaggcgctgcgccgcgcctgggacgcctatgccgacggcggcgaccgtttcgcggtggtgttcatcgatctggaccgcttcaagctggtcaacgacaccctgggccacctggcgggcgaccacctgctgttcgaggcaggcgcgcgcatccgctcctgcctgcgccattatgattttctggcccgcctcggcggcgacgagttcgcggtgctgatgttcggcatggacgcggcggacgagtgcgaggtgatcgcccgccgcatcgtcagcgaattcgagcgcgcggtgatcctggccggccgcgaggtgttttccaccgccagcgtcggcgtggtgctggccgaccgcgagcattaccacaaggccgacgacctgctgcgcgacgccgaccacgcgatgtactgcaccaagcagcagggccgccagggctacaccctgttcagccaccagctgcggatagaccaggccgaccagctggcgctggaagccgaattgcggcgcgcgctggaggaggaaggccagctgatcccttactaccagcctttcatcgaggccaggaccggcaagctggcgggcttcgaaaccttggtgcgctggcggcacccgcagcgcggcctgatctcgccggcggtgtttctgccgatggccgaggagagcgggctgatcaatcggctggaccgctacatgatcaacgccgcttgcgcccagttgcaggcctggcgcggcgagggccgggtcggcgaggacatcggcctgcacatcaacctgtcgtcggccaatttccacgatcccgacctggtcggctggataggcgagcgcatcgtccattaccagctgccgccggcgatgctgcacctggaaatcaccgaaagcgcgttgatcgaccagccggaaaccgcgtccagcgtgatgcaggcgctgcacggcctgggggtgaagctggcgctggacgatttcggcaccggctattcggcgctgtcctacctgcatcgctaccgcttcgacgtgctgaagatagaccagtccttcgtgttcgatctggaccgcaaggaggaatcggccgccatcgtccgcgccatcctggcgctggcgcgggcgctggacctggacgtggtggccgaaggggtggagacggccgcccagctggcgatgctgcaggagatgcattgcagcaagctgcagggcttctatttcgccgcgccggcgccggcctggcatatcgactgggagcggctggcgcgcttcgagcaggaaatccgctgtgcggcgtga

SEQ ID NO: 4343 - DNA, 618 bp, Chromobacterium substugae
gtgcggcgtgaatggtcgacccgcttcaaccgctggcgctacgatctgtacgcgccgctctacgacaagctggcgcagggcttcgccgccggccgccgccgctcgctgggcctgctcaatccgcagccgggcgagcaggtgctgctggtggcggccggcaccggcctggatctggacttcctggtgcgctgccgtcatctcaccgccatcgacatcgccccggcgatgctggaacagctgcgcgagcgcgcgcgcaagctggggatggaggtgcgcgccgagctgatggatgcgcagcggctggattttcccgacgcgagcttcgacgcggcggtgctgcatctggctttggcggtggtgcccgacccgcaggcctgcctgcgcgaggtggagcgggtgctgaagcccggcggccgggcggtggtgttcgacaagttcctggccgacggcgcgcgcgcgccgttatggcgcagggccggcaatctgctggctcggctgctggccagcgacgtcaaccggcggctcggcgacatcgtcgccgtcaccaaattgcaaccgattcacgacgaagaagcgggcctgggtggtttctttcgcatcgtactcttgcgaaaatag

SEQ ID NO: 4344 - DNA, 765 bp, Chromobacterium substugae
atgaatctgtttgttgaaacgctgggccaggggccggacgtggtcatgttgcacggctgggggctgcacggcggcgtattcgcccgggtggccgaacatctggcggggcgtttctgcgtccatctggtggatctgcccggccatggcgcgtcgccggcgctggccggtttcgacgccgacgcggtggccgacttggtcgcgtcccatttcccgctgcccgtgcaggtggtgggctggtcgctgggcggcctgatcgcccagcactgggcggcgcgccatcccgaacgggtgaagagcctggcgctggtgtcgaccagcccgcgcttcgtccgcgacgaaacctggccgcacgcgcaggagcgcaaatcgatagaagccgtcgcccagagcctggacggcgctttcgagcagacgctggagcgcttcctcgcgctgcagatgatgggcgcgccggcggcgcgcgacaccctgaagtccttgcgcggcgagctgttttcccatggccggccgcaaggcctgctgccggcgctgcagctgttgctggaggccgacgcccgttcgctggccggccgcatccgctgcccggcggcgctgttctgcggcgcgcgcgacgccatcaccccgataggcgccggccgctggttggctgaggcattgcccgacgccgtcctttacgaattcccgcaagcctcgcacgcgcccttcctgtcgcatgaacaggatttcgtgcgcgcgcttgcccagcatctggaagcccaggcatga

SEQ ID NO: 4345 - DNA, 909 bp, Chromobacterium substugae
atgagtgaagcgttttataccgacaaggcgcgggtgcgcgcctcgttcgaaaaggccgcggccagctacgattcggcggcggtgctgcagcgcgaggtgtccgaccggatggccgagcggctggagtacatcaagcatcagccggcggtgattctcgacgccggcgccggcaccggctacggcgccgcgcaattgcgcggccgctacccgcaggcgcgggtgctggagctggacctggcgcatgcgatgctgctggcctcgcgcgagcgcggccgcgccggcgacggcctgttgaaaaagctgttcaagcccagcctgccgtggcaggtagtggccgacatcgagcggctgccgctggccgacgacagcgtcgacatgatctggtccaacctgaccatccagtggatcaacgtgccggacaagatgttcgccgagctgcgccgggtgctgaagcccgatggcctgctgatgttctccacgctgggtccggacacgctgcacgagctgcgcggcgccttcgccggcgtcgacgccgccacccacgtcaaccagttcatcgacatgcacgacatcggcgacgcgctgatgcgcgccggcttcgccgagccggtgatggacatggaaaagatcgtattgacctacgacgacgccaaaggcgcgatgcgcgacctgaaggcgataggcgcgcacaacgccaccgctggccgcggccgcggcctgatgggcaaggcggcctggcgcaaggtggaagaagcctatgaaaagcaccgccgcgacggcaagctgccggccagctacgaagtggtgtacggccacgcctggaaaggcagcggcaagaaggtggccaagatgaccgacgacggccgccaggtgatcgaattcgtcaagaaagcgccgcgcgccgattga

SEQ ID NO: 4346 - DNA, 549 bp, Chromobacterium substugae
atgcgtgtggacatccgcaatgcctgccgcgaagacgcggcgagtttggccgccctgtcgatccaggtgtggctgagcacctatgcgttcgacggcatccgccaggcgttggccgactacgtgctgacggaattcacgccggaaaagatggcggccctgatcgccgatccggcgcgtcagctgctggtgatggagaaagacggccatctgctgggttacgcgcagctgaaactggacgcagcctgcgagggctgcgatgccccgtcgctggaagcggagcgggtctatctggtggagagccataccgggcatggcctgggccggcggctgatggacgcggcgcggcaatgggcgctggcgcagcccggccagccgcggctgtggctgcgcgtgtggcatggcaacgcgcgcgcgatcgcgttttaccgccgcgtcggcatggcgctgcacggcgagacccattttgaattggagggcgcgcggcatctgaattacgtgatgctggatcccgcgcccattggggcggccatggcggccgtcgatgtctga

SEQ ID NO: 4347 - DNA, 900 bp, Chromobacterium substugae
atgattagcaagagcattctacgtcccgcgctgctggccgggatcgcctccctgttgtccgcctgcatgaccgccacgccgccggagagcgccgccgtggccaaacccttgcccaagcccaggatcgcgctggcgctgggcggcggcgcggtgaagggcttcgcccacatcggcgtgatcaaggtgctggaaggggccggcatcacgccggacatcatcgttggcaccagcgccggcagcgtggtgggaagcctgtacgcctccggcctcaccggcatgcagctgcagcagcgcgccatcgcgctggaccaggccgatctgaccgactggacgctgtcgaccaagggcgtgctcaagggcgagaagctgcagaactggatcaacgcccaggtgggcaaccggccgctggaaaaactgggcaaacctttcgccgcggtggccaccgagctggattccggccgccgggtagtgttccgcaccggcaacaccggccaggcggtgcgcgcctcggccagcatccccaatgtgttcctgccggtgaagatcggcggcaagagctatgtcgacggcggcctggtcagcccggtgccggtcagcgccgcccgcgaaatgggcgcgcagttcgtcatcgccgtcgacatcaccggccgtcccaagcccggccgcgccaccggcttcctgtcgatgctggaccagagcctgagcatcatgaacggcccggcgctgacgcaggagctgaagcaggccgacgtggtgatccacccgaacgtgctgaacatcggctcggccgaattcgaagcgcgcaaccaggccattctggaaggcgagaaggcggcgcagcagatgctgccgcagattcgccaattgctgcagcaaaagagcctggcgctggctaaataa

SEQ ID NO: 4348 - DNA, 651 bp, Chromobacterium substugae
atgatcaaacttcacggtattccgctatcgccttattacaacaaggtgaagatcgccttgctggagaagggcgtcaatttccaggaagtggtgacgacgccctcgcaagaggacgagctgctggaaaagagcccgatgggcaagattcccttcgttgagatcaatggccacccgctggccgaatccacggtgatcctggagtggctggaggatgcctatcccaccgcctcgctgctgccgccgacgcccaacagccgcgcgctggcgcgcgagctgaccgcgatgcttgagttgtacgtgatgctgccggccagcccgctgatccgccacatgctgaaaggcacccggccggagccggagaaatgcgaggagatccgccaggcgctggcgcgcggcatcggcgcggtggccaagctggcgcagtgccgtccttggctcgccggggaggatttcagcttcgccgacctcagcgccgccggcatcctgccggtggtggcgcgcttgagccagacttttctcggcgaggacatgacgctgcggctgtctggttgcggcgaatacctgcagcgcttgggctgtcgccacagcgtggcccgcgtctgggccgaccgcgacgcttcgctggcggcgctgatggcgcgccgcgactag

SEQ ID NO: 4349 - DNA, 888 bp, Chromobacterium substugae
atgaagtttccggttgagttgatcctgctggcgctggtgccggtattcctgttgttcgtcgccggcgagctgtggctgctgcggcgcggcggccgcatcggcttgtatgatctgcgcgactcgctctgctgcgccgcgctgggcctgttgcaccagggcgccgacaagctggcctggctgttggtgctgcccctgtacggctggatctaccaacatcaccgcctgttccagttttccgatagctggctgagcttcttcctgttgttcctggggcaggatttcctctattactggttccaccgcgtcagccaccgcgtgcgctggctgtgggcggcgcacagcgtccaccacagttccacccggatgaatttcaccaccgctttccgtcagagcctgatgtacccgttggcgggcatgtgggcgttctggctacccttggcctgggtgggctttccgcccgagcaagtggtggcggtggtgctgctcaacctggctttccagtttttcgtccatacccagggggtgcccaagctgggctggctggagtacgtgttcaacaccccgtcgatccaccgcagccaccatgccaagaatccgcgctacatcgatcacaactacgccggcgtgctggtggtgtgggaccgcctgttcggcacttatgccgaggagctggacagcgaaccgtgcgactacggcaccgtgaagccggtgaacagcttcaacccgctatgggtcagcgtggcggaatggcgcgacatgctggccgaggcatggcgcgccgataactggcgcgaccgctggctggcgctgttcggtccgccggaggcggcggaagaggcggcttcgcgccagcgcgcgcggctgcaggcgcagcgtcaggccgcttga

SEQ ID NO: 4350 - DNA, 765 bp, Chromobacterium substugae
atgcagtgtctgagcagcaagtggcgcttcgttcgccatatcagggagataacaatgaaacaaccgatattgatcgccagcattctgggcggcggcatcgcgctcggcgccatcggggtagccggcatccaggccttgaaaccggcggcgccggccactccggccactgtcatcccggccagcgcgccgctggccgcggcatccgcgccggccgtgcaggcgctggcgcccagcgccgcctccgccgtggtggcgcaagccgcgccgaaagcggccgcgcccgccgccgccgctgctccggccccggcgcccaggccgaagccggttcacgccagctatgccaaggtgctgggcgtcacgccgatcaagcagaccgtcagcgagcccaagcaggtctgccatcaggagcaagtggcgcatcaggcgccggtgcaggacaacaaccgcatcgccggctcggtgatcggcggcgtggtcggcggcctgctcggcaaccaggtgggcggaggcaacggcaagaaggccgccaccgtgatcggcgcgctggccggcggcctggccggcaacaaggtgcaggaaggcatgcagcagcgcgatcaggtgaccagcacccagaccatctgcaacaccgaaaacgtagacaaggaaaaagtggtcggctacgacgtccgctactcgctggacggcaaaaccgccacggtgcggatggatgagaagccggagggcaagaccctgccggcgaaagacggcaagctgctgatgtga

SEQ ID NO: 4351 - DNA, 1371 bp, Chromobacterium substugae
gtgagcgaaacccaaaccggtttgaagcgagagctgaaaaaccgccacatccagctgatcgcgctaggcggcgcggtcggcaccggcctgttcctcggttcggccagcgtgctgaagtcggctggcccgtcgatgatcctcggctacgccatcgccggcttcatcgcctttctgatcatgcgccagttgggcgagatggtggccgaagagccggtagccggctcgttcagccatttcgcctaccgttactggggcaagttcgccggcttcctgtccggctggaactactgggtgctgtacgtgctggtcggcatggccgaactgaccgcggtgggcgagtacgtgcgctactggtggccgaatgtgccgacctggaccaccgcactggtctgcttcgtcgcgatcaacggcatcaacctcgcgaacgtcaaatcctacggcgagtccgagttctggttcgcgctgatcaaggtggcggcggtgatcgcgatgatcgtcttcggcggttacctgctgctgtcgggcaccggcggtccgcaggcttcggtcagcaatctgtggaacgatggcggtttcttcccgcacggcgtcaatggcctgttcatgatgatggcggtgatcatgttctctttcggcggcctggagctgatcggcatgaccgcggccgaggcgtccgatccgcagaagaccatccccaaagccgtcaaccaggtgatctaccgcatcctgatcttctacatcggctcgctggtggtgttgctgtcgctgtacccgtggagcaaggtggccgccggcggcagccccttcgtgatgatcttcgagcagatcggcgccggcttcaccgcccacgcgctgaacttcgtggtgttgaccgcggcgctgtcggtgtacaacagcggcgtctacgccaccagccgcatgctgttcagcctggcggagcagggcaacgcgccggccggcctgaaaaagctggacaagcgcggcgtgccggtcaacgcgacgctggtgtcggcgatcgccaccttcgcctgcgtgatcctcaactacctgttgccgggccaggctttcggcatcctgatgtcgctggtggtggcggcgctggtgaccaactgggcgatgatcagcctgacgcacttgaagttccgccgcgccaaggccggcctggcgctggtgttcccgtcgatctggttcccggcggccaactggctctgcctggccttcatgatcatgatcctgggcatcttgctgttcacgccggggatggcggtgtcggtctacgtgctgccgctgtggctgggcctgttgtggctgggtttccgcctgaagaaagccgggccggccgatggcaggctggttggcgaaaacgtctga

SEQ ID NO: 4352 - DNA, 162 bp, Chromobacterium substugae
ttgaaccatcatgaagcagattatttcactccaaagccgaaattggtggtggcgcggctaagccggcgcgccaggagtgttcgtatccgctttccgggccgccgtcatgggcggccttgttgtatccagcttttcaccccgtgcggcggcaaactgttctga

SEQ ID NO: 4353 - DNA, 1314 bp, Chromobacterium substugae
atgccgcgcacgcaatggggttcccgcctcggtttcattctggcttcggccggcgccacggtgggcctcggttccatctggaagtttccctacgtcaccgccatgaacggcggcggcgcgtttctgctggtgtatctggcttttaccttcaccatggggctggccctgctgcaggccgagctggcgctgggccgcgccgccggctgcggcgcggtgggcgcgttcgcccggctgggatcgccgcgctggaagctgctgggctacggcggcgtgctgtgctgcttcctgatattttccttctacagcgtagtcggcggctggacgctgggctatctgctgcgcgcgctggacggccgggtgatgagcgatgacgtcggcgcgctgggcgccttgttcggccagtacgtcggcaatccggccgaggcgctgctgacccacgcgctgttcgccggcctgacgctgttggtggtggcgggcggcgtgcaaaaaggcatcgaacgcatgggcaagctgctgatgcccttgctgttcctgctgatgctgggcctgatcgcccgcgccttgaccctgcccggcgcgatggcaggggtggaagcgttgttccggccggatttcgcccggctgacgccgggcatgctggtggaggcgctgggcctggcttgcttctcgctgtcggtgggcgccggctgcatgctggcctacggctcctacctcgggccgggcaccaggctcggcaattccgcgctgtgggtgaccggcctgacggcgctgacctcggtgctggccggtttgatgatcttccccgccatctacgccttcggcctgaatccgcaggccggtccgggcctgacttatatggtgatgccggtggtgttcaaccacctgccctacggccagctgttcgccaccgctttcttcgcgctgctgctgatggcggcgctgacttcggcggtgtcgctgctggaggtggtggccatcctgccgatagacgagttcggcgtcggccggcgccaggcgacgctggcggtgaccgcgctggccttcttagccggcgtgccggcggcgctgtcgttcggcccgctggcggattgcaggctgttcggccgcaacgccttcgagctgatggactacgccgcgtccaatgtgctgttgccgctgggctgcatcggcaccgccttgttcgccgggcgcgtggcgtggccggcggtgcgggacgagctgcggctgtccgcgccggctgcgctgctgatgcgcgtcgcctgccgctggctggcgccgctgctgataggcctggtgttggcctacaacctatag

SEQ ID NO: 4354 - DNA, 324 bp, Chromobacterium substugae
atgaactcatggcaacactgggcggccatcatcggcatgctggccgccacgctggcgatacgcgccagcttcctggtcttcggccagcggctggcctttcccggctggctgaaccgcgcgctgcactacgtgccggcggcggtgctgtcggcgctggtggcgccgatggcgctggcgcccgccggaaccatagacctgtcctggcataacgcctatctggccggcaccatcgtcgccatcgccgtggcctggaaaaacggcaaaacgctgctggccatcgtggtcagcttcgccgtctacggcgcgctgcgctggctgctatag

SEQ ID NO: 4355 - DNA, 711 bp, Chromobacterium substugae
atgccttccttatccgaccgccgccgctggctgctggacggcgcgcgcgacaccatcccgatgatggtgggcgcggcgccgttcggcgtgatcttcggcaccctggccatcgccgccggactgtcgcccgccgccacggcggcgatgtcgctactggtcttcgccggttcctcgcagttcatcgccgtcagcctggtttccgccggcgccgccctgccggtgatctggctgaccaccttcgtcgtcaacctgcgccacgcgctgtacagcgccacgctgctgccctacgcgcggccatggccgctggcctggcgctggccgctggcgttctggctcaccgacgagaccttcgccgtggtggagcaccgcttccgcagcctgggcgcggacggcggccagtggtattggctgggatcgtcgctgtcgatgtatctgaactggcagctatggacgctggccggcgtggcgctggggcgctcggtgccggggctggaccaattggggctggatttcgcgatggtggccaccttcgccgccatcgtcgcgccgcagctgaagaagcggccgacgctggccgcggcgctggcggccggcgcggtggcgctgctggcgcgcggcctgccctacaagctggacctgatgctggcggcgctggccggcgtcgccgccggcatgctgctggaacgcggacagaaacgggaggcggcatga

SEQ ID NO: 4356 - DNA, 834 bp, Chromobacterium substugae
atgcccgcctcttccgccgaacgctccgagctgttccgcgccgacgacctcggcgcgctggaatgcctggacgcgcaatacgccgagcggaccttcccgccccacttccatgaacaattcgtcgtcaacacgctgaccctgggcgcgcagtcctaccgccaccgcggcggcctgcaccgcgccggcgtcggcgcgctggtgctgatcaaccccggcgaagtgcacaccggcgagaccgcgcacgaaaacggctgggcctaccgcggcttctatcccggcgtcgacatgatgggccggctggccgccgacctgaacggcaaggccggcctgccctatttccgcgacaccgtcgtcgtcgaccccggcctcgcgcgccggctggacagcctgcacctgctgctgcgcgacagccgcgacgccttgcggcgcgaatcggcgctggccgcggtgttcagcgaggtgttggtcaaatacatgcggctgcgcccggacgagccggcatccgcccccggccccgtggaaaccgtcaggcagatgctggccgacgatcccgccgccaaccactcgctgcagcagctggcggcggcggtcggcttgtcgccgtggcaattgtgccgcctgttcaagcgcgagaccggcctgccgccggtggcctggcgcaaccagctgcgggtggcgcgcgcccgcaagctgctggcggccggcatgcggcccggcgcggcggcgctggaactgggcttcgccgaccagccgcacctgacccgcgcgtttcagcagacgctgggcgtcacgccggccgcctatcaaaaggccgtgggcgcgcgcccccgctga

SEQ ID NO: 4357 - DNA, 648 bp, Chromobacterium substugae
atgttcaaaacgttgtcgctgcaattcctgtttggcggtctgctcagcctgatcaccatcaccaacccgctgtccaagattcccctgttcatcacgctgacccgcgagatgagcgatgccggccgcgccagccaggcccgccgcgcctgcgtgttcgccgccgccatcatggtggtgagcctgctggccggcaacctgatcatggctgccttcggcatttcctacggcgcgctgcgcatcgccggcggcttcgtggtggcggtgctgggctaccggatgctgttcctgtcgcaagaccctggccagacgcccaagcaatcgggcgaacgcgaggactacgcgttcttcccgctggcgatgcccggcatcagcggccccggcaccatcgcggtggtgatcggcatctccaccgagatcgccgaactgaccacgctgccggccaaggcgctggccttcgcgatgaccttcgccgccatcggcctgacctgcgccggcatgtggctgacgctgaagtcgtcgcagctgatctcggcccggctgggccgcggcggccgcgaggtgatgacgcggctgatgggctttttgctgatctgcatcggcgtgcagttcgtcggttccggcatccgcaccttcatggccggctcctaa

SEQ ID NO: 4358 - DNA, 117 bp, Chromobacterium substugae
atgatcgatggggaagggaaaaccgcgccactttaccatggccgggcgcgcgggcggcgcggcaaaatgtcgcaggcgtcggcgcggctgccacaccccgccatgccgctggtttaa

SEQ ID NO: 4359 - DNA, 462 bp, Chromobacterium substugae
atgaaacgtttcgccgccgccttgttcggcctgtgcctgtccggcctggccgccgcccattccttccagctgggcgacatccacatcggccatccgtggagccgcgcgatgccggcgaccagtcccaccggcggcgtctacctgtcgctgaagaaccagggcaagaccgaagacaagctggtgtcggccagcaccccgcgcgcggaagccgccgaactgcacacccacgtcaacgacaacggcgtgatgcggatgcgcaaggtggaaggcggcgtggcgatcgcgccgggccagaccgtgaaattcgccccgggcagctaccacgtgatgctgatgggcctgaagcagccgctgaacaagggcgaccacttcccgctgacgctgaagttcgagaaggccggcagcgtcaccgtggacgtggtggtgcaggacggcggcgaaggcgacagccacagccactga

SEQ ID NO: 4360 - DNA, 1512 bp, Chromobacterium substugae
atgctgtgcttttgtcccgccatcgactttcgtcatgaccacctccgtttcctccccgcttcccgccgccttgccccgggtcgtcatccactattgcaccggttgccgctggctgctgcgcgccggctggctggcgcaggagctgctgaccaccttgaaagagttgaccgaagtggcgctgcgtcccggcagcggcggcgtgttccgcgtcgaggtggacggcgaattgctgtgggaccgcaaggcggaagacggctttcccgagctgaaaatcctcaagcagcggctgcgcgaccgcatcgcgccggacaaggcgctgggccacagcgaccgccaatcctgacttccgccgcgatgaacgccccgctgcgcaagatcatccacgtcgattgcgactgcttctacgccgccatcgaaatgcgcgacgaccccagcctgcgcgaagtgccgctggcggtgggcgggcggccggagacgcgcggcgtgatcgccacctgcaattacatcgcgcgccgttacggcgtgcattcggcgatgtcgtcggcgcgcgcgctcaggctgtgcccggagttggtgatcctgccgccggacatggcgcgctaccggctggccagccagcagatcatggccatttaccagcgctacaccgaggtgatcgagcccttgtcgctggacgaggcctatctggacgtcaccggccagccgcacgagcagggcagcgccacgctgatggccgaggcgatccgccgccagatccgcgaagaggtgggcatcaccgcctcggccggcatcgcgcccaacaaattcctggccaaggtggccagcgactggaacaagcccgacggccagttcctggtgcggccgcgcgacatcgacgccttcgtcgcgctgctgccggtggagaaggtgcacggcgtcggccgggtcaccgccgagcgcctgcaccggctgggcatccgcagctgcggcgacctcaggcgctggaccgcggccgacctgttccgccatttcggccgtttcggcgaacagctgctggcgatggcgcagggggtggacaaccgcccggtgtcgaccgaccgcagccgcaaatccatcagcgtcgaggaaacctacgcgcaggacctgccggatctcgccagctgcctggggcggctggcggagctggtggaccggctgcaggcgcggctggcgcgcaacggcaatcccgaattcaagggcctgtcggtgaaactgaagttcgacgatttcacccagaccacggtggagcagcccggctacgcgctggggatggcggccttcggccagctgctgcgcaccggcttcgcccgcggcgcgcggccggtgcggctggtgggagtgggggtgaagctggcggacgagcacgacctgccgcgccagctgcggctgttcggccgcgacggccggccgctgccggacacccagccggacggccaggccgagctctccgccgatgcccagccggacggcggcggcccggctagtcgcgcttga

SEQ ID NO: 4361 - DNA, 1098 bp, Chromobacterium substugae
atgaagacacccctgattaagcgcatctggctgcagatcaaggagccgctggacggctggatgatgctgttcctggggctgatcttcgcggtcagcatggtgctgctgtactccgccaacaaccagtccttcgacaagatagacaacaagctggcctataccgtgctgtcgctgctggtgatgtggctgatcgcccgcatgcggccgcaaagcgtgatgaacttcgcgccgccgatctacgtgctgggcgtgctgctattggtggcggtgcatttcaagggcatcaccgtcaacggctccacccgctggctgaacctgggcgtcacccgcatccagccgtcggaaatcctcaagatcgcgctgccgatgatgctggcctggttcttccagaaatacgaactgtcattgcgctggtggcattacctgatcgcggcgctgctgatcgccattcccagcgcgctggtgctcaagcagcccgacctcggcaccacgctgctgatcgccgccgccggcctgttcgtgctgttcttcgccggcctgccgtggaaggtgatcctggccggcgcggtgatgttcgccgccagcctgcccctggtgtggaaccatctgcacgactaccagcgcaagcgggtgctgaccctgatcgaccccaccaccgacccgctgggcaccggctaccacatcatccagtcgatgatcgccatcggctccggcggaccgtggggcaagggctggctcaacggcacccaaacccacctcgactacatcccggaacgcaccaccgacttcatcttcgccgtgtattccgaggagttcggcctggccggcaacgtggtgctgctggcgctgtacctgctgatcctcagccgcgcgatgatgatcaccgccagcgcccagaccctgtacggccggctgatggcggcgtcgatcaccatgtccttcttcgtctacgccttcgtcaacatgggcatggtgtccggcatcctgccggtggtcggcgtgccgctgcccttcatgtcctacggcggcaccgccaccgtcacgctgttcatcggcatgggcatgctgatgggcatcagcaatctgcgccggctgtaa

SEQ ID NO: 4362 - DNA, 1941 bp, Chromobacterium substugae
atgcgccgccccgcccgtttcaagaatccgcaaactgaagaagaagagtttcagctgcggctgatcatcgcctacggcctgatcatcctgatgttcctgctccttctggcccgcttcgtctggctgcaggtgctgcagcacgaccatttctccacgctggcgcagaacaaccgcatttcgctggtgcccatcctgcccaaccgcggcctgatcctcgaccgcaacggcatcgtgctggcgcagaactactccgcctacacgctggagctgacgccgagcaagattcccgacctcgccgccaccatagacaagctgaagaagctggccgacgtcagcccgcgcgacgagaagctgttcaagaagctgctggccgaaagcaagaatttcgaagccattccgctgaaggtgaagctcaccgacgaggaagccgcccgggtggcggccaacgcctggcagtttcccggcgtcgaagtgaaggccaggctgttccgcgactatccgtacaaggaaatgaccagccacgtgctgggctacatcggccgcatcaaccagaaagaccaggaacgcctcgccgacgaggacaagaccaccaattacaagggcagcaactacatcggcaagaccggcctggaagcggtgtacgaggaagacctgcacggccaggtcggcttcgaggaaatggaaaccgactccggcggccgcgcggtgcgcagcctgcgccgcacgccgccagtcaacggcaacacgctgaagctggcgctggacatccggctgcaggaaatggccgacaagctgttcggcgagcgccgcggcgcgctggtggcgatagacccgtccaccggcggcgtgctggccttcctgtccaaacccggcttcgaccccagcctgttcatcgacggcatcgacagccagacctgggccgcgctcaacagcgactggcagaagccgctggtcaaccgcgcgctgcgcggcacctatccgcccggctccaccttcaagcccttcatggcgatggcggccctcaccacccacagcataggcctgcacgacatccgtccggcgcccggctatttcacgctgcccggctccagccaccagttccgcgacagcaagaagggcggcaatggcatggtcaacctgcagcgcgccatcaccgtctccagcgacaccttcttctacaagctggcctgggacatgggcatagacaagatccacccggtggtcggctccttcggcctgggcagcaagaccggcatcgacctggatggcgaggccagcggcgtgctgccgagcaaggaatggaaggccaagcgtttcgcccgctacaagcccgaggtgcggcgctggtatccggccgacgtggtcagcatcggcatcggccagggcttcaacgcctacaccccgctgcagatggccaacgccaccgccatcatggccaacaacggccaggtgttcaaaccgcacctggtgcagcaggtggtggactccaaaaccggccaggtgcgccagatcgaaccggcgccggtccggcagctgccctatccgcaggagtacttcgactacatcaaggaaggcatgcacaacgtgatgatctcgggcaccggcgcccgcgtcggcgtcggcctgaagtattcgatggccggcaagaccggcaccgcgcaggtggtggcgatcaagcagggcgccaagtacaacgccgccgcgctggccgagcaataccgcgaccacagctggttcatcgccttcgccccggtggaaaaacccaagatcgcggtggccatcatcgtcgaaaacgccggtttcggcgccgccgccgccgcgccggtggcgcgcggcctgttcgattactacctgctgggcaaggtgccgaccgacctggccggcctgctcaagaccgtaccgatggaaaacggggacacgcatgaagacacccctgattaa

SEQ ID NO: 4363 - DNA, 504 bp, Chromobacterium substugae
atgtcgttggaccgtcccaaggaattgctcaagccggtcaagcgccgcttcatcctgctcaccttcgtcgccgcggtgctggtcgaactggtgccgctgccgcatggcagcacccgctggctgcccgatttcatcggcctcttgatcctgtactgggtgatcaaccagccgcgccgcgtcaacatcggcatcgccttcatgatgggcatcatcgccgacgtgtccaccgccggcctgttcggccagcacgcgctggcctattcggtcaccgcctttctcgccttgagccgccagcgccagctggtgatgttcaacctggggcagcaggcgctggtggtgctgggcctgatgctgaccaaccagatcatcatggtggtggtgcggatgctgaccggctccgctttcgtcggctggagctatttcctgccgccgctgataggggcgctgctgtggccgctgttgaccaagctgatgttgattccctatcgccaccactcggtatga

SEQ ID NO: 4364 - DNA, 909 bp, Chromobacterium substugae
atggatttcgccaacacccccagctttttccgctccgggccgcctccggctgcgcgcctggcgatgagcgcagtggcctcgatcgcgctattgataggcgacagccactacggcctgatggaacaagcgcgggaagccctgtcgctggcgctgtacccggtgcagcgcgcggtcaacctgccggcgcaggcggtgcgccacgccggcgactacctgacctcccagaccgagctgaagcaggaaaacaccgagctgcgcacccgccagctgcagatgtcggcgcagctgtcgcggctgcagacgctggagcgcgagctgaacgaattgcgcgcgttgaacgccatccgcgcccagcgcgacgactcggcgcagatcgccgagacgctgtacaccggccgcgacccgttctcgtacaagatcatcatcgacaagggcgacgacgccaagctgcaggccggccagccggtggttgacccgcgcggcctcttgggccaggtgacgcgggtgcagccgctgaccgccgaggtgacgctggtcatcgacaagaaccagatggtgccggtgatgatcgcccgcaccggcgagcgcgccatcctctatggttatggtggcggcgtcgagctgcgctatctgccgcaaagctccgatgtgaaggaaaacgaccaggtggtgacttccggcctggacgggctgttcccggaaggcattccggtggcggtggtgagcaaggtggagcgcaatcccggcgccgccttcacccgcgtcagcaccgtgccgctggccggcgtgcagcaaacccgctacgtgctggtgctgcaggcccgcgaaacccgcgcccgcccggccgaggcgccggcgattgtagagaaaaagaccaggggcggcagaaaggccgccgccgaggagtag

SEQ ID NO: 4365 - DNA, 1044 bp, Chromobacterium substugae
atgtttcgttcgctgaccggatacttctccaacgacctcgccatcgaccttggcaccgccaacaccctgatctacatgcgcagcaagggcatcgtgctggacgagccctccgtcgtggccatccacaacgacgcgcccaccaacaagaagtccatcctggccgtcggcctggaagccaagcgcatgctgggccgcaccccgggcagcatccaggcgatccgtccgatgaaagacggcgtgatcgccgacttcaccgtcaccgagcagatgctgaagcagttcatcaagaaggtgaacccgaaccgcttcttcgccgccagcccgcgcatcgtgatctgcgtgccctgcggctccacccaggtggagcgcaaggcgatccgcgactccgccctggccgccggcgcgcgccgcgtcgagctgatcgaagagccgatggcggccgccatcggcgccggcctgccggtggaagagccgaccggctcgatggtggtggatatcggcggcggcaccaccgaggtgggcgtgatctcgctgggcggcgtggtgtacagcaacagcgtgcgagtcggcggcgacaagttcgatgaagccatcatcaactacatccgccgcaactacggcatgctgatcggcgaaaccaccgccgaggaaatcaagaaaaccatcggctccgccttccccggcgccgaagtgcgcgaaatggaagtcaagggccgcaacctggccgaaggcattccgcgcgccttcaccgtgtcttccaatgaaatcctggaagcgctgaccgagcccctgaatcagatcgtctccgcggtgaagatcgcgctggagcagaccccgccggaactgggcgccgacatcgccgagaagggcatggtgctgaccggcggcggcgcgctgctgaaggacatcgaccgcctgctcgccgaggaaaccggcctgccggtgttcgtcgccgaagaaccgctgacctgcgtggtgcgcggctccggcaaggcgctggagaaaatggacaagatcggcaccattttcaccaacgtgccttaa

SEQ ID NO: 4366 - DNA, 288 bp, Chromobacterium substugae
atgtcgctgacgcaccaggatgtcgcacggattgccaagcttgcccgcatcgatgtgaacgaggcggaaatcgccgccactgcggacaagctcaacgatattttcagcctgatcgagaagatgcaggcggtggacacctccggcatcgagccgatggcccatccgcaggacgtgtccttgcggctgcgcgacgacgccgtcaccgaaaccaaccggcgcgaggccttccaggcggtggcgccgcaagtggaaaagggcctgttcctggttcccaaagtgatcgagtaa

SEQ ID NO: 4367 - DNA, 1452 bp, Chromobacterium substugae
atgacacaagccaccctcaagcaattgtcgcaacagctggcggccaaggaagtttccagcgtggaactggccggccagtatctggaccgcatcgaggcgctgaatccggcgctcaacgcggtgatcacggtagaccgggacaagaccctggccgaagcccgcgccgccgacgcgcgcatcgccgccggcgacgcccacccgctggccggcgtgccgctgctgcacaaggacctgttctgccagcaaggctggaagaccagctgcggctcgaagatgctggacaacttcgtctcgccttacagcgcccacgtggtggagcaatgcgccgccgccggcatggtgacgctggggcgcgccaatatggacgaattcgcgatgggctcgtccaatgagaattccttctacggcgcggtgaagaacccgtgggacctgaacgccattccgggcggcagctccggcggctccgccgcggccgtcgccgcgcgcctggcgccggtggccaccgccaccgacaccggcggctccatccgccagccggccagccattgcggcgtcaccggcatcaagccgacctacggcgtggtgtcgcgctacggcatggtggctttcgcttcctcgctggaccagggcggcccgatcgcccagaccgccgaagactgcgcgctgatgctgaacgtgatggctggcttcgatgcgcgcgactccaccagcctggagcgcgcccgcgaagactacagccgcgatctgaaccaatccttggccggcctgaaggtgggcctgcccaaggagtacttcgcagccggcctggatggcgaggtggcgcgcgcggtcgacaacgcggtggccgaactgaagaagctgggcgccgaggcggtggaagtcagtctgcccaacaccgagctgtcgatcccggcttactatgtgatcgccccggccgaggcctccaccaacctgtcccgctacgacggcgtccgctacggccaccgcgccaaggactacaaggacctggtggaaatgtatgaaaagacccgcgccgaaggtttcggcgacgaggtcaagcgccgcatcctggtgggcagctacgtgctgagccacggctactacgacgcctactatctgcaggcgcagaagatccgccgcctgatcgccaacgacttcaaggccgcgttcgaccagtgcgacgtgatcctggggccggtggcgccgacagccgccttcgatttgggccagatgtcttccgacccggtagagatgtatctgtccgacatttataccttgtcggtgaacctggccggtctgcctggcatgagcgtgccggccggcttcgccgccaacggccgcccgatcggcctgcagatcatcggcaactacttcgctgaagccaagatgctgaacgtcgcgcaccagttccagcaggcgacagactggcacgccaaggcgcccgcgctgtaa

SEQ ID NO: 4368 - DNA, 1449 bp, Chromobacterium substugae
atgaataaggattttccgaccatgaaatgggaagtcgtaatcggtatcgaggtgcacgtgcagctcaataccgtctccaagattttctccggcgccagcaccgccttcggcgccgaaccgaacacccaggcttccgcggtggagttggcgctgcccggcgtgctgccggtgctgaaccgcgcggtggtggacaaggcgattcgcctgggtttggcgctggacgccaacatcaaccagaagaacgtgttcgcccgcaagaactacttctatccggaccttcccaagggttatcagatcagccagatggacctgcccatcgtcgagggcggcaagctcaagattctggtcggcgatcaggaaaaggtcatcggcgtgacccgcgcccacatggaagaagacgccggcaagagcctgcacgaagacttccagggcctgtccggcatcgacctgaaccgcgccggcacgccgctgctggaagtggtgtccgagcccgacatgcgctcggtcgacgaggcgctggcctacgtcaaggccttgtacacgctggtgacctggctgggcatctgcgacggcaatatgcaggaaggcagcttccgcatggacgtcaacgtatcggtgcgcccggaggggcagaaggaattcggcacccgccgcgagatcaagaacctcaactccttccgcttcctggagcaggccgccaagtacgaaatccagtggcagatcgacaccctggaagacggcggcaaggtgcagcaggccaccgtgctgttcgacccggacagcggcgagacccgcatgatgcgcagcaaggaagacgcgcacgactaccgctacttcccggaccctgacctgctgccggtgcgcatctccgacgagcagatcgcccgcatccggggcgagatgccggagttgccggccgcgatgcaggcccgcttcgtggaaagctacggcgtgtccgcctacgacgcggcgctgctgacttccagcctggctcaggccgagtatttcgaagccgtggccaaggcttccggccagggcaagctggccgccaactggatcaacggcgaaatcgccgcgcggctgaatcgcgacggcaaggacatcgccgattgcccgatctcggtggcgcgcttgtccggcctgatcgtccgcatcgccgacaacaccctgtccagcaagctggccaagcaggtgttcgaagcgctgtgggacagcgaactgtccgccgatgacatcatcgagcgcgacggcctgaagcaggtgtccgacgtcggcgctatcgagaagatggtggaagaggcgatcgccgccaaccccaaggcggtggaggaattccgcgccggcaaggaaaaggcgctgaacgcgctggccggccaggtgatgaaggcgtccaagggcaaggccaacccggcccaggtccaggatatcctgcgccagaagctgggctga

SEQ ID NO: 4369 - DNA, 402 bp, Chromobacterium substugae
ttggctattccggccaaacaccgcgagacactgctgtccgcgtttggccacaagctgatcgtcaccctggaatcccaagaccacctgctgctgtatcccgaacccaactggcgcccggtcgaggcccgcctgcttgcccttcccaccggcaatcccactctgaaacgctatcaacggctggtgcttggccacgccgaaaccctggaaatggattccgccggccgcgtgctgctgccggcccgcctgcgcgaactgaccgcgctggacaaggacgtcgccctggtaggcatgggcaaccgcttcgaattgtggaatgccgaggaatgggacagccagaccgccgacgcgctggccatcgaccaggccgacctggcccaacaccttggagacttcacgctgtga

SEQ ID NO: 4370 - DNA, 963 bp, Chromobacterium substugae
gtgagcacccccaccttcgtgcatcgcacggtattgctgaccgaagcggtcgacgcgctggccatccggcccgacggcgtctacgtcgactgcaccttcggtcgcggaggccacagccgtttgatcctgtcgaagcttggcccgaacggccggctgatcgccttcgacaaggacccggaagccatcgccgtcgccgaccggctggcggcggaggattcccgcttcaacatcgttcacaacggcttcgagacgctgtcgtcggaactggcgcgcctgggcgtggccggcgtcgacggcgtgctgatggatctgggcgtgtcctcgccgcagatcgacgacggcagccgaggtttcagcttccgtttcgacgcgccgctggacatgcgcatggataccactcgcggcgtcaccgccgccgaatggttggcaacggccgacgaggccgatatttctgaggtgatcaagacttatggtgaagagcggtttgctcgcaagatcgcagcagccattgttgcgcaacggggggaacaccccatcacgaccacgcgcgagctcgctttgctcgttgggcaaaacgtccgtactcgggaaccgggtcaagacccggctacgcgcaccttccaggcgatccggatctttgtgaaccgcgagctggacgaattgaagtcggtgctgccgcaggcggcgcgcctgctgggcgagcgcggccgcctggcggtgatcagcttccattcgctggaggaccgcatcgtcaagcagtacctgcgcgacgtcagcagcgaggaaaagctgccggcctgggcgatggtgcgcgcggccgacatggccaagccgcctatcgccctggtgggcaaggcgatacgcgccggcgacgaggaagtgcacgagaatccgcgcgcccgcagcgccatcatgcgcgtggccgagcgcaccgccgcgccgtggcgggaggcggacgcatga

SEQ ID NO: 4371 - DNA, 273 bp, Chromobacterium substugae
atgaacaagctcaacgcgatgctgctggcgatgaccgtcttctccgcctggtcggtggtgacgtccacccacgtgtcgcgcaagctttacagcgatctgcagaaggaaaccaagtccgggcagcagctggaggtggaatacggccagctgcagctggagcaaagcacctggggcgcgcacgcggtgatcgagaaggccgcgtccacccgtcttgacatgcataccccggatccgcgccagatccaggtgatatcccccggagggaagatttga

SEQ ID NO: 4372 - DNA, 1752 bp, Chromobacterium substugae
atgcgagccggcagcaactacagcgttcgtcagcggccgatgtcggccagtccgtccctgcgcatgaccagcacccgcgtgcgctgtgtgctgttgatgctggcgttgctgtttttcgcgctggtctgccgcgcgatgtatctgcaggtggtgcagcaggacttcctgcagaaccagggcgaggcccgttttcgccgcgcgctgacgctggaggccaaccgcggcgtgatcaccgaccgcaacggcgagccgttggcgatcagcaccccggtgcagaccatctgggccagccccgccgacatggagccggtgccgccggccaagctgcgcgaactggccgccttgctggatctgtcgccggaagagctgtcggccaagctgtccgaccgcaagaaggaattcgtctacatcaagcgccagatcagcccggagcaggctgacaaggtgatggcgctgggcattcccggcatcgccaagcagcaggagttccgccgcttctacccggccggcgaaatcgtgtcgcacatcatcggtttcaccggcgtggacggcaagggccaggaaggcgtcgagcttgcccgcgaaaagatgctggcgggcaaggacggccgccgcgtggtgttgaaggaccgccgcggccacatcatcgaagacgtcgccgcgatcgagccgccgcgcgacggccagaagctggcgctggcgatagaccaccgcatccagtacctggcctaccgcgagatcaaggccgcggtggaaaccaacaaggccaaggccggcagcgtggtggtgctggacgcccataccggcgaactgctggccttggccaactacccgtcgttcaaccccaacaaccgcgtcggcgtgacgccggaaatgatgcgcaaccgcggcgtgatcgatctgttcgagcccggctccaccatgaagccgctgtcgatcgcgctggcgctggagcacggcaaggccaatctgaacacggtgctggatacccacagctacatgataggcccggccaccatccgcgacgtgtcgccgcaggccagcctgggcattctcggcatcatccagaagtcgtccaacgtcggcaccagcaagctcgcgctgatgaacagcccggaagagttctggaagcactacgacgcgctgggcttcggccgcgcgcccaacaccggcttccccggcgaggccagcggccggctgcgcgactggcaccactggcggccgatcgagcaggcgacgatgtccttcggctacggcgtgtcggtcagcctgatccagatggcgcgcgcctacaccattttcgccaacgacggcgtgatgctgccgatcgcgctgtacaagaccagcaacccgatgccgggcaagcgggtgatcgacgtcaagaccgcgcacgagatgcgcgatttgttgatcgccaacagccagccgggcggcggcgccgtcggcggccgcatcatcggctacagcatcggcgccaagagcggcaccgcgcgcaagctggaaggccgcacctatgtggccaacaagcaccgcgcgctgttcatgggcttcgcgcccggccatgcgcccaaggtgatcgtggcggtgatgatagacgagccctccgccggcaaatattacggcggcgcggtgtcggccccggtgttctcgcaggtcgccggcggcgcgctgcgagtgctcaatgtgccgcccgacgagccatccaataacactttattgccggaatcgacccccgttccggcggatttctga

SEQ ID NO: 4373 - DNA, 1482 bp, Chromobacterium substugae
atgaagagtcgtctgatcgccttgccggactgggatccggccgcgttgaaccagctgggcctgaccatcaagcgagtggaggccgacagccgccgcgtgctgcctggcgacgtatttctcgcctgccgcggcgagttcgccgatggccgcgatttcatcgccgccgcgctggaaaaaggcgcggccgcggtgctgtgggacgacgccgacggcttcgcctggaatccggcctggcaagtgcccaacctggcggtgcccaatctgcgcgagcgcgccggcatcgtcgccgcccacgtgctgggcgagccggcgcgcgacctgaccgtggtcggcatcaccggcaccaacggcaagacctccatttcgcactggctggcgcaggccttttcgctgctgggccgcaaagcggcgttgatcggcaccgtcggcaacggtttttacggccaactgaccgaaaccacccacaccacgccggacccggtgacggtgcagcagaagctggccgaataccgccgccagggcgcgcacgtggtgacgatggaggtgtccagccacggcctggaccagttccgcgtcaacggcgtggccttcgcgaccgcggtgttcaccaacctgacccgcgaccatctggactaccacggttcgatgcaggcttacggcgaatccaagaagaagctgttcttctgggaaggcctgaagcaggcggtgatcaatgccgacgacgctttcggccgccagctggccgccgagatcgatcccaagattacgcaagtggtgacctacggcctggagcagggcgatgtccgtccgctggcgctggccgccacgctggaaggcctgcaaatgaccgtgaccacgccgtggggcgtgaccgacgtgcgcaccggcctggtcggccgcttcaacgccgccaatctgctggcctgtctggccacgctgtgcgtcaacggcgtcagcctgcaggacgccgccgcggtgatggcgcgcatccagccggcgcgcggccgcatgcagagcataggcggcacccatgagccgctggtggtgatcgactacgcccacacgcccgacgcgttggagaaggcgctggcgacgctgggcgaaatccgcccggccggcggccggctgttctgcgtattcggctgcggcggcgaccgcgatccgggcaagcgtccgatgatgggcgccatcgccgagaaacacgccgacgtggcggtgctgaccagcgacaacccgcgcagcgaggacccgcaggccatcatccgcgacgtgttggccggcatggacgccgcccgcgcgcacgtggaggccgaccgcgaggccgccatccactgggcggtgagccaggccaaggtgggcgacgtggtgctgatcgccggcaagggccatgaggaataccaggacgtcgccggcgccaagcggccgttctccgacttccgcgtcgcggaagaggcgctcaccgcctgggggcagcaagcatga

SEQ ID NO: 4374 - DNA, 1365 bp, Chromobacterium substugae
atgatgacgctgagccaagccgccgactttgccaaaggccgcctgatcggcgccgacggcgaagtgctgcgcgtgatcaccgacagccggctggcgcagccgggcgacctgttcgtcgcgctgaagggcgagcgtttcgacgcccatgacttcgtcgccgaagtgacggccaagggcgccgccgcgctggtgcgcgacggcttcgagctggcgggcgccagcctgatccaggccggcgacgacacccggctggcgttgggccgcctggccgccggctggcgcgccagccagcccgcggtttgcgtcggcgtcaccggctccaacggcaagaccacggtcaaggaaatgctggccgccattttgcgcgcgcacgccggcgcggacgccgtgctggccaccgccggcaatttcaacaacgacatcggcctgccgctgaccttgctgcagctgaagccgcagcatcgttacgcggtgatcgagatgggcatgaaccatcatggcgagctgcgctacctgaccggcctggcgcggccgcgggtggcgctggtcaacaacgcgatgcgcgcccacttcggccatttcggctccaccgctgaagtggcccgcgccaaggcggagattttcgaggggctggaagacggcggcgtggcggtggtcaacgccgacgacgccaatctgcccttgttccgcgccgccgccggcccgcatcgccaattgagcttcggcttgggcgcggacgcccagatcggcgcgcgcgcgctgcggatggatgcgctgcaaagccgcttcacgctggtttccccgcttggggagatcgacatcgcgctgccggctccgggcgagcacaacgtgcgcaacgcgctggcggcggctgccgtcgcgctggcgctggaggtgccgctggcggccatcgccgctggcctggcggccttcggcggcgccaagggccgcctgcagatcaagcaaggtccgcgcggcctgaccgtgatcgacgacagctacaacgccaacccggattcgatgaaggccgggctggacgtgctggccagccagccggggccgcgctgtttcgtgatgggcgacatcggcgagctgggcgaggccgcgccggccttgcatgccgaagtcggggaacatgcgcgcctgcgcggcatcgaacagctcttcgcgctgggcgagctgtcgcgcggagccgtcgccgctttcggcgccggcgcgcagcattttgattcgattgacgagttgttggagtgcctggatagccggctggcgtcgggtaccgccgttctggtcaaggggtcgcgcttcatgcgcatggaacgggtggtggaacacctgatgcacgcaaacacagagggagtataa

SEQ ID NO: 4375 - DNA, 1086 bp, Chromobacterium substugae
gtgctgctttggttggctgatctgttgggctcgcacatccgggccttcaatgttttcaattacatcacgctgcgcgcggtgatggcggccctgacttcgctggcgatttcgctgctgctggggccgtgggtgatccgcaagctgaccgaattgaaggtcggccaggcggtgcgcaacgatggtccgcaaacccacctggtcaaggccggcacgccgaccatgggcggctcgctgatcctgctggccatcaccatcaccacgctgctgtgggccgatctgtccaataaatacgtgtggctgctgctggcggtgatgctgggcaccggcgcgctgggcttttacgacgattggcgcaaggtggtgtacaaggacccgaaaggcgtgtccgccaagttcaagatggcgtggcaatcggccatcgccatcggcgccggcgtgttcctgatcgccaccgccaagctgccggcgtccaccgaattcatcgtgcccttcttcaagaccgtcgcctatccgctgggcgcggtgggcttctgcgtgctgacctacctggtgatcgtcggcacctccaattcggtcaacctgaccgacggcctggacggcctggccgcgctgcccaccgtgatggtgtcggccggcctgtcgatcttcgcctacgccgccggccacgcggtgttctccaagtatctgggcgtgcccttcattcccggcgcgcacgaggtggtggtgttctgcgcggcgatgtgcggcgcctgcctgggcttcctgtggttcaacgcctatccggcccaggtgttcatgggcgatgtcggcgcgctggcgctgggcgccgcgctgggcaccgtcgcggtgatcgtgcgccaggaagtggtgctgttcatcatgggcggcctgttcgtggtggaagcgctgtcggtgatgatacaggtcggctcgttcaagctcaccggcaagcgggtgttccgcatggcgccgctgcatcaccattttgaattgaaaggctggaaggagacgcaggtagtggtgcgtttctggattatcaccatgatgctggtgctggccggcctgtccacgctgaagctgcgctga

SEQ ID NO: 4376 - DNA, 1362 bp, Chromobacterium substugae
atggattacgccaatcgacaagtgatggtggtggggctgggaggctcggggctggcggccgcgcgctacctggccgcccacggcgcacgtgtcagcgcggtcgacgccaatccgtccgccgagcggctggccgagctggagcgctggctgccgggcacgccagtgtcgcgcggcgagttcaccgccgccaccttcgccggcatggagctgctggtggtcagccccggcgtgccgctggtcaacccggccatcgccgccttccgccgcgccggcggcgaggtggtgggcgacatcgaactgctggcgcgagcgatccagggcgacggcagcaaggtgatcgccatttccggctccaacggcaagagcaccgtcaccagcctggtcggccatttgtgcgaagccgccggcctcgataccgtggtcgccggcaatatcggcctggcggtgctggaggctcagctggcgcgcgagcaaagcggcaagcggcccgacgtctgggtgctggagctgtccagcttccagctggagtccaccttcagcctgcgcgccgacgccgccaccgtgctgaacatttccgaggaccacctcgaccgctacgccgacctgttggactacgcccacgccaagaccgcggtgttcaacggcgacggcctgcaggtgctgaaccgcgacgacccgctggtacgcgccatggtccgccccggccacgaggtgaagtggttctcgttgcagggcgaggccgactacgcgctctcgcgcggcgacggctaccggctgagcgtggccggcgaagcggtgttcgactgcgccgacatgcagctgcaaggcctgcacaacgccgccaacgcgctggccgcgctggcgctgtgccagggcataggcctgccgctgaacacgctgctggacgggctgaagactttccgcggcctcgcgcatcgcgtggagctggtagacgaattcgacggtgttgcgtttatcgatgattccaagggcaccaatgtcggcgccaccgaagcggcgctggacggcatgacccgtccggtggtgttgatcgccggcggcgacggcaaggggcaggatttcgcgccgctgcaggcggcttgccggcgcgcggcgcgcgcggcgttgctgatcggccgcgacgccggccgcatcgaggccgcgctggaaggcagcggcgtcgcggtggaacgcttcgacacgctggaggcggccacgcgccgcgcggcggctttggcccggccgggcgacgtggtgctgctgtcgccggcctgcgccagcctggacatgttccgcaactacgcgcaccgcgcccaggtgttcatcgacaccgtcgcggcgctgaaggcggagcggcgatga

SEQ ID NO: 4377 - DNA, 1158 bp, Chromobacterium substugae
atgaaccgcaacccggcgcgccattacgtggcgatcaccccgttggacgaagcgctggcctgggcgctggcgctgttgctgtcgatcagcctggtgatggtgtattcggcgtctatcgcctacgcggaagccgacgcggcgacgcagaaccgctacttctacctgatccgccacgtggtattcatggtgatcggcctggcggcggcgtacatggcgttccagattcccaccggcttctggcagaagtattcggggaagatcttcctgatcggcttggtgatgctggtgctggtgctgattcccggcatcggcaaggtggtgaacggttcgcggcgctggatcaacctgctggtgctgaatctgcagccgtcggaggtgatgaagttcgcggtggtgctgtacgcggctgactacacggtgcgcaagagccacctgttgcacagcatcaaggaaggttttctgccgatgttcatggcgatggtggtggtggctttcctgctgctgcgcgagccggacttcggcgcgctgatggtggtgatgagcatcgcgatgggcctgctgtttctcggcggcatcaatatgcgcatcttctccgggctggcggtgatggcggtgggcgcgatcgtggtgttgatcatttcctcgccgtaccggctgaagcgggtgctgggcttcatggacccgtgggacgatccctacggcaagggttatcagctgagtcactcgctgatcgcgatcggacgtggagaatggtttggcgtgggcttgggcggcagcatcgaaaagctgttctacctgccggaggcgcacaccgacttcatcatggcggtgatcgccgaggagttcggtttcgccggcatctgcgttgtggttggcctgtacgcctggatcgtgcgccgcgccttccatatcggcgtggagtcgaaaaagctggagcgctactaccaggcgctggtggcgcagggcataggcatttggctgggcatccaggtgttcttcaacatcggggtgaacatgggcctgttgccgaccaagggtttgacgctgccgctgatgtcgttcggcggttcggcgatgttgatgaatttgatcgcggtggcggtgctgctgcgggtggactacgaaaaccgaaggattatgcggggctataaggtttag

SEQ ID NO: 4378 - DNA, 1092 bp, Chromobacterium substugae
atggtgatggcggcaggcacgggcggacacatcgtccccggcctcgccgtggccaaagagctgcaacagcgcggctggaaagtggtgtggctgggcaccagccgcggaatggagaacaagctggtgccgccgtccggtatcccgttggaaaagctgaatttccatggcgtgcgcggcaagggcctgctgggctcgcttacgggcgcggcgcaactggcggccgcgtttgtccgcagcctggcgctgatgctgcgccatcggccggacgcggtgctggggatgggcggctatgtctgcctgcccggcggcgcggcggcggctctgctgtggaagccgctggtgctggtcaacgccgatgccggtctgctgctcagcaacaaggcgctgctgccgttcgccagcaagctggcctgcggtttcgacggcagcgccgcgcggcaggccaaggcgctggtcaccggcaatccggtgcgcggcgagatcgagaacatcgcgccgccggccgagcgcttcgccggccgcagcggtccgctgaaagtgctggtggtgggcgggagcctgggcgcgaaaatattgaacgaaacgctgccgcaggcgatggccaagttgccggccgacaagcggccgcaactgacgcaccagaccggcgaggccaatttcgccgcggtcgaggcggcttatcaagcagcgggcctgcgcgagcaagtggagctgctgcccttcgtcgacgacatgccgaagcgcctggccgagtgcgatctggtgatttgccgcgccggtgcgatcacggtcagcgaattgtgcgcggccggcgtgcctagcgtgctggtgccgctggtggtgtccaccaccggccatcagcgcgacaacgccgagtggatggccgaggccggcgcggcctggcatctgccgcagaaggaattgaacgccgacgggctcgcgggcctgctggcgagtttggacagagaccagttgctggaaaaggccgggcgcgcgcgcgcgctggcccgctccggcgcggccggccgggtggccgacctgtgccagcagctggccggggatagaccggacgccgtagaagcgtcccagtag

SEQ ID NO: 4379 - DNA, 1392 bp, Chromobacterium substugae
atgaaacacagggtcaaacacatacatttcgtcggcataggcggcgtcggcatgtgcggcatcgccgaggtgctgcacggcctgggctataccgtgtccggctccgacatggccgacggcgccaccaccaagcggctggcggcggaaggcgtgcgcgtgttcttcggccacgacgccacttatatcgaaggcgccgacgtggtggtgacgtccaccgcggtgaaggccgacaacccggaagtgctggcggcgcgcgacaagcgcatcccggtgatcccgcgcgcgatgatgctggccgagctgatgcgcttcaagcagggcatcgccatcgccggcacccacggcaagaccaccaccaccagcctgaccgcgtcggtgctgggcgcggccggcctggacccgaccttcgtcatcggcggcaagctgaccgccgccggcaccaacgccaagctgggcttgggcgaattcctggtggccgaggccgacgagtcggacgcctccttcctgcacctgtccccggtgatggcggtggtgaccaatatcgacgccgaccacatggacacctacgaccacagcttcgacaagctgaagcaggctttcgtcgatttcctgcagcggatgccgttctacggccgcgcggtgctgtgcgtggacgacccgaacgtgcgcgagatcaaggagcgcatcaccaagccggtgaccacctacggcctcgacgattccgccgacatctacgccgaaaacgtgcgcgcggcggccggccagatgcatttcgacgtggtggtgaagaacggcaccatcacccgcttcccgctggtgctgaacctgccgggccgccacaacgtgctgaacgccttgtcggcgatcgccatcggcttggagtgcggcgccagcatcgaagccatccagcaaggcctggcggaattcgccggcgtcggccgccgcttccagcgctacggcgaggtgaaggccaaggacggcggcagcttcacgctggtggacgattacggccaccacccggtggaaatggcggccacgctggccgcggtgcgcggcgccttcccgggccgccgcctgttgttggctttccagccgcaccgctacacccgcacccgcgatctgttcgaagacttcgtcaaagtgctgtccggagtcgacgcgctgctgttgggtgaggtgtacgccgccggcgaagcgcccatcgtcgccgccgacggccgcgcgctggcgcgggcggtgcgggtgggcggcaaggtagagccgctgttcgtcgagagcatcgccgagctgccgcaggccatcgtcgatgccgcccgcgacggcgatgttgtggtgaccatgggcgcggggtcggtgggcgcggtgccgggcaaggtgctggcgctggtttga

SEQ ID NO: 4380 - DNA, 912 bp, Chromobacterium substugae
atgaagcagtacggcaaggtggcggtgttgatgggcggtcgctcgtccgagcgcgaagtgtcgctgatgagcggcgccggcgtgctctcggcattgctggccaagggcgtggacgcccacgggttcgatccggcggaaaagccgctggcggccttgaaggaagaaggtttcgcttgcgtgttcaacatcctgcacggcccgttcggcgaggatggcacgctgcagggcgcgctggaagcgctgggcatgccgtataccggctgcggcgtgatggcctcggccatcgccatggacaagtggcgcaccaagctgttgtggaagggcgccggcctgccgattccggctttcgagctgctggatgaagacagcgatttcgacgccatcgaaaagcggctgggcctgccgatcttcgtcaagccgtccagcgagggctcgagcataggcgtgaccaaggtcaagcagccgggcgagttgcgcgcggcgtttgcggaagcgcgcaagtacgacgcggtggtgatcgccgagcagtttatcggcggcggcgagtacacctgcgcggtaatcggcgacgtggcttacccgaccatcaagatcgaaccggccaccgagtactacgactaccaggccaagtacttccgcgacgacacggtctaccgctgcccgtccggcctcgcgccggaagtggaagcgaaggcgcgcgaattggcgctgaaggcgttcaaggtattgggttgccgcggctggagccgggtggacttcctgatggatgaagcgggcgagatctacctgctggaagcgaataccagcccgggcatgaccagccacagcctggtgccgatggcggcgcgggccgagggcatcgcttacgaagacttgtgcctgaaggtattggatacggtgcatgtgggataa

SEQ ID NO: 4381 - DNA, 726 bp, Chromobacterium substugae
atgtgggataaccatcggctgctccggagcctggccaatctgatgctgggcgctgcagcgctgatgttgctgtacgcggggggattctggctgacgcacgcgccggtattcccggtgaagaagatacgcatccagggggatatgaaccgggtgacggccgagcagctgaagttcatcgcggagcatgaactggccggtaccttcttcacgctggacatcgacaagacgcgcgcggctttcggcaaattgccgtgggtgcgcgacgcgcaggtgaggcggcgctggccggacgcgctggacatcaccgtggaggagcatgtggcgctggcgcgctggggagaaaacggcctggtcaacacccgcggcgagcgcttcgacgccgccagcgacgccaagctgccggtgttttacggtccggccggcgctgagaaggacatgacggcgatgctgacgcagatgcgtcagtccttgcagccgtcgggcctggcgccgcgcgagctgtggctgtcgtcgcggcgggcgtggaaggtggtgttggacaaccagctgcagctggagctgggcagaaatgacgtggtggcgagggcggaacgtttcgccacctactggaagagcgaattggcgcggttgccgtatcacatcgaatacgtcgatctgcgctatccaaacggattcgccgtgcggatgcccgattacaaggcgccgccggtaaagggaaacaagtga

SEQ ID NO: 4382 - DNA, 1245 bp, Chromobacterium substugae
gtgagcaaaccaaaggaaagcaagaacatgctggtcggcctggacatcggcacctctaagatcgtggcgatcgtcgccgaggtgctggaagacggccagcttaacatcgtcggcatgggacacacgccgtcgcgcggcttgaagcgcggcatggtggtgaacatcgagtccaccgtgcaggcgatccagcgcgcgctggaagaagccgagctgatggccgactgcaagattcacgaggtgttcgtcggcatcgccggcagccacatcaagagtgtgaactcgcacggcatggtggcgatcaaggatcgcgaagtcaccaagatggacatcgaccgcgtgatcgaaaccgcgcgcgcggtgaccattccgcccgaccaccaggtgctgcacatcctgacccaggaatacagcatcgacggccaggaaggcgtgcgcgagcccttgggcatgagcggcgtgcggctggaagccaaggtgcacatcgtcaccggcgcggtgtcggccgcgcagaacgtgaccaagtgcgtgcgccgctgcggcctggaagtgtccgacctggtgctgcagccgatggcctcggccatcgccgtgctgtccgaggacgagaaagacttgggcgtgtgcctgatcgacatcggcggcggcaccaccgacatcgccgtgtacgtgggcggcgcgatccgccacaccgcggtgattccgatcgccggcgaccagatcaccaacgacatcgcgatggccttgcgcaccccgaccaaggaagccgaggacatcaagatccagcacggcgtgtcgctggtcgcgatggccgatccggcgcagatgatagaagtgcccggcgtcggcgagcgcggtccgcgccagatgtcgcgcgcgacgctggccgaagtgatcgagccgcgggtggaagagctgttccaactggtgcagcaggagctgcgccgcagcggcttcgaggagctgctgtcgtccggcatggtgttgaccggcggcgccagcctgatgccgggcatggtggagctggccgaagaggtgttccacctgccggtgcgcgtcggcgtgcccaagtatgtaggcggcctggcggaagtggtgaagacgccgcgcttctccaccggcgtcggcctgctgttgtacggcaaggaccagatccagggttatgccggcccgcacagcaaggccgagtcggccggcgtggggcaattgttcggcaagatgaaggcctggttcgccgggaacttctaa

SEQ ID NO: 4383 - DNA, 1179 bp, Chromobacterium substugae
atggtattcgaagtgatgcaggaaacggccaccacggccgtgatcaaggtgatcggcgtcggcggcggcggttgcaacgccatcgacaacatgatcaccggcaatgtgcacggcgtggagttcatctgcgccaacaccgacgcgcagtcgctgcagcgcaaccgcgcgccgcagaagctgcagctgggcaccaacctgacgcgcggcctgggcgccggcgccaatccggaagtgggccgcagcgcggcgctggaagaccgcgaacgcatcgccgagatgctgcgcggctccaatatggtgttcgtcaccgccggcatgggcggcggcaccggcaccggcgcggcgcctgttgtcgccgaagtggccaaggaaatgggcatcctgaccgtaggcgtggtcacccgtccgttcgagcacgaaggcaagcgcatgaaagtggcgcagaacggcatcgaagacctgaagaaacacgtcgattcgctgatcgtgatccccaacgagaagctgatggaagtcctgggcgaggacgtcaccatgcgcgaggcgttccgcgccgccgatgacgtgctcaagggcgcggtggccggcatcgccgaagtcatcacttgcccgggcctgatcaacgtcgacttcgccgacgtgcgcaccgtgatgtgcgaaatgggcctggcgatgatgggctccgcctacgcctccggcatcgaccgcgcccgcgtggcggccgaacaggcggtggccagcccgctgctcgacaacatcacgctggaaggcgcgcgcggcgtgctggtgaacatttccaccgcgccgggctgcctgaagatgagcgagtaccgcgagatcatgggcatcgtccgccagtacgccgacgaagaggcgcagatcaagttcggcaccgccgaagtggaggacatgccggaagacaccatccgcgtgacgctgatcgccaccggcctcggccagaagaagtccgcccgcaacgaagagcgtccggagtacatcaagatcgtcaagaccggcaccgacgaccgcgcggtggaaatggtcaactacgaagacctggacgcgccggccatcatgcgcaccggccgccgccgctcgtcgccgtcgctggacttctccaatccggaagtgagcgagagctacgacatcccggccttcctgcgcaagcaggccgactaa

SEQ ID NO: 4384 - DNA, 915 bp, Chromobacterium substugae
atgatactgcagcgcacgctgaagcaagcgatcagcgccacgggcgtcggtctgcattccggcgagcgggtgaagctcaccctgctgccggcgccgcccgataccggcatcgtcttccgccgcaccgacttgcccgagccggtcgacgtgaaggtggatccctcgctcgtcaacgacacgcgcctctcctccacgctggtgacggacaccggcgtgcgtgtcggcacgatcgagcatctgatgtcggcgtttgccggcttcggcatcgacaacctggtcgtcgaggtgacggcggcggaaatgcccatcatggatggttccgccgcgcctttcctctatctgctgcagacggccggggtggtggatcagcccaagaaaaagcgtttcatccgcgtcaaacagagcgtgatggtggaagaaggcgacgtgtgggtccggctggacccgcacgaaggcttcaaggccaagctcgccatcgtgttcaaccacccggcgttcaatcgcgcgccgcagacggtggaggtggatttcgcccgccattcctacctagacgaaatcagccgcgcccgcaccttcggcttcatgcacgagctggaatacatgcgcaaccacggcctgggccgcggcggcagcctggacaacgccatcgtgatcgatgacgagtacgtgctcaatccagagggcctgcgcttcccggacgagttcgtccgccacaagctgctggacgccatcggcgacctgtacatcgtcggccatccgctgatcgccgccttctccggccacaagtccggccacgcgatgaacaacaagctgctgcgcaagctgctggcgacgccggaggcctgggagtacgtcagcttcgacgacccgctggacgcgccgtccagcttccacttgctgccgccgcaggaataa

SEQ ID NO: 4385 - DNA, 183 bp, Chromobacterium substugae
atgttcggcttctggcggctgtggctgctggcgaccatcctggccataggctgggcgctgttgtgcttcgccctcacccacgacagacgccatctgcgccgggtgctggccatcgtccgctggagcgccggcctgttgatcattgtgtcctgtttctggctgattttctgcctgctgcgttga

SEQ ID NO: 4386 - DNA, 480 bp, Chromobacterium substugae
atgacccgactcacgcatttcgatgacggcggccaggcccacatggtggatgtcggcgccaaggcggccaccgcccgccgcgcggtggcagagggcgtcatccgcatgctgccggccacctttgcgctggtgaagggcggcggccacaagaagggcgacgtgctgggcatcgcccgcgtcgccgccatcatggcggccaagaaaacctgggacctgatcccgctgtgccatccgatcgcgctgacgcggctggcggtggatttcgcgctgctggatgccgagtccgcggtgcggatcgaggtgaccgccgaatgcaacggccagaccggggtggagatggaggcgctgacagcggtcaatgtcggcctgttgaccatctacgacatgtgcaaggcggtggaccgcggcatggagatcggcggcgtgcggctgctggagaaagacggcggcaagagcggcagctggcgggcgccggactga

SEQ ID NO: 4387 - DNA, 537 bp, Chromobacterium substugae
atgcatccgctcgaactgaagtcgctgaaaacccccgctcccgatgtcggcgtgcggttgccagacggccgcctgctggcgatagaagtcaccgaggtgctggccggcgagcatgtccggcgcaccgccaaaaagaaggaagcccatctcgcccgccaggcggcggtgggcatttattcgatgttcgcgctgccggcaaacgccagcgacgtcgcctgccgcatcgaggccaaggtgggcaaggactaccatgtgccgcccgggcaccagctgcaattgctgctggccgccagcaccttcgaacacggcgccgtggcggccaccctgctgctgtatgtgtcggtgcaggagctgaaccagctcacccacgacatgctggcgcgctcgcgctaccagcacgtctatttgcatctgcagtccggccgcggcctctacgagtggaaccgccgccagcgctggcatgaaatccatccgccggtgttcgatgccggcggcgcgcccggcccgcaggagctggatccgcagaccggcaagtaa

SEQ ID NO: 4388 - DNA, 507 bp, Chromobacterium substugae
ttgaaagcattcctcaccctgccggccgcgctggccttgtgcctgagcctgccggcgctggccgacaacgacaggatcaagaaaaacatcaccttcgaggacgaaaaagcctgggaggagcaagcctacgcgctgcccgactacccgcaagccgccgactgggtggaagtgaagcctgactggctgcagagcaaccgtttcttcgtcgatggcaaaacgctgagcgtgggccaggacggcgtggtgcgctacatcagcaaggtgctcagccccaacggcgtggaaaacctcagcgtggaaggcattctgtgcaaggacgcccgctaccgcgcctacggcttcggcgacagcgtcaaccaccgctggatcgagccgatgcggcccatatggcaggacatcgtctatggcgacaagctcaggcgcgaactgcgcgaactgctgtgcccgtcgcacagcgcgccgcgcgacgccgccgaagcgctgaagtcgctgcgcaagggttcctga

SEQ ID NO: 4389 - DNA, 765 bp, Chromobacterium substugae
atgtgcatcatcgcttttgcctacaagacgccgggcatgggccagctggccctcttggccaaccgcgacgaatactacgcccgcccgtcggcgccgctggactggtggccggagtacccgcatacgctgggcggccgcgacctgcaatccggcggcagctggatgatggtcgacggacgcaaccgcttcgccgccatcaccaacttccgcgacggttttccggccaaggccgagcgctcgcgcggcgaactggtggagcgcttcgtcagcggcgacgacgacgccttcgcttttgccgactggctgcgcgccgagcatcaccgctacgcgccgttcaatctgctgttcggccatacctccgacctgttcttcttccacagccgcaccgcgcagatcgcccgcgtcacgcccggcatccacacgctgtccaacgccacgctggatacgccgtggttcaagagccagcggctggccgaatacctgcgcgaattccagcgggtgcccaacgaagaccaggcctacgcggcgctgtccgaccccaccccggccggccccggccagctgcccaacacccgtatcggcctggcgctggaaaaaaccttgtcgccgatcttcatccagggccgcgattacggcacccgcgcctcgatgttgctgacggtgtccagccgcggcgacatcgccttttccgaattgagctggggcctggccggccgcgaaaccggccgccgccattacaacctgcgcgccggcacggcgcgctga

SEQ ID NO: 4390 - DNA, 231 bp, Chromobacterium substugae
atgactcccgacaagcagattgatctttccggcctcaattgcccgctgcccatcctgcgcgcgaagaaggcgctggccgatatggcgagcggcgccgtgctggaggtgatcgccaccgatcccggcgcgcccaaggacttcgaggcgttttgccgccagaccggcaacggcctgctcgaatcgaccaccaccggcgagggcaagttccggatggtgctcaaacgcaaataa

SEQ ID NO: 4391 - DNA, 1035 bp, Chromobacterium substugae
atgcagacactcaccctgatccgccccgatgattggcacctgcacctgcgcgacgacgccgcgctggccgcggtgctgcccgacacctgtcgccagatgggccgcgccatcgtgatgcccaacctgaagccgccggtcaccacggtggccgccgccgccgcctaccgcgagcgcatcctggccgcgcgcccggccggcagcgccttcgaaccgctgatgacgctgtatctgaccgacaagaccagcgccgatgaaatccgcaaggccaaggcctgcggcttcgtccatggcgtcaagctgtatcctgccggcgccaccaccaattccgaccacggcgtcaccgacatcgcccaggcgatgccggcgctgcaggcgatggccgaagtcggcatgccgctgttggtgcacggcgaggtgaccgacgccgacatcgacgtgttcgaccgcgaggcggtgttcatcgaacgggtgatgaagccgctgctggccaaactgccgaatttgaaggtggtgttcgagcacatcaccacccgcgaggcggccgaattcgtcgccgccgcgccggccaatgtggccgccaccattaccgcccatcacctgctgatgaaccgcaacgcgctgttcgtcggcggcatccggccgcaccattattgcctgccggtgctcaagcgcgagcaacaccgccaggcgctggtgaaagcggccacttccggctcggccaagttcttcctcggcaccgacagcgcgccgcacgccaagggcgccaaggaggcggcctgcggctgcgccggcatgtacaccgccaacgcggcgatcgaactttacgccgaagccttcgaagccgccggcgcgctggacaagctggaggctttcgccagcctgaacggcccggccttctacggcttgccggccaacggcgggcgcatcaccctggccagggaaagctggaccgtgccggccgagctgccgtatccgggcgacgcgctggtgccgctgcgcgccggggaacagataggctggcgtttgctggactga

SEQ ID NO: 4392 - DNA, 123 bp, Chromobacterium substugae
ttgcttgtcagtcatcttctactctccttgttctgtctccgtcctgtctatcgcaagacggcggatttttttcactcgattgtatccagagtgggtccgcagattatgcgcagaggtttttga

SEQ ID NO: 4393 - DNA, 1614 bp, Chromobacterium substugae
atgactgacaagcaatcgctgaaggcgatcgccgccgccgtcgcgctggccatggcttccggttccgtgctggccgccaaggtgcccgccggcgtcaagctggctgccaagcaggagttcacccgcaataccggcgccgagccggaaacgctggatccggtagtggcggaatccgtgccggccaacaccatcaccgccgacctgttcgagggtctgaccacgctggatgtctacggcaaggttctcccgggtgtcgccgaaagctggaaggaagtcgaagccaatacttgggtgttccacctgcgcaagaacgccaagtggtctgatggcactccggtgaccgccggcgacttcgtctacggctggcagcgtttcgtcgatccgaagaccgcctccccgtacgcgtcgacctacggcatgttcatcgtcaacggcaaggaaatcgccgagggcaagaagccggcctccacgctgggcgtcaaggccgtcgacaagtacacgctggaagtgaagacgccttatccggtgctgttcctgccgtcgctggtggccaacacccagctggcgccgctgccgaaggccaccatcgacaagtacggcaaggactggaccaagccgggcaagatggtcagcaatggtccgttcctgctgaaggactggcaagtcaacagcaagatcgtcaccgccaagaaccccaactactgggacgccaagaacgtccagctgaccaagatcacctatctgccgatcgaagacagcaacgccgacgtcaaactgtttgaatccggccagaacgatttcgtctaccagttgccgccgggcaccttcgacaagtacaaggcgcagtacccgaaggaaatccgcaacaccgaattcctggccctgcgctactactcgttcaacaacaaggatccgctgctgaaggatgtgcgcgtgcgcaaggcgctgtcgatggtgatcgaccgcgacattctggccaagaaaatcaccgccgacggccagacgcctgcttatagcgtgatggtgcgcggcatttccggcgccgacgcctccacctacgactgggtgaaatggccgatggccaagcgcgtcgacgaggccaagaagctgctggccgaagcgggcgtcaagccgggcaccaaggtgaccttcacctacaacaccaacgactatcacaagaagatggcgatcttcgccgcttcggagtggaagtcgaagctgggcctgaacaccgagttggaaagcctggagttcaaggtgctgctgaagaagcgccatgacggcgactaccagatcgcccgcaacggctggaacgccgactacaacgacgccaccaccttcttggcattggtgcagtgcaataacgatcagaacgaaaacaagaactgcaatcccaaggcggaagagctgatcaagcagggcagccagtcgctggacccggccaagcgcaagcagttgttcacccaggccaccaagatgatcatggacgactacccgatgctgccgctgctgcaatacaccgcgccgcgtctggtgaagtcctatgtgggcggctacggcaagagcccgctggatcgttaccagggcaaggacctctacatcatcgcccactga

SEQ ID NO: 4394 - DNA, 921 bp, Chromobacterium substugae
atgtggtcttatactttccgacgcattctggcgacgatccccaccttgctggcggtcatcacggtctgctatctgttgctgcacttgacgccgggcggcccgttcgacggcgaacgcaaggtctccgccgcggtgctggccaatctgcaggccaagtaccatcttgacctgcctccgtggcaacaatacctgtattacctcaacagcctgctgcacggcgatctgggggcctccttccgctatgccgactggagcgtcaacgatctggtgagcaaggccttgccggtgtccgccaccataggcggcggagccatcctgatctcgctggtgctgggcgtgctgctgggcaccatcgccgcgctgcgccagaacagcgtcgtcgattatctggttatgttgttcggcaatatcggcggcgccttcccgtccttcgtgctggggccggtgctggtgatgatcttcgccatctggctgccgctgctgccggccggtggctgggacaacttcaagctgaagttcatgatcctgccgatttcgctgttggtgttcatcaacgtctccactatcggccgcgtgatgcgcggcagcctgatcgaagtgctgaacagcaacttcatccgcaccgcgcgcgccaagggcctgccgctgcgcgccatcgtgctgcgccacgcgctgaagccggcgctgatgccggtggtgtcggtgatcggcccgctggccatctcgtccatcacctcggcggtggtgaccgagacggtgttcggcctgccggggctcggcaaactgatcgtcaacggcgcctccaaccgcgactacacgctggtgctgggcctggtggtgctggtgacggtgatcacggtggtgttcaacctcctcgtcgacctggcttatgccttgctcgaccccaagatccgctactga

SEQ ID NO: 4395 - DNA, 915 bp, Chromobacterium substugae
atgatgaagagcaaacaagcggctgcggccgtagcgctggaaaacggcctgagcgaggcggcggtcgaaggccgcagcctgtggcgcgacgcccgcatccggtttctccgcaacaaggcggcggtggtcagcctggtggtgctcagcctgatcacgctggcctgtatcttcggccccatgctgctggccaacggctatgccgataccgactgggacgcgatgagcgaggcgcccacgctgcataatatgcactggttcggcaccgacgcgctggggcgcgacctgctggtgcgctgcctggtcggcggccgcatctcgctgatggtgggcctgctggccaccatcgcctcggtgatcctgggcatagtctggggcgccaccgccggcttcctcggcggcaagatcgactcgctgatgatgcgcatcgtcgacatgatgtacgcggtgccctacctgctgatcgccattctgatggtgacgctcttgggccgcgagttctacctggtggtgctgaccatcaccgtgttctcgtggatggacatggcgcgggtggtgcgcggccaggcgctggcgatcaagtccaaggaatacgtcgaggcggcgcacgcgatcggcgtgtcgacgcctgtgatcattttccgccacatcgtgcccaacctgctgggcatcgtggtgatctacaccacggtgacggtgccgggcgtgatcctgaccgagtcggtgctgtccttcctcggcctgggggtgcaggagccgatgaccagctggggcgtgctgatccaggacggtgccggggtgatggattccacgccgtggatcctgctgttcccggccgggatgttgtcgctgacgctgtattgcgccaactatatcggcgacggcctgcgcgacgcgctggacccgaaagaccgctga

SEQ ID NO: 4396 - DNA, 1002 bp, Chromobacterium substugae
atgagcattctgaaagtaactaacctcggggttcagttccagaccaacgacggcgtggtcaacgccgtcaacggcgtgaatttcgagttgaaaaagggccagaccctgggcatcgtcggcgaatccggctccggcaagagccagaccgtgctggcgatgatggggctgctggccaagaacggcaaaaccagcggcgaagcgctgtaccacggccaaaacctgctggcgatgggcgcgaaggatctgaacaagatccgcggcgaccgcatctcgatgatcttccaggacccgatgacctcgctgaacccctacctgacggtggagcggcagatgagcgaggtgctggagctgcacaagggcctgagccggcgcgacgccaaaaagcgcgcgatcgagcttttggacgcggtgcgcatcccggaagcggcgcggcgcatcaatatgtacccgcacgaattctccggcggcatgcgccagcgggtgatgatcgcgatggcgctgctgtgcgagccggaagtgctgatcgccgacgagccgaccaccgcgctggacgtgacggtgcaggcgcagatcctgacgctgctgaaggacctgcagcgcgatttcggcacctcgatcatcatgatcacccacgacctgggcgtggtggcgggcctgtgcgagaacgtgctggtgatgtacggcggccgggcgatggagtacggccgcgccgacgacatcttctaccacccgagccatccctacaccatcggcctgctgggcgcgctgccgcggctggaccacgacggctccgagctggtcagcatccccggcaatccgcctaatatggccaatatgcccaagggctgtccgttcagcgagcgctgcgtgcacagcagcgagcgctgcgtcggcgagctgccgccgctggccgccagcagcctgaatccgcagattctgcgcgcctgtcacaagccggcggaagaactggtcaaagccgccgaggaggtgacgcatgtctga

SEQ ID NO: 4397 - DNA, 993 bp, Chromobacterium substugae
atgtctgaaaccgccaagcagccgatcctgtcggtacgcaacgtcaaggttcatttccaggtcaagggcggcgacgcctggccgtggagccccaagaaaacgctgaaggcggtggacggggtcagcttcgacctcttcgccggcgaaactttgggcgtggtcggcgagtccggctgcggcaagtccaccctcagccgcgccatcctcaacctgatcccggcgacggaaggcgaaatcgtctggatgggcaaggacctgcgccaaggcagcgccaaagactggctcagcgtccgcaaggacatccagatgatcttccaggatccgctggcgtcgctgaatccgcgcatgaccatcgcccagatcatcggcgagccgctgcgcgtgcacaagcccgagctgtcggccgacgaggtgatgaagcgcgtcaaggccatcatgaagcgggtgggcctgcgcgagcagatgatcaaccgctacccgcacgagttctccggcggccagtgccagcgtatcggcatcgcccgcgcgctgatcctggagcccaagctgatcatctgcgacgagccggtgtcggcgctggacgtgtcgatccaggcgcagatcatcaacctgctgaaggaactgcagcgcgagatgggcctggcgctgatcttcatcgcccacgatctggcggtggtcaagcacatctccgaccgcatcctggtgatgtacctggggcgcgaaatggagctggcgcaaaagcacgcgctgtacgacgtgccctcgcacccgtacacccgcgcgctgctgtccgccattccgattccggacccgcggcaggaaaagaacaaggtgatccagatcctgcagggcgatctgcccagcccgatcaacccgccgtccggctgcgtgttccgcacccgctgcccgcaggcggtggagcgttgcgcgcaggaggtgccgaagctgcgcaagctgtcgagcgaaacgcaatcgtcctgcctgctggcctga

SEQ ID NO: 4398 - DNA, 363 bp, Chromobacterium substugae
ttgctgcagcagaccgaaggcgccggcgagctcaagcgcgccagcatcgtcaacgcgctgagcggcagcctggagggacaaggctggctggagtaccagctgctgtatccggcggacgagggcggcgaggtgagcttcatcggctacgagcgcgtggtcgcgcgctggggcgagcggcagggcagcctggtgctgcggcatgacggcgtgtattccgccgcggccggcgtcagcggttcgctgcgggtgatgccgggcagcggcagcggcgatttcgccggcttgagcggcgacgggcgcatcgtggcccgggcgggggagcatggcggagagtatctgctgacgctgcaataccgcgactga

SEQ ID NO: 4399 - DNA, 711 bp, Chromobacterium substugae
atgtatcaagggcagcaggaatacgatattgggctggaatggggcctgccgggcgtgcgtcggctggatgggcaggcggcgctgtgcgtgattgtcgacgtgctgtcgttcagcacctgcgtcgacatcggctgcggctgcggcgcggcgctgctgccttttcgtcccgacgacgagggcgccgcagccttcgccgccgagcgcaaggcccagctggccggcaagcgcagccgcaacaagctgtcgttgtcgccggtctcgatgcgggcgctgagcgccggcagccggctggtgctgccctcgccgaacggcgccgccttgagcctggagtgcgcggcgggcgaggtggtggcgggctgtctgcgcaatgccgccgcggtggcggcatacgccggcagccagggcgcgccggtgcggctgatcgccgcgggcgaacgcgcaccggacggcgagctgcgtttcgccttcgaagacttcatcggcgccggcgccatcattcaccggctgactggcagcaagtcgccggaggcgcaggcggccgaagcggcgttcttgctggccaggcatgatttgctcagccatctgcgccagtgcacgtccagcctggaactgatcgagcgcggcttcgccgacgatatcgaactggcggcgcagctggatgtcagcacctgcgtgccgcgtctgcaggcaggcgagtatcgcgcgctgtga

SEQ ID NO: 4400 - DNA, 351 bp, Chromobacterium substugae
atgttgccggcaaaaatggtcagcacgactttcgatctgcccggctaccgggtggtggccaatctgggcgtggtgcgcggaattacggtgcgctcgcgctcggtggtgggtaattttctcggcggcttgcagtcgctgttcggcggcaacatcaccatctataccagcttgtgcgagcaggcgcgctccgaaacctacgcgctgatgtgcgagcacgcggcggcgctgggcgccaacgcggtgatcggcatgcgctacgacgccaccgacgtgatggccggcctgaccgaggtgctgtgctacggcaccgcggtgcgggtggagccgctggacgcggcccgtccgtcttaa

SEQ ID NO: 4401 - DNA, 921 bp, Chromobacterium substugae
atgagcgcccgccatcccgccgccgcctgggcgcgcgactaccaggccggcgacgccgccgcggtcagcgcgctgttccgcgcggtctacggcgaccactacgtgtatccggacgtctacctgcccagccagatcgagcaacgcaacgccagcgggcaatggcattcggcggtggcgctgctggacggccgtctggccggccatgccacgctgtggctggacccggcgcggcccggccaggccgagctggccttgaacgtggtgcatccggacgcgcgcggacgcggcgtggccagcctgctgggacgccatctgcgcgccgcggccggcagcctgggctgcggcctgctcaccatcaagcaagtctgctcgcacccgcaaagccaatacctggcgcaaacgctgggcttccacaccagcgcgctgatgctggactacgtggattcgccgttcggcaagcccgagccggaaagcatcgtgctgggttgcctgccgctgcggccgcggccgttgcccgaactggcctggccggcggaatgggaggaatggctgcggccgctgcgccaggccttcggtcccggcgcgccggcggcggcgccgacgcgcttgcccggcctcagcctggcgcgccacggccagcggctggaagtcgtcgttccgcagcccagcgcggcgcggctggcggaaatcgccgccctgccggccggccagctgatctacctgaagctggcgccaagcgccgacgcgctggcgctgcgtccgcggctggcagaggcgggcttccgcttcggcggcctgctgcccgatgccggcggcggctggctgctgttgtttctgcgcggccagcgcggcgacgccatccgcttctgcgacgccggcgccgaacagctataccggctggatttgcagccggcggcttaa

SEQ ID NO: 4402 - DNA, 1305 bp, Chromobacterium substugae
ttgcgccggccgtccgcggacgccggcgccgaagccgcaatcatgaatccaaagctgaaatcactcgtcgaccacgcccggcgccattcgccgttctatcgccagctgtaccgcgcgctgcccgccgagggctggcggctgtccgacctgccgccggccgatcccgaccactactggcgcggctcgcaaacgctgcgcgactggccggtgctgaccgcgccgctggacgacggccatgtcttcaagaccggcggctccaccagcgagggcaagctgtcggtcttcagccgcgccgagtggcaagccttcgtccaggccttcggcggcggcgtcgcccgccagctgcgggccggcgaccgcgtcgccaacctgtttttcgccggcgacctctacaccagcctgctgttcatccacggcgcgctgtcgcgcgcgccgctgccgctggtggaattcccgttcacctgccatgtcgacgacgccgtgctggccgacgccatccgccgatatgagatcaacgcgctgaccggagtgccggcgcagctgctgcgcttcgcccaccacctggcgcatgccggccagacgctggccggcgtcgataccgtgctgtatggcggcgaaagcctgttcggcgagcaactggcgctgctgaaacaggcttttccccaggcccgcatcgcctcggtgggctgcgccagcgtcgacgccggcctgataggctatgccgagcccggctgccgccacggcgagcaccgggtgttcgacgacgacagcctggtggagatactggacgaggccagcggcgagccgatcagcgaaaccggccgctgcggcgtgctgacgctgaccaatctgcagcgccgactgatgccggtgatccgctatcccaccggcgacctggcctgctggcgcgagccgccggggccggcgcgcaagttcgcgctgcagggccgctccggccagggccaccgcgtccgcgtcggcacgctgtcgctgtttccggcgcaactggcgccgctgctggaaaggcatgccgagctgttggcctggcagctggcgatagaacgccgggacggccgggacgcgctcagcctgctgctggccagccgccgccagctggattgcgcggcgctgcgccaggacttgctggccgcccaaccggccatcgccgcgctgtgcgcggccggccagctgcgcctggacatcgtccagaccagcccggagcggatgcgcacccatccgcgctccggcaagctgatgcgggtggtggatctgcgcgactaccaagccgaggaggcgcagccatga

SEQ ID NO: 4403 - DNA, 2403 bp, Chromobacterium substugae
atgtatctgattgatggagaattgcgcgcccagctcacggcggacgacgcgctggccgcgctgcgcgcccgactggccgacaccctggccgcggagccggatgtcgaggccgtactgtcctgcgccgagcgtttcgccgacgcgctggcgcgcgccggcggccacccgctgctggacgaggccggccgcctcgccctggcgcgcttctgccgccgcgaagcgctgcaagccaagctggagcgcgaactggacgagcggccgttctcgctgcgccgtcacgactaccgcgaagcgcgcttcgaagcctggcgcccgctgggcctggtgctgcacatcaccccgtccaacgcggcgctgctgcccttcatggcggcgctggaaggcctcttggccggcaacgtcaactggctgcgccccagcgccagcgaccagggcctgagcgcgcggctgctggccgaattcctgcgccacgaccacagcggccggctggcccggcgcgtcgccgtgctgcccatcgccagcgaccggctcgccccgctgctggccgaggccgacgcggtgtccgcctggggcggcgacgccgcgctggccgccatccgcgcgcaattgccgcccggctgccgctggatagactggggccaccgcgtcagcttcgcctatctcgacccggccgccggcgacgcacaactggacgcgctggccgacgatgtctgccgccacgaccagcaggcctgctccagcccgcaatgcctgctggtggactgcgacgacgcggaaacgctgcgcggcgtcgccgcgcggatggccgccgcgctggcgcgccgcgcgcctcagtggccggcgctgcggcccgacctgcaggaagccgccgagatcagcagccagatggcctttctacggctggaccaggccttcgccggcctggacggcgaagtgctggacggcgaaggctggcggctggcctggaacgcccgccatgaactggcgccgtcgccgctgttccgcaccctgcagttgcggccggcgccgcgcgccgaactctccgccatcctgcgcccctggcgcacccgcctgcaaagctgcggcctgatcgccccggcggcgcgcctaccggaactgagccgcgcgctgctggcggccggggtcagccgcgtcgcgccggccggccgcatgcacgacggctacgacggcgagccacacgacggcgtctacgcgctgcaacggctgtcgcgccgggtgtcggccacgctggacgccgccgcgctgcccggccacgcccacctggacgcgccgccggccgagcccgagggcctggccgcgctgccggtgatggacaaggccgacttccagcgccagggcgccaacgccaaggcccagctgttcttccgcagcggcggcagcagcggcgcgcccaagctggccggcttcagctatcgcgactaccaccgccagatgcgcgccgccgccgacgggctgttcgccgccgggctcgacccagccgccgaccgggtgatgaacctgctgtacggcggcaaactgtacggcggcatgctcagcttcttcactatcctcgaccacatgggcgtcgcccaatacccgatgggcggcccgtccgacgacgatttcagcgagatcgcgcgcttcatcgtcgagcagaacatcaacaccttggtcggcatgcccggcaccttgcaccggctgttcgaatgcgagaacaagctgctgcgcggctacggcggcgtgcgcaaggtgttcttcggcggcgagcacatcagcgacggccagcgcgcctacatcggcagcttcggggtggagctgatccgctccgccctgtatggatcggtggatgccggcccgctcggccacggctgccccggcagcgccgacggcgaattccacctgctggccgaaacccaatggctggaagtgttggagcaggacagcgaccgccccgccgccgccggcgaaatcggccgcctggtgttcacctcgcgcgagcgcgaagcgcagcgggtgcggcgctacgacctgggcgacctgggccgctggctgcccggccgctgcgcctgcggcctggcaacgccccgcttccagctcaccggccgccacggcgcgctgctgcgggtcggcaccatcttcgtcaatccggccgagctgagccggcaaataggcctgccgctgcaatggcttgtggaccaggcggacagcggctgcgaccgcatccgcctgctggccgacggcgagcccaaccgcatccgcgcccaattgctgcaggacccgatgctgagcgaagtcgtcggcggcggcctgctgaaactggaaatctccccgacgccggcggccgaattccgccgccatccgcacagcggcaagacgccgctggtgctggacctgcgccgttaa

SEQ ID NO: 4404 - DNA, 1131 bp, Chromobacterium substugae
atgacctcactcaagcatgtcgaagcgctgtgccatctggacgatccctaccgcgccgacgccgaatgcgactgcctgttcgacgccgcgatgcgcgagctggtggactaccactgcgagcgcagccccggctaccgccaatggctggagcagaacggcttcacgccggcgcgcctggccggcctggccgactggtcgcagctgccgcccatcttcgccaactatttcaagcgccggctgctgctgagcgcaagcggcgaagacgcgctggagctgacttcgtccggcaccaccggccagaaaagccggatgcgctacgacgaacgcagcatcggcgccgcccagcgcatggtggaccgcatcttcgaccactacggctggcataccccggaccaaccggccaactacctgctgctcagctacgagccggcgggcgccatcacgctgggcaccgcctacaccgaccagttcctgtgcaagtacgcgccggtcaaccgcgccgtctacgcgctgcgccacaccggcaagggcaacgagttcgatcccttcggcgcgatgcgcgcgctgcaggaattcgccgcggaaggcctgccggtgcgcattttaggcttcccggcctttctgtggttcacgctggagcggatgcgcgacatgggcctgccgccgctcgccctgcatccgcaatcgctggtcttcctcggcggcggctggaaaacccatgccgaccaggcgattcccaaactggagctgtaccgccggctgggcgaacagctgggtctgccggacgaacgttgccgcgacggctacggctcggtcgagcatccagtgccctacgtcgaatgcccgaaccaccgtttccacgtgcccagttgggcccgcgcctgggcgcgcgacaccgcgacgctagcgcggctgccctacggcgagcccggcttcctgcacctggtttcgccctacatcacctcaagcccggcccatagcctggcgttgagcgacctggcggcgctgcacccggcggccagctgcggctgcggcctggccaccgactggttcgagctattgggccgcgccggcaccagcaagagccgcagctgcgcgatggccgcgtccgaactgatcaaggagtcctga

SEQ ID NO: 4405 - DNA, 1257 bp, Chromobacterium substugae
atgcccgccgaaaagtttcgccccctgctcgccatttcccgccgccaggcgctgtgcttctgcctgctgctcaccgccttcgaactgctgacctacctcgccagcgacatggtgatgccggccatgctgcaagtgacccgcgatctggacgccgacagccgccacgtgcccaccgccctcaacgccttcctgctgggcggcatcgccctgcaatggctgatcggcccgctgtccgaccgcttcggccgccggccgctgctgctggccggcgtcctgggcttcgccgccgcctgcgccgccgccgccggggcgcagcagatcgaaagcttcaacctgctgcgcttcgcccagggcaccgcgctcggcttcgtcatcgtcgtcagctacccggcgctgcaggaaaccttcgccgaggaggacgcggtgcggttgatggcgctattggccaatatcgcgctgctgtcgccgctggccggaccgctgttgggcggcctgctgctgaagctgctgtcctggcgccagctgttcgccgcgctggccgccgccgccttgctggtggcgctgggcctgtggcggctgatgccggagacggtgggcgcgccgcgccgcgacggccccgcgctgccgccgacgccattgcggctgaaggccgcgctggccaactacctcggcctgctgcgccaccgcaccgtgctgtgcggcagcctggcgctgggcctgatcacgctgcctctgatcgcctggatcggcctgtcaccgctgctactgatccgccagctgggctacagcaacctggaatacggcctgtggcagctgccggtgttcggcggcgtgatcgccggcaacctggcgctgaaccggctggccggccgccagagcctggcgcggctgctgcgcctctccctggcgccgatggcctgcggcctgctgctgaccggcatcctcaccccgctgcatccgacgctgccgaccctggccgccggcctcgccatctacgccttcggcctgggcctgggcaacgccacgctgtaccggctcaccctgtacgccagcgacagcgccaagggcagcgtcgccgcggtgctgggcatgctgtccaccgccacgctgggcgccggcgcggccttgctggcctggctgaacgccggcgacagcccgcaaagcttcgccgtcggcgccaccgccgccgcgctgctggccgcgccgccgctgtggctgctgctgcgcgcgccgcagccgcaggccagcgccgcctga

SEQ ID NO: 4406 - DNA, 741 bp, Chromobacterium substugae
atgttgcgcgccgctttgtgcggcctgttgctggccggcgcggcctgttacgcgatggccgacggcgacgctttgtggcgcatcgtcggcgagcagtgcctgcccaatcagcaaagccaaggcaaacccgacccctgcgttgaagtggggcaggcggtggcggtgctgaaagaccgctacggcgcgctgcaatatctgctgattcccaccagccgggtcagcggcatcgaaagcccgcagctgctgcgggacggcgcgccggcctactggcgcgaggcgtggcgcgcgcggcgctacatggcgctgaagcgcggcggcccggtgccgcgccaggcggtggcgctggcgatcaactcgcagtacggccgcagccagaaccagctgcacatccacatttcctgcatcgaccccaccgtgcgccagcaggtggacgatctggacgacagcctgccgcggcgctggcgcccgctgccggtggagctgaaaggccacgcctactgggcgcggcgcgtggacgccgaccgggacggcaatccgcaaggcgatccgttccgcctgctggccgacgagttgcccggcgcagccgagcagatggggcgctacggtctggcgctgctgccggccagcttcgccgacggcgacggcttcgtgctgctggcaggccgcgccgacctgctcagcgcgaaccgcggctcggcggaggagttgcaggaccacgactgcaaggtgctggaccgctag

SEQ ID NO: 4407 - DNA, 393 bp, Chromobacterium substugae
atgcagcagagcctggggctggtgtcgctggtggtgagggattacgacgaggccatcgatttttacgtgaatacgctgggtttcgagctgaccgaggacagctaccagccggagcaggacaagcgctgggtggtggtgacgccgccgggctcgcaggccggcctgttgctggcgcgggccagcaacgaggggcaggccgccttcattggcaaccaggccggcggccgggtgtggctgttcctgaataccgacgacttctggcgcgactatcggcgctaccaggcggccggggtggagttcgtccgcccgccgcaggagcaggattatggcacggtggcggtgttccgcgatttgtacggcaatttatgggatctgctgcagcgcaagggctga

SEQ ID NO: 4408 - DNA, 777 bp, Chromobacterium substugae
atggaccactcagccgacctcgcccgccgcttcggcggcatcgcccgcctgtacggcgacgacgcgctcgcgcgcttccagaacgcccatgtctgcgtggtgggcgtcggcggagtcggctcctgggcggtggaggcgctggcgcgcagcgcgatcggcaaactgacgctgatcgacctggacaacgtcgccgaatccaacaccaaccgccagctgccggcgctggatcctttgtacggcatggccaaggtcacggcactggccgaacgggcgcgggccatcaacccggcctgcgaggtgattgaaatcgaggatttcgtcaccgaagagaatatggacgcgatgctgggccagggctacgactacctcgtcgactgcatcgacagcctgaaggtgaagacggcgatggccgcctggtgcgcgcgccaccgccagcgcttcatcgtctccggcggcgccggcggccagatggatcctagcaagatcaagctggccgacttgtccgaagtgacacaggacccgctcttgtccaagctgcgctacaacctgcgccgccaccacggcttcgcccgcgacggcaagaagatgtgcgtgccctgcgtctactccaccgagcagctggtctacccgcaggcccaggcctgcgatgccgacgacgcgcgcggtccgcagggcctgtcctgcgccggcttcggcgccggcatggtggtgacggccagcttcggcctgttcgccgcgtcgcgggtgctgaccgatctggccaaggccaagaaataa

SEQ ID NO: 4409 - DNA, 225 bp, Chromobacterium substugae
atgaagcagcaaagattcgatatcgatctggacaaacactacaacgccaccgtggtgatcgcctgcgaagaatgcggccgcgaaacccgccagcatctgcgaaccatcgtcccggaccacccgctgcagtgcagctgcggcgccgacatctccatggccgcgcccgacatccagaaggccgaacgccaggccgacgccatcaggcaatcgtatcggatacattga

SEQ ID NO: 4410 - DNA, 336 bp, Chromobacterium substugae
atgcaacaaacctacgccttcttcgcgctgctgcgcgtccaccccaactggctgcggctgagccgcccggagcgccgccgcttcgaggccgaaacgctgcggccgatctacgagcgctacccggcggtgcgcatgcgctggttcgacgccgaagccttcaccggccgctgcagcgacatcgcgctgttcgaaaccgagtcgatccgcgagttctactacctgatcgacgcgctgcgcgacagcaagatcgccaccgagccctacttcgagtttctcgacatcattccggcggtggaggacggtttccgcgaatacgacgcccaactggcgaactaa

SEQ ID NO: 4411 - DNA, 597 bp, Chromobacterium substugae
atgcccgccattccccaagcccgaaaacagccgcgccaggcgcgttcgcgccatgccgtcgccgccattcttgaggcggcggctcgcattctggcgcgcgacggctacgctggcctgaccaccaacaagacggccgagctggccggcgtcggcatcggctcgctgtaccaatacttccccaataaagacgcgctggtggccgcgctgcaccgccgccacggcgaggaaacgctggccgcggtgcaggatgcgctgcggcgcggcgcgggctggccgccccggcggcagttggcggagttggtggcggcggtgctggcgctgcatctgcgcgaactgggcctgcaccgggtgctggagcgcgaatggccggccttcgacgagccgccggccgtcaacccgcaggacgccgcgctgcgcgactgcgtggccgcctggctggccggcatcggcgccgacgccggccgggcggaggtgctgctgaggatggccgacggcctgatccacggcctgctgctggacgccgagccgccgccggacgcggcgcgactgattaccgacgcgctggcggcctgtctgggcctgccggcggaaacttga

SEQ ID NO: 4412 - DNA, 1032 bp, Chromobacterium substugae
atgatgaagtggatagacctgcgcagcgataccgtcacccagccgacgccggcgatgcgccaggcgatgctggacgccgaactgggcgacgacgtctacggcgacgatcccaccgtgatccggctggaagcgctggcggcggacaagctgggcaaggaagcggccctgctggtgcctagcggcaccttcggcaaccagctggcgctgttcacccactgccggcgcggcgaggaggtgatcgtcgaggacaacagccacatcgtctggcacgaagccggcggcgcggcggtgatcgccggcgcgcagctgcgcaccatcgagggccgcgacggcgtgatggcgacggcggacatcgagcgtcgcatccgcgtcggcgatgacatccacgagccgcgcaccggcctgatctgtctggaaaacgcccacggcaacggcaaggtgctgcctttggcggcgatggccgacaccgcggcgctggcgcgcgcgcacggcgtgcccatccacctggacggcgcgcgggtgttcaacgccgccgcctacctgggttgcgacgtgcgcgagatcacccgtcatgtcgacagcgtgatggcctgcctgtccaagggcctggccgcgccgatcggctccgtcctggccggcagcgccgacttcatcgccgcggcgcggcgcaagcgcaagctgttgggcggcggcatgcgccaggccggcgtgatcgccgcgccgggcatcctggcgctgaccgagatggcggcgcggctgccggaagaccacgccaacgcccgctacctggccgagcgtctggccggcctgccgtgcatcgacatccgccccgacgacatccacatcaacctggtgtggttccgcttcaacgccgacatcgacagcgccgagctgatggcggcgctggaggaggccggtttcctggccaatccgccgcaccagggcatgatgcgcctggtcacccactggcaggtggggcgcgacgatctcgaccgcctggtggaagcgatgcggcgggtgctttgcgactga

SEQ ID NO: 4413 - DNA, 723 bp, Chromobacterium substugae
atgtggcgacgcctgttgtccggcgcgctgctggcggccggtttgtgcaatgcctggtcccagcccgcgcgcgctgccgggctggacgcggtgagaatctacaccgacgacgatccgccctacgtgatggtgggggcggacggcaaggtggccggcggcaccacggtggaaaaggtgacgcgggtgatgcgcaagctgggcctgccgttcagcgcgctggaggcggtgccgtgggcgcgcgcctaccaggaggcgaagacccggccgtacgcgatggtgtttcccatcgccaaaacccgcgaacggctgaagtacctggatttcaccttcaagatcatcgacgcagaagtctatttctactggctgaaaacccgttccgacatccagctggcctctctggaagacgccaagaagcattcggtgtgcgtggtgcgcaacgactaccggcaggaatacctggaaagcgaaggctttctgcggctggacgtcgccggcgacaccaccgacaacgtcaagaagctgctcagcgggcgctgcgacctgatcgtctccaccgaaaccggcatggtgagcaaattgaaggcgctgaacgccgaccgggcgctgctgacgcgcggcatgcggctggacaagctggacagcgcgctgtacgcggcgttcaacaagggcacgccgcccgacgtcatcgcccgtttccgcgccgccgccgccgaagtggagtaa

SEQ ID NO: 4414 - DNA, 777 bp, Chromobacterium substugae
atgatccgacgtctgctgtgcctggcctgcatgtgcctggcagcctggagcgcgcgcgccgagcaactggccagcgtgcagagccgccccggcgtcatcgtgcgcttcctgctgctggagccggccggaccggcgcgcgccaacctgatcctgttcagcggcggcgaaggcctgctcaagctgtcggatgccggcgaactgggcgccggcaaaggcaattttctggtgcgcacccgccaggggtgggccgacatgggttttcgggtggcggtggtggatgcgccgtccgacatgccgcgcggcctgctgggcgactttcgcgccagcgccgagcatgcccgcgatgtcgccgccgtcgccgattacctgcggcgcggcgcggcgctgccgctgtggctggtgggcaccagccgcggcaccacctcggcggtcgcgctgggcttgcagttgccggagcgggtccacggcctggtgctgacttccagcctggacagcggccgcggcagcctggcggacttcgaactggagcggctgcggatgccggtgctgatgatccagcaccgccgcgacgactgccgcgccagccgcgcctacaacctggggaccatcatagaccggctgcgttccgagcagccgcgccagctgatgctgatggacggcggcaagaacgagggcgacccgtgccagccctgggcctggcatggctacaacggcatcgagggccgggtgctgaagctggccggcgcctggatgctgtcgcatggcggcgcgccctag

SEQ ID NO: 4415 - DNA, 2031 bp, Chromobacterium substugae
atgaatccgtcccacgacccccatctctggctggaaagcctggactccaaagccgccgccgactgggtggccgcgcagaacgcccgcaccgaggccgcgctggacgccgatccgcgcttcgccggcttgcgcgccgacatcctcggccatctgcgcgacacccggcagatcccgtacttcgccgagcacgccggctggctgtacaacttccaccaggacgaggcccatccgcgcggcatttaccgccgcaccaccctggacgcctaccgcgccggcagccaggactggcagacggtgctggacatcgacgcgctggccgacgccgacgagcgcgactggtatctggacggcgtgtcgcactgcacggtcaagccggagcgggcgctggtgcacctgaccgacggcggcggcgacgccagcgtggcgcgcgaatacgatatcgaggcgcggcgctgggtggagcatggcttcagctttccggaaggcaagaaccacatcgcctggcgcgacccggacagcgccttcgcctgcccgggctggaagggcgcgccgctgacccgcgccggctacccgcgcgaggtgtggctggtgacgcgcggcgaagacggccagcatggctggactcagctgttcgccgcgccggaagacgcgatgatggtggcggcctggcgctttctcgacagcgacggcagcgcgctcgacctgatcgaagcctccgacggcttctaccgcaagacctaccatctgctggacggcgcgctggagacccacgcgctgccgttgccggccaaggcggagatcgaggcctacatagccggcgatttcatcgtcaagctggcggaagactgggactggcgcggccaacgctatctcaacggcagcctgctggcggtcagtctggccggtctgctgggcgagggggcggcgccgcagttgctgcaggctcccgagccgcggctggcggtggcggcggtggaaaccacccgcagccggctgctggtcaatctgctggacaatgtgaagagccgcatgctgtgcttcgccaagcaagacggcgcgtggacgccgcagccgctggcgctgccggaagacggcgtgatcgagatcgccgaccagccgtggcagagcgacatcctctactacacctacagcgacttcctgacgcctagcggcctgtaccggctggacgcggccagcggcgagggcgaatgcctgcgccgccagccggaggccttcgatccggcgccttatgtcgccgagcagtggcaggccaccgcgccggacggcgaacagattccgtatttcgtggtgcgccgccgcgacgcgccgttcgatggcacgacaccgacgctgctgtacggctacggcggtttcgaggtgccgatgctgccgtactacatcgaaaacttcggcccgcactggctggccaagggcggcgccttcgtgctggcctgcatccgcggcggcggcgagttcggcccgcactggcaccaggcggcgcagggggccaggcgccaggtcagcttcgacgatttcctggcggtggcggaagacctgatcgcccgcaagctgaccgcgccggcccggctggggatagagggcggcagcaacggcggcctgttggtgggcgcggcgctggcgcagcggccggagttgttcggcgcggtggtgtgcgaagtgccgctgctggacatgctgcgctataccgagctgttggccggcgccagctggatagacgaatacggcgaccccgacgacgcggccgagcgcgcggcgctggccgcctactcgccgtaccaccatctgcgcgccgacgcccgctacccgctggccttgttcaccaccagcggcagcgacgaccgcgtccaccccggccacgcccgcaagatggcggcgcggctgctggagctgggccacgacgcgctgttctatgaaaccgacggcggcggccatgccggcaacgccggccaggaggaaaccgccagcgaattggcgcgggtgctggtgtatctgtaccagcggctgatgtga

SEQ ID NO: 4416 - DNA, 1974 bp, Chromobacterium substugae
atgtggactttcgaccatcctcccatcgcgcaggtcaagcagcgctacggcgtcgagctgacgccggcctggctggacaatctgcgccaggcggcagtcgatttcggcgcgtccgcttcttttgtctccccggacggcttgctgctgaccaaccaccatgtcgcgctcggctgcctgaaccagctctccagcgcccagcgcgatctggtggccaagggatatctggcgcgcgagcggcggcaggagctgaaatgccccaacggcaccgcccgcgtgctggagtcgtggcaggacgtcaccgccggcatccaggccgcctctcccgccagcctgccgccggagcaacaggccagccgccgcaaaaccgccatcgccgcagccgaacaggcctgcgacaaggccagcgggctcaaatgcgaggtcgtcagcctgtataacggcgcggtttaccagctgtaccgctatcgcgaatggaaggacgtgcggctggccttcgcgcccgaataccaggccgccttcttcggcggcgacgccgacaatttcgtctatccgcgccacgcgctggacatggcgctgctgcgcgtttaccaaaacggcaaaccctatcggccgccgcattacctcaagctatcccgccagggcgtggcagagggcgaggcggtgttcgtcgccggccatcccggccgcaccagccggctggaaacgctggcccagctgcaattgcgccgcgacgtgaccttgccgctgcagttggcggatgcccgaatgcagcaggcgctgttgcatcgctatgcggcacgctcgcccgaagcggcgcgccaggccaatgacgccctgttcggcgccgagaactggctcaagtcgatgagcggcgaatataaagcgctgcgccagcccgagctggaagccgccaagcgccaggaagaaaccgagctgcaagccgcctatcgccaggcgggtctggcgggcgatccttggcaatcggtcgagcaagccgtcgactaccagcgcggccatttcctggaaagctatttcgtcggctatggccaccgcacgctgctgtcccgcgccggcgcgctggtggagctggcggccgagcggcagctgcccgaaggcgaacggctgaacggctatagcgacagcgacctgccggatcaggagcgctggatccgcgccgatacgcccatctatcccgagctggaagtcgctcggctgaccggccagctggagcagatgcgcgccaagctgggcgctgcgcaccccgccgtgcgcattctgctgggccaggaggagccggcggcggcggcgcgccgcctgatcggcggcagcaagctcaatctggcgggcgaaaggcaaaagctgctggacggcggcgcggccgccatcgccgccagcgccgacccgctcatcgctgcggcgcgccagctctacccgttgcgccgtcaactggaacgcggcgacgaggcccatgtccacacgccgctgcgccaagccgccgcccagttgggccaggcccgcttcaagctatacggcgacagcctgccgccggacgccaccggcacgctgcggctgagctacggcaaagtcgccggctatgacgccgacggcgtcgccacgccgtggaaaacggtgataggcggcgtctacgcccgcgccagcgccttcgaccagcgcccgcccttccaactggccgacgctttggcgaaacaacgccgcgccatcaaccccgacctgccgttcaacttcgtcaacaccgccgacatcatcggcggcaacagcggctcgccggtggtgaacgccaagggcgagctggtcggcctgatcttcgacagcaatctggaaggcctggccggcggccatatctacagcgacgccaaggcccgcgccatcgccgtggacagccgcgccatcctacatctgctggacaaggcttaccatgcccagaatcttttaaaagaactgtctccggcttaa

SEQ ID NO: 4417 - DNA, 2022 bp, Chromobacterium substugae
atgaagcgactgttgccgttgagcctgctggtgtgcctgcaggccgcctgggcgggccccgccgaagaactgaattacggcgcgtatggcatagatctgaagggcatcgatcattcggtgcgcatccaggacaatatttcgctgtacgccaacggcgcctggatgcggcgggcgcagatcccggccgaacgctcgtccaccggcatcgcggaatatctgtatgacttgaaccagcagcgcgtgcgcgaaatcatcgagcatgccgccggcgacgcctcttccccggaagcgggcaagatcgccgccttgtaccagagcttcatggatgaagccgccatcgccaagctgggcctggcgccgctgcgcgcgcagctggatgagatcgccggcctgtcctccgccggccaggcggtcgcctatatggccaagctgcaaggacagccggtggatacgccgttccgtttctatgtgcagcaggaccccaagaactcctctgcctacctggcgggcatcagccagtcgggcctgggcatggaccgcgattactatctgggcaaatcggcggatttcgccgccgcgcgcaaggcgtatcagcgctatctggccaagctgctgacgctggccggcgaaaagcgggccgatagccgcgccaaggcggtattcgcgctggaagacaagctggcgcggatgcaatggagcaatgtcgaaaaccgcgacatccagaagacctacaacaaggtggccgtcgccgatctgggcaagcgcctgcccggctatgactggccggggattttcgccgccgcccaattgtccgccgccaaggatgtcaatctggatcagcccagctacctcgccaaattgtccggcgcgctgtcgcatgcgccggtggcggtgttgaaggattacctgaccttgcgcacgctggacgcgtatgccgcctatctggacaagccatgggtggccgcgcacttcgatttctacggcaaagtgctggatggccgcagcgccgaccgcccgcgctggaaaaaggcggtgtcgctggtgaatgagggcatgggagaagcggtgggcaagctgtatgtggccaagtacttcacgccggaggcgaagcgccaggcggatgagctggtgcgcaatttgctcaaggcctacgaccaaagcatcgataccttgtcctggatggagccggccaccaagcgcgaggcccacgccaaactggccaagtacacgcccaagatcggctacccggacaagtggcgcgattacggcgcgctggagatcaaggcggacgatctggccggcaacgtggcgcgcatcagccagttcaattaccagcgcgacgcgaagcggctgaacgagccggtagaccgcgccgaatggggcatgacgccgcaaacggtgaacgcctactacaacccggccaacaacgagatcgtgttcccggccgccatcctgcaatcgccgtatttcgatcccaaattcgatctggcggtcaactacggcagcatcggcgccaccatcggccacgaaatcagccacggtttcgacgatcagggccatcagttcgacggcgacggcaatatgcgcaactggtggacgccggcggacgagaagcacttcaaggaagtgacggccaaactggtcaagcagtacagcgctttcgagccggtgaaggggcatcatgtcaatggcgagttgacgctgggagaaaacatcgccgacaacgccggcctggaaatcgcctacaaggcctacaagatcgcgctgggcggcaaggaagcgccggtgatcgacggcatgagcggcgatcagcgctttttcctggccttcgcccagtcgtggcgcagcaagagccgcgacgcggcgacggtgaagcagatcgtgtccgatccgcacacgcccgacctgtaccgcccgatcggcacggtcagcaatctggacccgttctatcaggctttcggcgtcaagccgggcgacaagatgtatttgccgccggcgcagcgcttccacctgtggtggtga

SEQ ID NO: 4418 - DNA, 534 bp, Chromobacterium substugae
atgaagaaacatctggctttcgcgctggcgctgaccagcctggccggcggcgcccatgccgccgactacatcttcggcgccggcaacggcacccagcagctcacccgcacgtcggacggtttcggcatcggcctcaacctcgactacctgcgccacgaccacaagggcagcgccggcggcgccggcctggagttcgcattgccgctgggcccgctgaccgtggcggccggcggcaagctgatggcgctgtcgccggacagcggctccgccaccgcggcgatgataggcggccgcgccagcttcgacgtggcgcccaaggtcaaggtgttcggccaggcctactacgcgccgagcagcttcgccagcggcagcgtcgaccgcgtcagcgactacgccgcgggcgtgcgctggaacgtggccggcccgttcagcgtggaagccggctaccgctacttcgacatccgccgcgatgacgccagccgcagccgccgccttgccgacggcgcctatctgggcgccggcctgagcttctaa

SEQ ID NO: 4419 - DNA, 633 bp, Chromobacterium substugae
atggacacgcaccaactggacccgatcgaagtgcgcgtgctgggcgcgctggtggagaagcaggcgctgacgccggacgcctatccgatgacgctgaacggcctcgccagcgcctgcaaccagctgaccagccgcgagccggtgctgcagctgtccgacgccgacatcagcgccgcgctggacgcgctgatcgccaagcggctagtgggcgagaggctgccggccggcagccgcgtcgccaagtacgagcaccgcctcaactacgaatggaatatcgacggcgcgcggctagcggcgctgacgctgctgatgctgcgcgggccgcagaccggcgccgaaatccgcacccgcgccggccgcatctacggctttgccggcgtggatgaagtggaaaccgcgctggcggcgctggccgacaaatacccgccgctggcgatgaagctggagcgccagcccggcgagcgcgaggcgcgctggtgccatctgctgagcggcgagccgcagcaggccgaggctgcggctccctgcgaaatcatagacgtgggcctcaccggccgcgtcgccgcgctggaagccgaggtggcggcgctgaaagccaggctgctgtcgctggaacaacatctggccggctga

SEQ ID NO: 4420 - DNA, 1533 bp, Chromobacterium substugae
atggttttacgactatcgctgttattcaccgtattgttcgccctgtggggcgcgctggcccccgaacacatggccgccgccaccggccagtggctgagcttcaccatctcccgcttcggctggttctacctgctatcggtgttcggcttcctggtgttcgcgctgtacctggccttcggccgtttcggccacatccgcctgggcaaggaggacgaggagcccgaattctcgcggctgagttggttcgccatgctgttttccgccggcatgggcatcggcctggtgttctggggcgtcgccgagccgatctcgcacttcgccgcgccggccagcgccggcaccgcgccgcagtcggccgacgccgcgcgcgccgcgatgcgccatgtcttcttccactggggcctgcatccgtgggcggtgtacagcctgaccgcgctggtgctggcctacttcaagttcaaccgcggccagcccggcctgatcagcgccgccttccgtccgctgctgggcgaccgggtgaacggcccgatcggcatcgccatcgacgtgctggcggtgctggccaccgtgttcggcgtcgccaccacgctgggcttcggcacgctgcagatcgagagcgggctgcagatgctgttcggcgtccagccgtccgactggctgaccgtggccatcgtggtgatcgccaccgcgctgttcctgctgtcgtcgctgaccggcctgtcgcgcggcatcaagtggctgtccaacctcaacatctgtctggccatcctgctgttcctggcggtggtggtgcttggccccaccggcttcatcttcgacaccttcaccaccacgctgggcgactatctaggcaatctgaccagcaccagcctgcggatgagcccgttcacccagggcacctggatggccaactggacgctgttctactgggcgtggtgggtgacctgggcgccgttcgtcggcatgttcatcgcccgcgtctcccgcggccgcaccatccgcgaattcatcgtcggcgtgctgctggtgccggcgctggccagcttcgtctggttctccgcctttggcggcgccgcgctggacctgcagctgttcggcggcgccgacctggtgtccgcggtcaagagcgacgtatccaccgcgctgtacgtgatgttcgagcagctgccgggcggccatgcgctgtcgctgctggcgatggcgctggtgatcatcttcttcgtcacctcggccgactccgccaccttcgtgctgggcatgttcaccagcggcggcaatctcaaccccagccaccgcgtcaagctggtctggggcgtgctgctggccgcggtggcgctgatcctgctgcaaagcggcgggctcaagggcctgcaggcggtgctgatcgtcagcgcgctgcccttcatgctgatcatgataggcatggcggtgtcgctgtaccgggcgctggacgaggaagagcgcgacggccgcaagcgcgaaatccgccgcctgcgccagctggaagcgctggagcgccgcgagacgcgctga

SEQ ID NO: 4421 - DNA, 747 bp, Chromobacterium substugae
atgatccgaatcgatattttgctggtggaacaagggcttgccgcgtcgcgcaccgccgcgcagaacctgatcgccgccggccgcgtcagccatcagggcgcggtggtggccaaggccagccagaagtttccgccgcatgccgaattcgcggtggtcgccgacgcggccgaccgctatgtgtcgcgcggcggcctgaagatgcagggcgcgctggcgcaggccggcatcgcggtggacggctggtgcgcgctggatgtcggccagtccaccggcggcttttccgactgcctgctgcaatacggcgcgcgccgggtggtgggggtggatgtcggccacgatcagctgcatcagcggctgcgcgacgacgcgcgggtgcgctacttcgagggcgtcaacgcgcgcgcgctggaccacgccgcgctgctggccgccaacgacggcgatggcttcgacctgatggtctgcgacgtgtccttcatctcgctgagcctggtgctgccgtcggcgctgccgctgctgaagccgggcggccgcctgctcagcctggtcaagccgcaattcgaggtggggcgcgaggggctgtccaagggcggcatcgttcgcgacgccagcttgtatccgctggtgcaggacaagatcaaccgggtgctggccgagcagaacatgaagacgctggcctggttcgacagtccgatcaagggcggcgacggcaaccacgagttcttcgtccacgccgcgcgccgctga

SEQ ID NO: 4422 - DNA, 477 bp, Chromobacterium substugae
atgtaccgccacatcatcgccgcgatagacggcagcaacaattccgacaaagcgctgcacgaagccatccgcgtcgccaaattcagcgacgcccggctcaccctggtccatatcgccagcctgcgcgaactggccgtcgacagcctgggcgtctacgccggcgaccccggctacgacctggcgctgcagcaaggccaggaggcgctggcgcgcgcgcagcagctggcgcgcgaggccggcctgcacaatgtgctgagccatctggaaaaaagctgggaaggcggccacgacctggccgacctgctgataggctacgcccgctcgcagcaggccgacctggtggtgctgggcacccatggccgcagcggcctggcccacctgttcatgggcagcttcgcccaggacgtgctgcgccgcagccactgcccgctgctgatcgtgcgcagcaccgacgacgacgacatccgcgtcgagtaa

SEQ ID NO: 4423 - DNA, 1350 bp, Chromobacterium substugae
atgtctgatgcccgcatgccggcaggccgcatcgaatggctgcaacacagcaaggcgagggatgtggaactcgccttcgccgatgtccacggcttcgcccgtggcaagaccctgcccgcttcggccttcatccagggccagcagctgcgcatcgcccgcgcggtgccgctgcaaagctgcgtcggggaattccccgactacagcttatacggcgaacacgatccggacgtgaccctcacgccggactacgacaccctgcgtctcgtcccctgggccaagacgccgcgcgcgctggtgatctgcgactgcgtcgaccacgacggcggcctgtcgccgctggcgccgcgctccatcctgaaacagctgctggcgcgctacgccgcccacggctggactcccatcgtcgcgccggagctggagttctacctgttcgccgcccacggcgacccggcgcagccgttccagccgccgcaactgccctgcggccggcgcgaaaccggcttcgacgccttcggcttttccgcgctgggcgaactggaagcctttttcgacgagctataccaggcctgcgagacgctgggcatcgccaccgacacctgcgtgcacgagatgggccccagccagttcgagatcaacctcaagcacggcgacgcgctgaagctggccgacgacaccttcctgttcaagaccgcgctgaaggaaatcgcccaccgccacggcctcagcgccgtgtgcatggccaagccgctgcccggccagcccggcagctcgatgcacatccaccaaagcctggtggaccgccgcggccgcaacgtcttcagcggcgacggcggcgaagccagcccggcgttcttcggcttcatcgccggcctgcaacgcttcctgccggagctgatgccgctgttctgccccaatcccaactcctaccgccgcttcgtcaagggcatggcggcgccggtcaacctcagctgggggctggacaaccgctcggtcggcctcagggtgccggtatccggcccggaggcgcgccgggtggaaaaccgcctgcccggctgcgacgccaacccctacctcgcgctggccgccagcctgggcgccggtctggccggcatcgaacagaaactgacgccggacgaagcggcgcacggcaatgtgttcaagcagcaggccgccagcctgccgaccacgctggacgccgcctgcgcggcgatggcggcggcggaaatcggcgaaaagctgttcggcgccgacttctgccgcgcttatctggcggtgaaggaggtggagttgaccgactaccatcgccaagtcaccacctgggagcggcagtacctggggtttctggtctga

SEQ ID NO: 4424 - DNA, 1611 bp, Chromobacterium substugae
atgcagctgaatacccgcctgatcatcatcatcgccgccagcatgatcgcgctgctcggcatctccacggtcgccctgttctccacccgcgccaccctgcaccaggaaaaacgcgaacagatcgtccatctgctgaaaatggcggaaaacagcctcagccacttccagcagctggaaacccagggcatgccgcggccggaggcgcaaaagcaggccatcgccgcgctgtcggcgctgaaggtcggcgacatctatttcttcggccgcaaccgcgacaacctggtgctgttccaccccagcaaggaccgcgtcggcaaggtggacatgggcagcaagctgccggacggccgcaccaccgtgcaggcctacgaagacgcgatgcagcaggaccactacggcgtgctgaccatccagaccaagcgcgccggcagcggcgccgaggaattccccaagctcaacggcgtgttccgcttcgacccctggggctggaccataggcaccggcatcttcatcgacgacatcgaccagctgttctggagcgaggcgcgcacgctgctgctagtggcggtgctctgcatcgtggtgctgggcgcgctggtgggctggatgtcgcgctccatcctgcagtcgctgggcggcgagcccgcctatgccgccgaggtggtgaaggccatcgccgacggcgacctcagcttagccattcaagtgaagggcggcgccggcagcctgctgggcgcgatgcaggacatgcagggcaagctcaggcggatgatagaagagatcggccacgccacgcagagcatcaaccactcctgccgccagctctccagcgacatggacaaggtgcacgaggtgtccggcatcgccagctcgtccaccacctcggccgccgccgccatcgagcagctgtcggtcagcatagaccatgtcagcgccagcacccgcgacaccgaaagcggcgcgcgcgacaccgcccagctggccagcgaaggcaagacgctggccggcaacgccgccgacggcatccgccaggtcgccgaccagatccacagcgccagcgacatggtcggccagctggccgagcgcagccgcagcatcagcagcatcgccgaaaccatacgcgacatcgccaaccagaccaatctgttggcgctgaacgcggcgatcgaagcggcgcgcgccggcgagatgggccgcggcttcgccgtcgtcgccgacgaggtgcgcaaactggccgagcgcaccgccagcgccaccgacgagattagcaccatcgtgcaggcggtgatcagcgaaaccggcaacgtctccagccagatggacgaaatccgcccggcggtgcaggccggcgtggaacaggtgcagcaggcggcgcagacgctggattcgatcagccgccaggccagcagcgcgctggaaaacgtccacaacgtggtggtggcgatgggcgagcaaagccaggccggcaccaatatcgccggcaatgtcgaacaggtggccggcgtggtggaggaaacgcagaactcggtcagcaacgcggtggaggcggtgcgcgacatcgaccagcaagccgccaatctgcatcagaccgtcggccgcttccgcctgtaa

SEQ ID NO: 4425 - DNA, 1401 bp, Chromobacterium substugae
atgcctgccgtttcccacccgatgtacgaccagcattacgccgacggcaaagcccgccgccagaactgtccacgcgccagccaggctgagtgccggctggccgccgaccgcgacgtggtggcgctggtggagtccacctcgcaaggccgggtgccggcgctggcgccgctgcgctacgcgcgcatgcacgcgtcgccgttcgccttcttccgcggcatggcgatgatccaggccgccgacctcgccgccggcccggacagcggcctgcgcctgcagatctgcggcgacgcccacctgatgaacttcggcttcttcgcctcgccggagcggcagttggtgttcgacatcaacgatttcgacgaaacccaccccggcccctgggagtgggacgtcaagcggctggcggtcagcctggtgctggcctcgcgcagccgcggcttcggcgccggcgacgcccgcgacaccgtattgcagctggcagccacctaccgccgccgcctgctcgccttctcgcagatgagccagctcgacctgtggtactgccgggtgggcttcgaggagctgctgtcgcacgcgcccgacccggcgatgcgccagcaattgcagaaagtggccgacaaggcgcgcagccagacccaggagcgcctgctgcccaagatgaccgaaagcgaggacggcgcgctgcggctgcgcgacaacccgccggtgatcttccacctggacgaggccggcggcccgctggccgcctgcgacgactggctgggcgccgacagcctctccaaggtgcaaggcatgctggagcattacatcgccacgctgaaggaagaccgccgcgagctgctgcggcgcttccgtctggtggacgcggcgttcaaggtggtgggcgtcggcagcgtcggcacccgctgcctggcgctgctgctgcaggacgactacgaccagccgctgttcctgcagctgaaagaagcgcggccgtcagtgctggaagccttcacccaggactgcgtgcacggcaaccagggcaagcgggtggtgttcggccagcggctgatgcaggccaccagcgacctgttcctcggctggacccacagcgccgacggccgccatttctacatgcgccagctgcgcgacatgaaaggcgcgccgacgctggaaaccttcgccgccgccgaagagctggccagctacggccaggcctgcgcctggacgctggcgcgcgcgcacgccaaatcgggcggctgcgccgccgagatcgccggctacctgggcgacagcgacaagttcgaccaggcgctggccgactacgcgcaggcctatgccgatcaggtggaagccgactaccggctattcgacgccgcgatccaaagcggccgtttgccgtgcgcggcggcggcgcgctga

SEQ ID NO: 4426 - DNA, 369 bp, Chromobacterium substugae
atgccgaagttccgcctgctgctgtccctcgccctgtccctgcccctgctcgcctgcaccacgccgctacgcgccgcccccgccggcggccccgcgctggactcctcccgcccgccggcacagctgaccgattgcctgcagcaagggctgcagaaactgcacatccccgacgatttcatcgaacgccgcgacgagcgcgacggcagccacagcctggcgatgcgcaaccccgccagcgacgcctccggcacccgggtggaaatcctgccgcaggccgacggcagccggctgcaagtggagctgaacggcctgccgctgagcccggcctggaaaaagctgatccacagctgcagcggcaagaggctgtga

SEQ ID NO: 4427 - DNA, 477 bp, Chromobacterium substugae
atgaaaaccctgaccaatccagacctggccgccatgtccgccaaggccgcctgtgcgccgcgcctgcgcgcccaccacaatctccacgagcagctggacgacgccatccagcgcctggccatcgccatggagccggacacttatgtccgcccgcaccgccatccgggcagccctgagctgctgatcgtgctggccggcgcgctggactggatcgaattcgacgccgccggcgaaaccgtggtcgcccgccaccggctgggagagggcggcgcgcgcgtgttcgagatgccggcaaacacctggcactcggtggtgtcgctcgaaccaggcagcgtggtgttcgaagtcaaacgcggcccctacctgccgctggacagcgccgaccaggccgcctgggccccggccgaaggcgacgcccgcgtcgccgacatgctggctttcctgcgcggctgccaggccggcgagcgtttcgcgtaa

SEQ ID NO: 4428 - DNA, 939 bp, Chromobacterium substugae
gtgaacgcaaataaaaaagtagcgctggcgctgttggctggttctttcggtttcggctccccggcgcagtccgcgccaagcggagccgattcgtcgccgactccattcagcgtgcccttggcgaagcaagccaatggctttgtcgcggtgaaggcgcggctcaatggcgtggatggccgcttcttgctcgacagcggcgcgtcgatgacttgcgtagaccgcaagcaggcggcccggtttggtttggaaaatcaagggacaacgcgcacctcgcatgggtccgccggggcaaccgagatcaagcgggtagccgacaagcggctggaatggggcggcagattggcggcagacaagttggctgtgtatttgacggatttcgacgcgatcaaccaaggtttggccgaagaaggggttgccgcggtggatggcgtcatcggcatggatgtgctggccgagcaatatgcggtgctggattatgggcaacagcagttgcgcttgggaaagggcgccacgccggcagcggcttttgatcgcttgcctttgacgtcgctgggcggcagccaattgatgctggagggggtgatcaatggcgtgaaagggcgcttcatcatcgacaccgccgcgggagggacgttcgtcaccgacgatgcgcacgccgccaggttccatctggtccgccaacctggagcgaatcaggtccatggcgtcggcggcagcgtcgaaagtcatttctacttattggacagcttgcagctaggcccgcgtttcacgctgcggcagcagaaggtggagaccatggatctggccggcgtgaacgcctcgctgaaagccaaagggctggaggaggtggatggcttgcttggcgccaatgtgctgaatcagggggcggccgtctttgacatcggacaacaggttttgcagctcaagccattgatttga

SEQ ID NO: 4429 - DNA, 1260 bp, Chromobacterium substugae
atgaacataaaagaatacatgcagcagctgggcaaggcggcgcgcaaggcctcgcgcctgctggcgcgcgccgacacccaacagaagaacgccgcgctgctggccatcgccgacgccatcgtccgcgaccaggacctgctcctggccgccaaccggcgcgatctggacgccgcgcgccgggccggcctcgacgccgcgatgctggaccggctgaccctgtccgcccacggcgcgctggcgatggccgacggcctgcgccagatcgccgcgctgcccgacccggtgggcgaaatcagcgagatgagctaccgcccgtccggcatccagctgggcaagatgcgggtgcctctgggcgtggtcggcatcatctacgaggcccgccccaacgtcaccgccgacgccgccggcctgtgcctgaagtccggcaacgccaccatcctgcgcggcggctccgaagccttccacagcaaccaggccatcgccgcctgcgtgcacgagggcctgcgcctggccggcctgccggccgaggcggtgcaggtgctggaaaccaccgaccgcgccgcggtgggcgaactgatctccatgccggaatacgtcgacgtgatcgtgccgcgcggcggcaagggcctgatcgcccgcatcagcgccgaggcgcgggtgccggtgatcaagcacctggacggcaactgccacgtctacatcgacgacaccgccaatccggacaaggcgttcaacatcgccctcaacgccaagacccaccgctacggcacctgcaacaccatggaaacgctgctggtgcacggcgccttcgccgaattcatgctgccgcgcctggccgacgcctactgggaaaaaggcgtggagctgcgcggctgcgagcgcacccgggtgatactgggcgacaaggtggtgccggccagcgaagacgactgggccaccgaatacctggcgccggtgctggcggtgaaagtggtgaaggacatcgatgaggcgatcgagcacatcaaccactggggcagccaccacaccgacgccatcgtcagcgaagactacggccgcgcgcgccgcttcctgcgcgaggtggactcggccagcgtgatggtcaacgcctccacccgcttcgccgacggcttcgaatacggcctgggcgccgaaatcggcatctccaccgacaagatccacgcccgcggcccggtgggcctcaatggcctgaccagccagaagtggatcgtgctgggcgacgggcagatcaggcagtaa

SEQ ID NO: 4430 - DNA, 1593 bp, Chromobacterium substugae
atgcccctgcttcgcctgttgctattgcttgcgctatgcctgccggcgctggccgccgaaccgcgcgccaacccgtcgccggccgacagcgcccgcaccctggtgctggacaaccgcccgatcttcctgtttctggccccccaggccaggctgagcccggagcagcggctgcggcgcacgctggagcgcatccgcgagctgacgccggacgacctgagccagccggtgcaagccgcgccgctggccgactccagcctgcgcggcatcgcgctgagcatccacggcaaaccgctgttcacgctgttggcggacgacctggaccccggcgatcaattgacgctggagcaggctgcggcccgggtgcgcgaccggctgaacgaacagcggctggccgcgctggagcagcgctcgccggaacagatggccaaggccgccttgctggcgctgctggccagcgccgccttcgccgttctgctggcgctgatcctgcgcttgcgcgcggcctcgcgccgccgcctgcagcggcagccgctgggccggctgccctggctgggcggcaagttcgacctgcgccatttcctgcgcgccgccgaatgccagctggtggacgtcaccgcgctgctatgcgcgctgttcgccggctatgtctggctcagctacgcgctgggcctgtttccctatacccggccgctgggccgcaaactgggagattcgttctaccagctgctcgccaccctggccgacgacatcctgtcggcgctgcccggcctggccacggtggcgatgatcttcctgctgacccggctgctgggccgcggcctgacgctgctgtgcggcgcggtggaacgtggccagctggcgctgcccggcctgcacgccgagaccgtcggcgccacccgccggctggccggggtggcgctgtggctgttcgcgctgatcgtcgcctatccctacctgcccggcgccggcagcgacgccttcaagggcgtcagcgtgttcttcggcctgatggtgacgctgggctccgccgggctgatgaaccacgcgatgagcggcctggtgctgatctacgcccgcgcgctgcggcgcggcgactacgtgcgggtgggcgaagtggagggcacggtgatcgaactgtcggcgctgtccaccaagctcgccaccagccagggctatgaaatcaccctgcccaacgcggtggcggtgggcggccggatcagcaacttcagccgccatggcgaaggcggcggcgcgatgatcgccagccgcgtcaccataggctacgacaccccgtggcgacaggtgaccgcgctgctggagctcgccgcgcgccgcagccccggcgccgatccggcgtacgcgccgcaggtgcgcaagctggcgctgcaggatttctacatcgagtacgagctgcaactgcggctgctgccggacgccgatccgcccggcgcgcgcgacgcgctgcacggcgaaatcctggacgccttcaacgaattcggcgtgcagatcatgtcgccgcacttcgtcgaacagccggaaaaaccggtcacggtgccggcccagcgctggcgcgaaccgcctgccggacaatag

SEQ ID NO: 4431 - DNA, 1188 bp, Chromobacterium substugae
atgagtcccggcaccacccgctcctctctcgccctggcctgcgccatcattctggccgggctcaatctgcgcccctgcctggccgcgatcggccccttgctggaaccgatccgccacgccaccggcatccgcttcagcgacgccgccctgctcaccacgctgcccatcgccgccatgggcgggggcgctttcgccggcggccggctggaagcctggctgggcgcgcgcggcggcgtgctgctggcgctggcgctgatcctgctatcctgcgcgctgcgcctgccgccgcccggctaccccgccctgctcgccaccgccttgctggccggctgcggcatcgcgctggcccaggcgctgctgcccggcctgatcaagcagcatttccccgataaggtctcgctgctgatgggcctgtacgtgaccgccatcatgggcggcgcttcgctggccgcggccggcgcgccgtggctggcccaagccagcggccaatggcatctgggcctagcggtatgggcgctgcccgccgcgctgggctgctggctgtggtggcggcacgcgccgaccgcggccggccacgcctcccactcccactccgccgcctcgccgggccgcctgccgcgcgcctggctgctggccggctactttggcctgggcactgccgtctacacctgctcgctggcctggctgccgccgtttttcgtgcagttgggctggagcggccagcaaggcgggctgatgctcagctacatgaccggcatggaggtgctggccgggctgaccttgccggcgctgtcggcgcgcggccccgacctgcgcggctggctggcgctggcgctgtgcttcaccttggcggggctgctcggcatggtggcgctgccgcaagaccggctgatgctgctgtgggtgggtttgctgggcctgggcgtgggcggcctgttcccgctcagcatgatcctgaccctgtcgcacctggacgacagccgggccgccggcaggctgacggctttcgtgcaaggaataggctacctgatcgccgcctgcgcgccgttcgccgccggctggctgcgcgacgtcaccgccagcttccagctggcctggctggcgctctccggcgcggtggtcctgttgctgctgctcaccgcgcgcttcgccccgcaacgctatcggctggcgatgcgcttggcctga

SEQ ID NO: 4432 - DNA, 801 bp, Chromobacterium substugae
atggcttactacacccaccggaatcgacggctgtactacctggctcacggcgacggcccggctgcgctgctgctgcacggcatctgcaacagcggccgcgcctggctgccgcagctggaggcgctggccgcggccggctaccgcgtgatcgcgccggacttcgccggccacggcgcctcgccgcggctggacgcctcgtacggcgtcgccaatctcgccgccgactgcgtcgcgctgctggatcagctggatctggcgcaagcgcacatcgtcggcctgtcgctgggcggcatggcggcgcagcagctggcgctggacgcaccgtcgcgggtccgcagcctgaccgtggcctgcagcttcccctccaccgccaccgacgaagccaggcagatgctggccggctgggcgcagacgctgcgcgagccggacggcccgctgaaacggctggagcaaagctggccgcgcaacctcaacgccgccttccgcgccagccccgccgggcaggcgctgtactggcagtggcaggcgcaggcggcgcaggcggacggcgcgtcgcaagcccatgtctgcgaagggctagccgattaccacctagccgagaacctgtccgccatcgccgcgccagcgctctatctggccggggaatgcgacgaggtgtcgccgccggcgctaagccaatggatggcggcccaggtgcccggcgcgcgctttgcaacgctgcccggcgccgcccacgtagccaatgtggacagcgccgccgccttcaacgccgccctgctcgccttcttgcgccaacactga

SEQ ID NO: 4433 - DNA, 516 bp, Chromobacterium substugae
ttgtgccatgatgcattcatggacaagctagatagcatactcgagcaatggcggcaggcccgccccgatgtcgattgctccgcgatggcggtggtcggccggctgggccgcctcctcatccacctgcaaaaccggctggccgacaacttcgccgccttcggcctgaaagacggcgaattcgacgtgctggccacgctgcgccgcgccggcggcgccgacggcctctgtccaaccgacctctacaccagcctgatgctgacctccggcgccgtcagcaaacggctggaccggctggaagccgctggctgggtgacgcgccaacccaatcccgacgaccgccgcgcgctgcgcatcttgttgaccccggcaggactcgaacgggtagaccgcgcgctggaaggacacgtcgccgccatggaagacgcgctctcgccgctcgcgcccgagcagcgcgctcaactggccggcttgctcaagctctggctgcagggcttccccggcgaatcgcccggctaa

SEQ ID NO: 4434 - DNA, 408 bp, Chromobacterium substugae
atgaaaacccacgcccgcctctgcgccgccctgtcgctggcgctgctatcctcctccgcactcgcctgcggcgacgaagccgcgctgtacagccgcgcctacgaccagtgcatggacgccgccgtctccaccgtcgccatgcaggactgcatcgccgccgagcatggcaagcaggacaaaacgctcaacgacaactaccgcaagctgatggccgcgctggccaagccgcgccagccgcagttgctggcagcgcaacggctgtggctgcaataccgcgacgccaactgccgtctctacgccgacccggacggcggcaccgccgccgcattggccgccgccgactgcgcgctggccgccaccgcggcgcgcgccgccgaactggccaagctgctgccggagcagcactga

SEQ ID NO: 4435 - DNA, 1653 bp, Chromobacterium substugae
atgtcagaccacgatcccctccatcccccgaccgatgccgcgccgcaagacccgtcgcgccgccgcctgttcgaaggcctggcagccatcggcgccgccgcggcgctgccggccgccatcagcgaaagcgccgcagccgcgccggccgtccacggcccgctggacgccaagctgcgccaccatgtgaagaacgtcgtggtgatctacctggaaaaccgcagcttcaacaatctgtacggcaacttccccggcgtgaagcatccgctggcgcaagcgccggccgaaacctgtatccagctggaccgcgacggctccaaactgaagaatctgcccaagatctggggcggcatggtgcagcgcggccagaccatcgccggcaagtactacctgatagacgaaaacgcgatccagaacctgcccaacggccccttcccgctgaaggacgccgacggccagccgctgccggaggccgtgatcacccgcgacctgtggcatctgttctaccagaaccagatgcagatcaacggcggcaagaacgaccagttcgtcgcctgggccgactccggcgcgctggtgatgggccactacagcgaaaccgcgaaaaacctcaaccagtggaaaatcgcccagcaatacacgctgtgcgataacttcttcatggcggccttcggcggctcctacctgaaccaccagttcctgatttccgcccgcacgccggaatacttcaacgccaaggacaccgcggcggccaaaaagatcgccgtgctggacgacggcccgcagggctaccagctgaaggtgaagcaagcgacatcggcgatggacggcccgccgcagttcgtcaacaacggcgccatcaccccggacggctatgcggtcaacaccatggcgccgccgttccaacccagctacatcaagccggcccaaggcggcgaccaacgctacgccgacccggccgacgccaataccctgccgccgcaaacctacgacaccatcggcgatctgctgtcgcgccagggcgtcagctgggcctggtacggcggcagctggcaggcggcgctggaaggcaagggcggcccggacacccccaacttccagtaccaccaccagccgttcaactacttcaagaacttcgcgcccggcacccaggcccgcgccgaacacctacgcgacggcggcctgggcgacagcccgatcagcaaccgcttcatcgccgacgcggtggccggcaagctgccggcggtggccttctacaagccgcagggcaacctcaacatgcacgccggctactccgacgtggaaagcggcgaccgccacgtcgccaacgtgctgcagcacctgatgagcggcccgcagtggaagaatatggtggtgatcatcacccacgacgaaaacggcggttggtgggaccacgtggccccgcccaagggcgaccgctggggcccgggcagccgcatcccggccatcatcgtgtcgccattcgccaagaagggccatgtcgaccacaccttctacgacaccacctccatcatccgcttcatcagccgcctgcacggcctgccggagctggagggcgtcaaggtgcgcaaccaggccttccatcagcgcggcgcccagccgccgggcgacctgaccggcgcgctgcagctctaa

SEQ ID NO: 4436 - DNA, 885 bp, Chromobacterium substugae
gtgcccgccctgcaacatttccagcccgaccattctcccgccgacatcatcgccgcgctggagcgcgacggcggcgtcgtcatcgaccgattgctggaaccggccgcgctggcacgcttccgccagcagctgaacccgctgctggacgcctcgcccgactgccagggcgatttctacggctacgccacccgccggctgtccggcctgatcgcccgcgtgccggcctgccgcgagctggccatccacccgctgatcctgcaggtgatggacgccttcctgctgaagggctgccgcgaataccagctcaacctgacccaggcgatacgcatcggccccggcgagccgcgccaattcctgcacagcgacggcctgatgttcccagtgaaggtgccaggctcggaaagcatgatcaactgcatgtacgcgctggacgacttcaccgaggacaacggcgccaccaatgtcgcgcccggcagccacctgtggccggaagggcgcgaggcgcaagaagacgaaatcgtgcgcgccgcgatgcaggccggctcggtgctgatctacctgggctcggtcatccacgccggcggcgccaaccgcagcgcggcgccgcgcaccggcgtggtgctcagctacaacctaggctggctgcgccaggcggaaaaccactacctggcggtgccgcgggagctggcgagcgagctgccggaacggctgcagcggctgctcggctacttcgtccacgcgcccaacctcggcagcgtggacggccgcgatccgatcgaactgctgcgcggcccggcccagggccaggcgcgcttcaccgaattcctgcccgaggagatccgcggcccgctggccgaggcgcgcgccgccatgcaaaagggctga

SEQ ID NO: 4437 - DNA, 429 bp, Chromobacterium substugae
atgtccggacgcccgctacaagacatcacccgccaggacagccacctggcccgcctcaccgccgccgccaacgagctgatggcgctggaccgcgccttcaagaagctgatcccggaagccatggccgaagcctgccgcgcggtgcgcatccgcgacgacgagctggtgctgtacgccgacaacggcatcgtcgccgcccggctgcgcatgagcgcgcccggcctgctgccgcagctggccagacagggctacccggccgccaaggtgaaggtcaaggtgatgctgaagctggcgcggcggaaaaaaaccaagaccctggccatcagcgaaaacgcgctggacggcatggagcaagccgccgaaagcatagacaatccggtggtgcgccaggccttggccaggctgatcgcacatcagcgccgcggctga

SEQ ID NO: 4438 - DNA, 1314 bp, Chromobacterium substugae
atgactcacgacaccaccaccccgggacaagaaatcttcaagctgaagaacgtctgccgcggcttcgccaagggcagcgacgagatccaggtgctggacgacgtcaacctgacgctgcacgagggcgagatcgtcggcctcctgggccgctccggctccggcaagtccacgctgctgcgcatcatcgccggcctgatccagcaaagcagcggcgaggtcaactatcgcggcaagccgctgaccggccccgccgaaggcgtggcgatggtgttccagaccttcgcgctgttcccgtggctgaccgtgctgcaaaacgtcgaggccggcctggaagcgctgggcgtggagcccaaggagcgccgcaagcgcgcgctggccgccatcgacctgatcggcctggacggcttcgaaaacgcctacccgcgcgaactgtccggcggcatgcgccagcgcgtcggcttcgcccgcggcctggtggtcaacccgacgctgctgctgatggacgaaccgttctcggcgctggacgttctgaccgccgagacgctgcgcaccgacatgctggacctgtggagcgacaagcagttgccgatcaagtcggtgctgatcgtcacccacaacatcgaggaagcggtgttcatgtgcgaccgcatcctggtgctgtcgtccaaccccggccgcgtggtggccgagatcaaggtgccgttcccgcaccgccgcaatcggctggacccggccttccgcaagatggtggacgacatctacgcgctgatgaccgcgcgccgcagcgcccacacgctgcacaagctgccgctggaaatcggcagccacctcggcgaggtgtccaccaacctgatggccggcctgatcgaggaagtggcgcaggcgccttacttcggcaaagccgacatgccggaaatcgccgagaagctgcggctggaggtggatgatctgttcccggtggcggaaatcctcgaacacctgggcttcgtcgaactgaaggacggcgatatcctgctgaccgccgccggcaagctgttcgccgactacggcacccaggagcgcaaggtgcagttcgccgaacacctgctgcgccacgtgccgatggccgcccacatccgcaaggtgctgcaggagcgccccggccagcgcgcgccgcgcttgcgcttcgcccaggagctggaagactcgctgtccgaccaggcggcggaagaaacgctggacaccgtgatcagctggggccgctacgccgagatcttctcctacaacgaccacaccgaaaccttcagcctggaggatgtggagggcggccagtaa

SEQ ID NO: 4439 - DNA, 1740 bp, Chromobacterium substugae
atgaccaccgctgtccgccatttcatgcccgccaccgcgcggaggctgatacccaaccgctgggatctgatcgcgtttccgctgatcctgggttttctgttgctggccaccagcggcatccgcgaaacctgggcgccgatcaccgcgctgcagaccgtgccgatcacgctggaccccggcaacctgccggaatacgcgctgcgcaccactttgcgcatgctggccgccatggcggcggccctggtgttcacgctgatttacggcacgctggcggccaagagccgccgcgccggcctgctgttggtgccgatactggacatcctgcagtcggtgccggtgctgggctacatctcgttcaccgtcaccttcttcctggccttgttccccggccgggtgctgggcgcggaatgcgcggccatcttcgccatcttcaccagccaggcctggaacatgaccttcagcttctaccaaagcctgcgcaccgtgccacgcgacctggaggaagtctcggtcaacctgcgcctgtcgccgtggcagaaattctggaagctggaagtgccgttctcgatgccgggcatgatttggaacatgatgatgagcatgtccggcggctggttcttcgtggtggcgtcggaggcgatcaccgtcggcgacaagaccgtcaccctgcccggcgtcggctcctacctggcgatggcgatccaggacaagaacctggccgccgtcggctgggtgatcctgaccatgaccgtggtgatcttggtctacgaccagttcctgttccgcccgatggtggcctgggctgacaaattccgcctggaggacaccgccagccaatccgcgccggaatcgtgggtgctgaacctgatccagcgcacccatttcatccagcagctgctcaagcccttcggcaagctgatcaagaccatcgcccggctgcggctgaatgtcagcctgcccaagggcatccattccgaagcccacaccccggtgtcgcgcggcatcgatgtggtgtggtggttcggcgtggcgatgctggccatctacagcgccaacatcctggtgcacttcatcgcccgcgaagtgggcgtggcggaggtgctgcgggtgctcggcctcggcctgatcacgctggtgcgcgtcagcctgctgatcgtgctggcctcggtggtctgggtgccgctgggcgtgctgatcggcctgcgtccggcgctggcggaaaaaatccagccgctggcgcagttcctggccgccttcccggccaacctgctgttcccggtgttcgtggtgttcatcgtccatttcaagctgaaccccgacatctggctgtcgccgctgatcgtgctgggcacccagtggtacatcctgttcaacgtgatcgccggcgccagcgccttccccaacgacttccgcgaggcggcggccaatttccgcatccgcggctggcaatggtggcgcaaggtgatgctgcccggcatcttcccctactacgtcaccggcgcgataacggcatcgggcggcgcctggaacgccagcatcgtttccgaattcgtgtcctggggcaacgacaaggtggtcgcgcacggcctgggcgcctacatcgcgcagaccaccgccgccggcgactacccgaagatcctgctgggcatcgtcaccatgtcgctgttcgtggtgctgttcaaccgcctgctgtggcgtccgatgtacgccatcgccgaaaacaaactccgtctcaactaa

SEQ ID NO: 4440 - DNA, 2046 bp, Chromobacterium substugae
atggacaggcggcaatttctgaagtggggcagtttcctgacggtgtcggcggccagcgccggactgagcggatgcataggcgacgacagcggcagcagcgcgggcggcagaaacctgaacgccgccggcaagcgcttcgacctgggcgtggcttccggcgatccgcgtccggacagcgtcgtgctgtggactcgcgtcgacggcggcgacggcagcaacccgctcgccgtcaccgtgcagctgtcggacaaggccgacttctccaatctgctggtcaatcagagcctgagcgccgatcccggctgggactatacggtgcgccacaaggtcaccggcctgtccgccgccaccttctactattaccgcttcctcaccggcagcgtggtcagcgccgccggccgcaccaagaccgcgccggcggccggcagctcgccggcgcagctgaaattcgcctacatcacctgccaggactggagcgtcaaccactggggcgccttcgatgaaatcgcccagctggacctggacttcgtcatgcatgtcggcgactacatctacgaaaccgtcggcgccggcttccagaccggcggcaacgaaacccgccatccgccgctgaccctgcccaacggcacccggcgcgccgacggcgcgatctacgccaccacgctggccgactaccgctacctgtacaagagctaccgcgccgatccgcgcatccaggcggtgcacgccaacttcccggtgatctcgatctgggacgaccacgaattctccgacgactgctggcaggaccgccaggtctactatccgggcgaagacgacacccccaacacaccgcgccgccgcagcgccaaccaggcctggttcgagtacacgccggccgatgtcagcatcgatctggccaatccgtcgttccagaacatccagatctaccgtagcttcgatttcggcaagctggccacgctggtgatgaccgaccagcggctgtaccgcgccgaccacatcatctccgaagactcagtccccaataccggtctggccaatatcggcagccgctatttcgtgccgcaggcgctgctgtcggccaccgaagccgccaagatcgccgcagccggcggcgacctgcagccggtgtccatcctgggcgacagccagcgcgcctggtggcagcaacagatgcagggcgccgccggcgcctggaagctgtggggcaacgaagtgtcgctgctgagaatgggcgtggacggcacccaggcggtggccggcatgctggcgcagggcctggccccggcgctggcgcagaacttcgccctcaatctaagcgccccccagctgcaacagctggccggcgcgctgtacctggacctgaaagccgccgacgtcagcggcgccaccccggcgctgacttacgccaacacccagcccttgctcgccggcttcagcgccgccatttccgcgccggtattcgccgccgcgctgaagccggcgctggacgccgcgctgccgccgtcgatgctgctgaaccaatacatcctcaacgccgaccagtgggacggctacaacgccgagcgcaaggcgctgatggccttcctgaaaaccaacaacatcggcaatgtggtgggcatcaccggcgacatccacgcctttttcgccggccaggtgatggacgacttcgacgccgccagcccgaccccggtgatggtggacctggtgaccgccggcatctccagcaactccttcttcagctatttcaagaacgtggtggacacggtgccggccttcgccaaggccaagccgctgatctaccagaccgcgaacggccagacggtcaacaccttcaccgccacgctgcaaaccttcaacccctggctgaaatacgccgacagcgacgcccagggctacgcggtggtgacgctgacgccggccaagctcagctgcgccttccacaagatggccaagctggtcggcggcgtcgcgccatctcccgccaccgccagcgtccagaccgtggaagtgctggccggcgccccggtggtcaacgtgctgtga

SEQ ID NO: 4441 - DNA, 2838 bp, Chromobacterium substugae
ttgtttgttaccctgctcttgatgtggcgcatggatgcccccataaccttgtctgcgaatgtgctacacttttcagcattttttgcggacacactttccggcccgctggtttctggattcgattacatgatctcctcgctactcaagaaggtattcggcagccgcaatgatcgtctgctgaagcagttccgccagacggtggtacgcatcaacgccctggaacagggcctgcaagcgctgtccgacgaggcgctggccgccaagaccgatgaattccgcgcgcgcctgtccaagggcgagacgctggacgacctgttgcccgaagccttcgccgtctgccgcgaagcctcgcgccgcgtgatgggcatgcgtcacttcgacgtgcagctgatcggcggcatggcgctgcactacggcaagatcccggaaatgaaaacgggcgaaggcaagaccctggtggcgacgctggcggtgtacctgaacgcgctgtccggcgacggcgtgcacgtggtgaccgtcaacgactacctggtcagtcgcgacgccggcatcatggcgccgctgtacaacttcctcggcctgtcggtgggcgtgaacctgtcgcagatggcccatgacgacaagcaggccgcctacgcctgcgacatcacctacggcaccaacaacgaattcggcttcgactacctgcgcgacaacatggtgttcagcgtcgaagaaaaggtgcagcgcaagctggccttcgcagtggtggacgaggtggactccatcctgatcgacgaggcgcgcacgccgctgatcatctccggtccggccgacgacaacatcgacatgtaccagcgcatgaacgcggtgccgccgctgctcaagcgccaggaaaccgaagaaggcgaaggcgactactgggtggacgaaaaagcccacagcctgctgttgtcggaagccggccacgagcacagcgaggacatcctcacccgcatgggcctcttgaaggaaggcgacagcctgtactcggccaccaacatcacgctgatgcaccacctgatggccgcgctgcgcgcccacgcgctgttccacctggaccagcactacgtggtgcaggacggcgaagtggtgatcgtcgacgaattcaccggccgcctgatggccggccgccgctggtccgatggcctgcaccaggcggtggaagccaaggaaggcgtggagatcaaccgcgagaaccagacgctggcctcgatcaccttccagaactacttccgtctgtacggcaagctgtccggcatgaccggcaccgccgacaccgaggcctacgaattccagagcatctacaacctggaaaccgtggtgatccccaccaacaagcctatggtgcgcaaggacgcgcaggacaaggtgtaccgctccgccaaggagaagtacgacgccatcctggccgacatcaaggactgccacgagcgcggccagccggtgctggtgggcaccaccagcatcgaaaactccgagctggtgtccgagctgctgcacaaggccaagctgccgcataacgtgctgaacgccaaggagcacgcccgcgaagccgacatcgtggtgcaggccggccgtcccggcatgatcacggtggccaccaatatggccggccgcggcaccgacatcgtgctgggcggcaatccggaaccggaaatcaaggcggtgcgcgctgacgacagcctgtccgacgccgagaaaaacgccaaggtagaggccatccgcgccgactggaagcaacgtcacgccgcggtgctggaagccggcggcctgcatatcgtcggcaccgaacgccacgaatcgcgccgcatcgacaaccagctgcgcggccgttccggccgccagggcgacccgggctcgtcccgcttctacctgtgcctggaagacccgctgctgcgcatcttcgcctccgagcgcgtcgccgccatcatggaccggctgaagatgccggaaggcgaggccatcgagcacccgtgggtgacccgctcgatcgaaaacgcccagcgcaaggtggaaggccgcaacttcgacatccgcaagcaattgctggaatacgacgacgtcgccaacgaccagcgcaaggtgatctaccagcagcgcagcgaaatcctggtggaagaggacgtgtccgacgtggtggtgaacatgcgcgaaggcgtgatctccgatctggtcgacctgcatctgccgccggaatcgctggaagagcagtgggacctggccggcctggagaagacgctggccgccgacttcctgctggaggcgccggtggcggcctggatgcaggctgaaaccaccctggacatcgaacatatccgccagcgcatcatcgatctggccgccgcggcctaccaggccaaggtggagcaggccggcgacggcgtgatgcgccagttcgaacgcagcctggtgctgcagatgctggacaaccactggcgcgaacacctggcggcgatggaccatctgcgccagggcatccatctgcgcggctacgcgcagaagaacccgaagcaggagtacaagcgcgaggccttcgagctgttcgccgacatgctggagcgcatcaagcgcagcgtggtgcaagtgctgatgacggtgcagatccgcggccaggaagacgtggaggcggtggagccgcacgcgctgccggagtttgaaatgcagcatgccgagccgggttcggcgctgggcgacgacgaggacaatccgctgtcgccggaagcgctggcctcgcaaggcctgcgcatcaaccgcaacgacctgtgcccgtgcggcagcggcaaaaagtacaagcagtgccacggccgtctggcttga

SEQ ID NO: 4442 - DNA, 1152 bp, Chromobacterium substugae
atgctgcttattctcttctccgccctattcacctcgttcatcttggcgatactggtggtgcgctacaactacctgcacagcaaatactcggctgacagcgatatggcaggcatccagaaattccacgcctgtcctgttccccgcatcggcggcattccgatcttcctgggcttttcggtcggactgacggtcgccggcgtactccacgcctccgtcgaggcgctgtacttcatgcttgcctccctgcccgccttcgcatttggcctgacggaggacttgaccaaaagaatcggtccgctgcctcgcctgctcgccactttcgtctccgcggcgctagtcttttacctgctgcacggcagcatcaaccgtgtcgagatcccctggctggaccacctgctcgccaactacgcgcccttggccttcctgttcacgattttcgccgccggcggcgtggctcacgcgttcaacatcatcgacggctacaacggcctgtccggcacggtggccattctcaccctgctggcgctcgcttacgtggccttcaaggtcaacgactcattcctgatcgcgctttgcttcgccatgataggcgcgatatcgggcttcctgctgctcaacttccctcgcggcctgattttcgccggcgatggcggcgcctacctcacaggattcgccgtcgcggagatttccatcctactgatcgccaggcatcccaatgtctcgccgtggttccctctgctggtggtcatttatccggtcttcgagaccgtgttcaccatttaccgccgcaagttcctgcagaagcgctccatcggccacccggatgcgctgcacctgcaccagatcatctacaaaagagtggtgctgtggatggtggcgtccaaagaagccaagcacctgacccagcgcaacagcatgacttcgccgtatctgtgggcgctatcctccagctccgtcttgccagcgatgctgttctggaaccaaaagtacgtgctgatggctttcgccgcgctcttcgtgctcagctacacctatctgtacaaatcgatcgtccgcttccgcaccccgcgctggatcatgatcaatgagcagatcaagcagcaatcgccggtcggcgccagtaccgcggccaatccacagcgcagctcctga

SEQ ID NO: 4443 - DNA, 480 bp, Chromobacterium substugae
atgaaatcaaaacgcctgttcgccgccttgctgatcgccgcgctgccgctggccgcccacgccgcccccacgctggagcaaagccgcttcaccgacctgaacgccaagcccgccaccaccgccgcctacaagggcaaggtgacggtgctgaacttctgggccacctggtgcggaccgtgccgcgaagagatgccgatgctgaacggcctgcgcaaaaaactggcgcccaagggcgtggaagtggtgggcgtggcgctggacagcaaggagcaggtggaacccttcgtcaagcagctgaagatcggctatcccatcctgctgggcaacgacgacacgctggatctgatgcgcagcctgggcaacaagaccggcggcctgccgtacacgctggtgctggaccgcagtggcaaagtcgccgccgcgttgacaggaaaactggatgaaaagcggctggaaaccgccatcaagccttatctgtaa

SEQ ID NO: 4444 - DNA, 945 bp, Chromobacterium substugae
atgtctatcctcgtctgcggggcgctcgcatacgataccctgttctcgttccatggccgttttgacagccagatcctgccggatcagctgcacaagatttccaccacctttttggctcccaccatgcgccgcgagttcggcggcatggccggcaacatcgcctacagcctgtgcttgctgggcgagaagccgattgtgatgggcgtggtgggcgaggacttcgaaccgtaccggcagcacctgaaacgggtgggcgtggatgaccgcttcatccgcctgatccgcaagcagtataccccgcaatgcttcggcattgccgacaaggacggcaatcagctgatggccttccacccgggcgcgatggatttcgctaccgagaaccacgtgtccgacatcccggatccgatcgagttggctatcctgtcgccgggcggttacaccgccttcatccagcattcgcgcgagctggcggcggccgggatcccgttcattttcgatccgggccaggagttgccgctgttgtcgcgcgacgagatccacgagatcgtcgatctggccagctatgtggcgatcaacgattacgagagcgagttgatgcgcgaacgcgccggcctgacggtcgacgacctgcgcaagaaggtgaaggcgttgatcgtcacccgcggctccaagggcgccgagatctatgtcgacgataccgtgcacctgattccgcgtgtgcagatgcccatcaagccggtggatccgatgggctgcggcgacgctttccgcgccggcctgctgtggggcatcagccgcggcgtggattggaagatcactggccggctggccaatgtgatcggcgcgatcaaggtgaccacccatggctgccagaaccatttcttcgattgggattcgctgaaggatttgtatctgcaggcctatggcgacgaatggccgctgtaa

SEQ ID NO: 4445 - DNA, 1233 bp, Chromobacterium substugae
ttggaaagccgcattctggcggcccaaccgcagatcgaacactggttccgcagccagtggcacgcccacgccacgccgttctatggttcggtcgatctgcgcaacagcggcttcaagctggcgccggtggacatgaacctgttcccgggcggccataacaacctgaatccggaattcctgccgctggcggtgcaggcggcgcagagcgcggtggacaaggtctgcccggaagcgcgcagcatcctgttgattccggaaaaccacacccgcaacactttctacctgcagaacgtcgccaccctggtgcacattttcgagcaggccggcctcaaggtaaggctgggttcgctgaacccggaaatcaccgagatcaccgaactggtgtccgccaacggcgacaagctgacgctggagccgctggagcggcgcggcaaccgcctggtgctgtccgacggcttcaatccctgcgtggtgctgctcaacaacgacctgtcggccggcatccccgatctgctgcaaaatctggagcagacgctgctgccgccgctgcatgccggctgggcggtgcgccgcaagacccatcatttcgaagcgtacaacaaggtgtgcgacgacttcgcgcggctgatttccatcgatccgtggacgatcaatccctacttctccagctgcggcggcctggatttccacgcccgcaccggcgaggagcaactggcggagacggtatcgcagatgctggacaagatccgccgcaaataccgcgaatacggcatcgacaacgaccccttcgtcatcgtcaaggcggacgccggcacctacggcatgggcgtgatgagcgtgaagagcccggacgaggtgatcggcctgaaccgcaaggcgcgcaacaagatgtcggtggtgaaggaaggcctggaagtgtccgaggtgatcgtccaggagggcgtgtacacctttgaaaccgtcaacgaggcggtggccgagccggtggtctacatgatggaccgctatgtgatcggcggcttctaccgcgtccacaccggccgcggcatcgacgaaaacctcaacgcgccgggcatgcacttcgtgccgctgtcgttcgagacgccatgtttgccggaccgcaagggcttgccggactgcgcgcccaaccgcttctacgcctacggcgtgatttcgcgcctggcgctgctggcggcttcgctggagctggaagccaccgacccggacgcctga

SEQ ID NO: 4446 - DNA, 483 bp, Chromobacterium substugae
atgaaaaaactggtttttgcaggtttgatggcgctggcgaacgtgtgcctggcggatggcgtggtggtgaaggtgtcgccggtggcgcaatatggcgacccggtgcgcatcagcagcaatatccgcaacgagtgcgcgctgccggaagcgcaggccgccgccagcctgaaggggctggaggaggccggcatcagcgccgaagccgcgccggaagaccagctgaaacagtccggctattacctgaagctgcggctggagaacgtggtgtcgatgggcaacgccttcatcggccaccacaagtcggtctccatgatcgccaagctgtacaagaacggcaagctggtggataccttcaccggctcgcgcgactcgatgggcggcatcatgggcggcttcaagggctcctgctcggtgcttgagcgctgcacgcaaaccttgggcaaagacctggccgcctgggtgaaaggcaaactggacgcctga

SEQ ID NO: 4447 - DNA, 945 bp, Chromobacterium substugae
atgagaatactgttcatcgccgacccgctggagcacttcaagatctacaaggacaccaccttcgcgatgatggaggaggcgcatcgccgcggccacgccatcagcttcgccgaggcgcaccagctgtcggtggagggcgagcgcatcctggtggacgcgcacgatctggcggtaaccgacgagcgtcccaactggtacaagctggggcaagtgcagcgccagccgctgaccggcttcagcgcggtggtgatgcgcaaggatccgccgttcgacatggagtatctgtacgcgtcgcagctgttcacgctggcggagtcgcacggggtcaaggtgttcaccagcggccaggcgctgcgggatttcaacgagaagctggcgatcctgaatttcccggagctgatctcgccgacgctgatcagcggcgaagcgcaccggctgcgcgccttcgtcaagcagcaccaggacgtgatcctgaagccgctggacagcatgggcggcgacagcatctttcgcgtcaagccggacgatcccaacctgtcggtcatcattgaaaccatcacctggcgcggcaagcgcaccatcatggcgcagcgctacattccggaaatccgcgatggcgacaagcgcatcctggtgatagacggcgtgccggtggaccactgcctggcgcgcatcccggccgccggcgaaacccgaggcaacctcgccgccggcggccgcggcgaagccaggccgctgtccgagcgcgaccgccagatcgccgagacggtagggccggagctgaagaaacgcggcatcctgctggctggcctcgacgtgatcggcaactacctgaccgaggtcaacgttactagccccacttgcttccgtgaaatcatggaccagaccggcatcaacgtcgccggcctctacatcgacgcgctggagcgccactgccagcactga

SEQ ID NO: 4448 - DNA, 381 bp, Chromobacterium substugae
atgggaaagacgcaggaaagcccgttcaagggcaagaccggcctggccaggctgatcaacgcctttggttattcgctggacgggctccgggccgctttccgccacgaggacgcgttccgccagttggtgctgctggcggtcatcctgatcccgatggccttcagcgtccacgccgcgccgctggcgcgcgcgctgctggtggccagcagcctggccacgctgatcatcgagctgctgaactcggccatcgaggcggcagtcgaccatacctcgctggaacgccacccgctggccaagcgcgccaaggacatgggcagcgccgcgcagctgctgggcctgatcaatctggcggtggtgtggggcctggtgctgttcggctga

SEQ ID NO: 4449 - DNA, 366 bp, Chromobacterium substugae
atggtgtctccgcaacaggctggcgcggaagaggcggtggcgaatctggtgctgtggctgaagctggcggtggaggccggcggcgcgttggtgatcgcagccggcgcgctgttattggcgatgcgctatttcacgcagcggctggccggcggcccgcccgactacaaccggctgcggctgggtttcgcccgcatgctggcgctggcgctggaattgcagctggcggccgacatcctgtccaccgcggtggcgcccagctgggaccagatcggcaaactgggcgccatcgccgtgctgcgcaccgcactcaattatttcctggcgcgggaaatccgcgaggccgaagccggccgtgccgccggctga

SEQ ID NO: 4450 - DNA, 378 bp, Chromobacterium substugae
atgaaaatcagcagccacttcctattcaccggctccaccatcctgaccttgttcggtctggccgatcagcaatacctgatcctgcccgtggccttcctgatcgccttcatcggcctgtccgccgccgaccgcgagcagttggccgacatgacgttgcacgccaccgcgatgctgatcccggcctcacagcggcccttgctgccgctggacgccttccgcggccaaggcctgatgttctaccgcgccggcagcccggtgtaccgcatgctgatcgcgcgcgattcgcgctggcaattcctgggcgagcaaggcgaagtggccgaggagcccggctgcatccgcgtctatcccggctacttgtaccgccgcctgccctga

SEQ ID NO: 4451 - DNA, 2310 bp, Chromobacterium substugae
atgcccaccagcctcttgatcgtcgaatcgccgtcgaaggcgaaaacgctgaagaaatacctgggtccggacttcgaagtcctggcctcctacggccacgtgcgcgacctggtgccgaagaacggcgccgtcgatcccgaaaaagacttcgcgatgaagtaccagctgatcgcgcgcaacagcaagcacgtcgacgccatcgtggacgccgtcgccaaggtagaccacgtctatctggcgactgacccggaccgcgaaggcgaagccatctcctggcacctggtcgaaatcctcaacaagaaaaaactgttgaaggacaaggccgcccagcgcgtggtgttccacgaaatcaccaagaacgcggtgctggaagccatccagaacccgcgcgagatcgcccaggacctggtggacgcccagcagacccgccgcgcgctcgactatctggtgggcttcaatctgtcgccgctgctgtggaaaaagatccgccgcggcctgtccgccggccgggtgcaaagtccggcgctgcggctgatctgcgagcgcgagaacgagatcaaggccttcgtccagcaggaatactggtcggtccatctcgacagccacaagagccgcaccaaattctccgccaagctgaccaccctcgccggcgtcaagctggaccagttcgccattcccaacgaggccgagcaagcttcggtgctggcgcgcctggccggcaagccggcccaggtcggcgccatcgagaagaaaaagaaaacccgcagcccggccgcgccgttcaccacctcgacgctgcagcaggaggccgtgcgcaagctgggcatgaccaccgaccgcgcgatgcgcaccgcgcagcagctgtacgagggcatggacatcggccagggcaccgtcggcctgatcacctatatgcgtaccgactcggtggcgctggccaatgaagcggtggaggaaatccgcggctacatcggcctgaaatgggacgccgacttcctgccgaagaaccccgccgtctacaagagcaaggccaagaacgcccaggaggcgcacgaggcgatccgccccacctccatcctgcgcacgccggagatggtgaagcccttcctcaccaccgaccagttcaagctgtacgacatgatctggaagcggacgctggcctgccagatggcgccggccaagttcgacaccaccagcgtggacatcctggtgggggaaggcgtgttccgcgccagcggccaggtgcagacctttgccggcttcctcgccgtgtacgaggaggacgtcgacgacgccgaggacgaagacaacgccaagctgccgctgctggccgaaggcgaagagctgccggtggacaagctctacggcgaccagcacttcacccagccgccgccgcgcttctccgaagccagcctggtgaaggcgctggaagagttcggcatcggccgcccgtccacctacgccagcatcatctcgacgctgaaggaccgcgagtacgtgatcctggacaagaagcgcttcctgccgaccgacaccggcgacatcgtcaacaagttcctgaccgagcacttcgcccagtacgtcgactacaacttcaccgccaagctggaaaaccagctcgacgaaatcgccagcggcaaccgccagtgggtgccggtgatggacagcttctggaaaggcttcaagaagcagatcgacgagaaggaaagcatctcccgcgccgaagtcaccaccgaaagcctggacgaagcctgcccgaaatgcagcaagccgctgtcgatcaagttcggcaagcgcggccgcttcatcgcctgcaccggctacccggaatgcgattacacccgcaacctgggcgaaacggcggaacaagcggcagaagaggctgaggcgccgacggtgatcgaaggccgctcctgcccggactgcggcggcgagctgcacatcaagaagggccgttacggcaagttcatcggctgcgccaactacccgaagtgcaagcacatcgaaccgctggaaaagccgcgcgacaccggcgtggaatgcccggaatgcaagaccggcagcctgatcgaacgcaagagccgctacggcaagctgttctacagctgcaacacctatcccaagtgcaagtacgccacctggaacccgccgatcgcggagaagtgcccgcagtgcggctggccgatcctgaccatcaaggtgaccaagcgccgcggcaccgagaaggtgtgcccgcagaaggaatgcggctacgccgagcagatcgcgccgccggaaggcaaggaagccgcgccggccgaagaggcctga

SEQ ID NO: 4452 - DNA, 459 bp, Chromobacterium substugae
atgtttgacgtactcacctatttattcgagcaatacagcgaccccgccgccttcggcgaccgcaacgccctcacccgccagctgaacgccgtcggcttcgacgatgacgacatcggcgaagcgctggactggctggacagcgtcggcgaaaccagcgtggaagcctacgccggcgccgacgaaggcagcggcctgcgcgtctacgccgacagcgagctggagcacctgcccgccgacgtgcgcggcctgatccagtttctggaggacaacggcgcgttgaccccgtcgcagcgcgagatggtgatagaccgcctgctggagctggacggcgaagacctggacgtcgccaacgccaaactgctggtgctgatggtgttgtgggcgcaacaggcggaactgccgatactgctcggcgaagcgctgctggaagcggtgcacggcgagcccaccatgcaataa

SEQ ID NO: 4453 - DNA, 1071 bp, Chromobacterium substugae
atgagcgccccctggctgaagctggcgctgactcccggcatcggcccggtcggctttctcaagctgatcgacgccttcggctcggccgagcacgccgccgccgcccgcgccgcccagacggaaaagctgatcggccgcgaggccgccgacgcgctgcagcaggacctggccgcgcctatggtggaggccgcgcaggtctggtccgaaggcgaaggctgccacctgctgacgctgctggaccccgattatccgccgcaactggccgaagcggcgtcgccgccgcccttgctgttcgcccgcggccggcgcgagctgctggcgcggcctatgctggcggtggtcggcagccgcgccgccaccccgcagggcaagcgcaacgccgaggacttcgccgccggcctggcggcgcacggctataccatcgtcagcggcctggccagcggcatcgacgccgccgcccaccagggcgcgctcgcccaccccgcgtccaccatcgcggtggtcggcaccggcatcgaccgggtctacccggccggcaaccgcgcgctggcccaccgcatcgcggccgaaggcctgctgctgtcggaattcccgctgggcatggggccgctgcccgggcacttcccgcgccgcaaccgcatcatcgccggcctggcgcgcggctgcctggtggtggaggccggcaccgcctccggctcgctgatcagcgcgcggctggcgatggaaagcaaccgcgacgtgatggcgattcccggcagcatccacaacccgcaggcgcgcggctgccaccagctgatcaaggacggcgcgcggctggtggaaagcgtcgacgacgtgctggacgaagtcggccgcctgtcggcgcggcaggtcgaacaagccgcgccggacggcgggaaagccgcgccgctgctggacgccatgggttgggaaccggcgctggccgagaacctggcggacgcgctcgggttgactgccggggaggtttacgcgatgctgctcgaactggagctggacggccaggtggccagcctcgccggcggccgctttcaaaggctggctcgaacctga

SEQ ID NO: 4454 - DNA, 1038 bp, Chromobacterium substugae
atgcgtaaccgcattatatcgcttgctctggctctagggctggctcttcccgccttttccgacgaactgacggtcaaacccgacgcgccggcccgctacacggtggccagaggggacaccttgtggggcatttccgcccgctacctgaaaagcccgtggcaatggcccgagctgtggcggatgaaccgcgccgacatcaagaacccgcactggatctatcccggcgacgtgctgacgctggattacgtcgacggccgcccgcgcttgtcgctggccggcgacagcctgcgcgaggtcaagctgtcgccgcaggcgcggcccgagcaacaggaccaggccatcgccagcatcccggccgaggcgatagaacccttcctcgcccgcccgctggtggtggatccggcgcaattcgccaccgcgccgcggctggtggccggccccgacgagcgcatcagcatcagccagggcgacaaggtctacgccagcggcgtcggcgaaaccggcacctggcaggcctaccggctgggcaaaccgctgctcgaccccgacagccaggcggtgctgggcgtcgaggccgcctacagcggcgacttggtggcggacaagctgggccgcgacgtgcagacgctgcgggtccggcgcgtggccggtgaaatcctgatcggcgaccatctggtgcgcgcgccgcgcgagcagttcgtcaactacgtgccgcattcgccgccgccaggcctgcgcggcaagatcatcagcacctaccagggcatagacggcgcggcgcaatactcaaccgtcgcggtcaacctgggcagccaggccggcatggagcccggcctggtgttcggcatctacaagaaaggcggcgacatcatgatcgacggtccggacggcaagccccgccgcacgcagctgccgaccgaacaggccggcaagctgttcgtctaccgcgtgttcgacaaggtttcctacgcgctagtgctggacagcaccagcgccatctatgtcggcgacggcatcgccgcgccggaggccgaatga

SEQ ID NO: 4455 - DNA, 159 bp, Chromobacterium substugae
atgcaaaatgttcaacagcgccattggtatttattcactccaagttgtcgtattgccgcgcccgcgccgataatacagccatccgacgcagctttcgttccgtccccgctccgggccccgggcctgccggcaccaagattgggattcattcatgcgtaa

SEQ ID NO: 4456 - DNA, 504 bp, Chromobacterium substugae
atggcgctgttgaacattttgcattacccggacgatagactgcacaccgtggccaagccggtggaggttttcgacgccgcgttgcagcagcagatcgacgatatgttcgagaccatgtacgaagccaagggcataggcttggcggccacccaggtcgactaccaccgccgcctggtggtgatggacatctcggaagagcgcgacgagcgccgggtgttcatcaacccggaaatcgtcgagaagaacggcgaaaccgtttacgaggaaggctgcctgtcggtgcccggcatctacgacaaggtgacccgcgccgagcacgtcaaggtgaaggcgctggatcgcgacggcaagccgttcgaactggaggccgacggcctgctggcgatctgcatccagcacgagatcgaccacctgaacggcgtggtgttcgtcgagcggctgtcgcagatgaagcagacccgcatcaagaccaagctgaaaaagcgcgaaaaacagaatatgtaa

SEQ ID NO: 4457 - DNA, 924 bp, Chromobacterium substugae
atgaaactgatttttgccggcacgccggaattcgccgccgccgcgctgcgcgagctgatcgccgccggccatgagatcgcgctggtgctgacccagccggaccggccggccggccgcggcatgaagctgaagcccagcccggtgaaggaagtggcgctggcccacggtctgcgcgtcgagcagccggaaaagctgcgcggcaacctggaggcgcagcagatgctgcgcgacatcggcgccgagctgatggtggtggctgcttacggcctgatcctgccgcgggatgtgctggagattccggcgcgcggctgcctgaacatccacgcctcgctgttgccgcgctggcgcggcgcggcgcctatccagcgcgcgatcctggccggcgacggcgaaaccggcatcaccatcatgcagatggacgtcggcctggataccggcgacatgctgagcatccatccgctggcgatcgccgccgacgaaaccgccgcctcgctgcacgacaagctggccgcttgcggcgcgcaagccatcgtcgagactctgggccgcctggacgcgatcgcgccgcaaaaacagccggaagacggcgtcacctacgcgcagaagctggccaaggccgaggcggaggtggactggacgctgccggccgaggacgtcgcccgcgccatccgcgcctacaatccggcgccgggcgccttcaccacgcttggcggcgagccgctgaagctgtggatggcggttgccgaggccggcgccgcggagccgggcgcggtggtgtcggccgacgccgacggcgtgctggtgggcgccggccagggcctggtgcggctgaccgtgctgcaggcggccggcggcaagcggctggcggcgcgcgatttcgtcgccggcaagagcctgccggcgggaacccggctgggcgtttga

SEQ ID NO: 4458 - DNA, 858 bp, Chromobacterium substugae
atgaacgacaactggctgaagaccacggtgctgatggccgcgatcatggccttgttcgcgttgataggcggcatgataggcggcaaggcggggatgctgctggcgctgctgttcggcggcggcatgaatctgttcgcctggtggaattccgaccgcatggtgctgtcgatgtacaacgcgcaggaagtggacgccaatagcgcgcccgagttctacggcatggtggcggagctggcgcagcgcgccggcctgccgatgccgcgcgtctacgtgatccacgaggagcagccgaacgccttcgccaccggccgcaatccggaaaacgccgcggtggccgccaccagcggcatcatgcgcatgctcgactaccgcgagctgcgcggcgtgatggcgcacgagctggcccacgtcaaacaccgcgacacgctgatatccaccatttccgccaccatggccggcgcgatctccgcgctggccaacttcgccatgttcttcggcggccgcgacgagaacggccagccggtcggcctgctgccgcgcctggcgatggcctttctggcgccggtggcggccagcctgatccagatggcgatctcgcgcgcgcgcgaattcgaagccgaccgcggcggcgcggagatttccggcgacccgctggcgctggcgtcggcgctgcagaagatcgagtactacgcgcagggcatcgcgatgccgacggccgaggcgcacccggaaacggcgcagatgatgatcatcaacccgctgtccggcggcgggggcctgggcgacttgttccgcacccacccgcacaccgccgaacgcatcgagcgcctgaacgcgctggcgcgcggcgcgtattga

SEQ ID NO: 4459 - DNA, 1251 bp, Chromobacterium substugae
atgcatcatatccagcagctggccgcggacattctgggccgcgtcgaggccggcaccactctgaccgaggcgctggccgccgcccaccgccaggcgcccaatctatccgccgccgagcgcggcgcgctgcaggatctcagctacggcagcctgcgccacctgggcgcgctgcggcaccatttgcgccagctggtgcccaagccgctgcccgagccgcagctggagcgggtgctggtcatcgccttctatcaattgcagcacacccgcgccgccagctacgcggtggtcaacgaggcggtgacgctggccggcacgctggccaagggcaatttcaagggcctggtcaacggcgtgctgcgcaatttcctgcgccggcgcgacgagctggtccagctggccgagcgcgatccggtggccaactgcaaccatcccagctggtggctgcagcgggtgcaggccgcttatccagagcaatggcggcaggtgatggccgccgccaactcccacccgccgctgacgctgcgggtcaaccgccgcgacggcgccgcggccgactacctggcgcggctgcgggccgccggcatggaggcggaagcgctgggcggcgaggcggtgcggctggccaagccggtggcggtgcgcgagctgcctggcttcgccgacggcgcagtgtcggtgcaggacgagggcgcgcagcgcgccgcgcactggctggacctgcagcccggccagcgcgtgctggacgcctgcgccgcgccgggcggcaagaccggccacatgctggagctggccgacatcgagctgacggcgctggacatcgacgccgcacggctggcgcgggtggcggacaatctggagcggctgggcctcaccgcccagctgcgcgaggccgacgccgcccggcccgacagctggtgggatggccagctgttcgaccgcatcctggccgacgtgccgtgctcggcctccggcgtggtgcgccgccatcccgacatcaaatggctgcgccgccccggcgatttcgccgcgctgggccgccagcaggcggcgatggcggacgcgttgtggcccttgctcgccagcggcggaaaaatgctatacgctacctgctcgatttttcccgaagaaaaccaacagcaattggaaagcttcctgcagcgccacccggatgcggcgtgcccgaggcaggagcaactgctgccctgtgagcgtcatgacggcttctattacgcgctgcttgagaaacattag

SEQ ID NO: 4460 - DNA, 573 bp, Chromobacterium substugae
ttgagaaacattagcctgctgctgggcctgctgtgctgtctgattccggcggcgcaggcggacgccatcgcgccgcgccgcgccgaagccgaagtgatggctgacggcacgctgtcggtcagcactcggtttctcaccaagctcacccccagcctcagcgaagcgctgcagcagggggtgtcgctggggtttcggctggagttccagctgatcaagccgcgcaccaccgcctattacctgagcctgcgcgagtggttcgacccgcacgcgcagctcagcttcaaactgtcctaccagtcgctgaccggccgctaccgcgtcagcatcggcagcctgtccaattactaccccagcctgcgcgaggcgctggcggctatcggcgcgatccagggctggcgggtgctcaatcccggcacgctggaccccagaaagccgggccaggtggccggccaggtgcggctgctgctcgacatcggagatttgcccaagcctttccagatgaatgcgctgggctccgacgactggtcgctggattccgactgggtcaagctcgacatcaaggacggcggctga

SEQ ID NO: 4461 - DNA, 2112 bp, Chromobacterium substugae
atgcgctacgccaccatcgcgatggcgacgctgggggcgatcctgctctacctgctggccgtggccaccggcaacgcctcaaagctcaacgactactactggtgggtgttcggcctcaacagcctgctgctgctggccctgctcagcgtggtgggccgccagctgtggcgcttgcgccagcgggtgaagaaccgggtgttcggcgccaagctgacccagcggctggcgctgatgttcgccggcgtggcgctggtgcccggcctgttggtgttcaccgtgtcggcgcagttcctcacccgcagcattgaaagctggttcgacgtccgcgtcgaggcggcgctggaccgtggcctggtgctgggccgcagcgcgctcaactacgtgctggacgatgtcggccgcaagagccggctggttctggacgaggtggagccgctgccggacagccagctgccggcgcggctggagcgcctgcgcgaacaactgggcctgcgcgaggtcgccatcttcaaccgcggcagcggccagatgctggccttcgcttccgcgtccgcccggccgcaggggccggcgccgacgcgcgaggccctgcgcgcggtcaagctgcgctcgccgcagcaaagcatagaaaacgacggcaacagcggcctgatgctgcgggtgctgctggcctaccggatgccggacgagcaggtgcgcgtgctgcagctgcagcaggccgcgcccgccgacatcagccgcgacgccgagcagatcgaaagcgcccgttccgaataccgccagctgctgctggcgcgccacggcctgcgcaccttctacatgctgacgctggcgctggtggtgctgctggcgctgaccgcggcgctggccttcgcgctgttcctgtcggaacggctgtcggcgcccttgtccgagctggcggccggcacccgggcggtggcgcagggcgacttctccaagcgccatccggtgtaccgccgcgacgaattgggcatgctgaccacgctgttcaaccgcatgacgcagcagctggacgaggcgcgccaggtggcggacaagagccgcggcgagctggagggcggcaagctgtacctggaaagcatcctggccaacctgtcggccggagtgatagccttcggccgcgactggcagatccgcgccgccaataccagcgcctcgcgcattctgggggtggagttcaatcatctggcggagcaccgcttcccggagtggggcgaggtgatgccggcggtggagccgctggtggcgaccgtgatggagcataccgacagcgatgtggaaagcgactggcagacccagctgaactatgaaaccagccagggcgagcgcacgctgctggtgcgcggcgcgcggctgccggagcactccagcgacggctacgtgctggtgttcgacgacatcaccgaactggcccgcgcgcagcgcgacgcggcctggggcgaggtggccaagcggctggcgcacgagatccgcaacccgctgacgccgatccagctgtcggccgaacggctggcgatgaagctggcggacaagctggaaggcaacgacgccgacatgctcaaacgcgccaccgacaccatcatcaagcaggtcggcgcgctgaaaagcatggtggacgcttttcgcgattacgcccgcgcgccgcggatcaaactggtcaaacttgatctcaatcaggtgatccgcgaagtgatgaccctttacgaatccaatcctgctgttaagattgcgctggacgaggttccgccgatgatcatgggcgacgccgccctgcttcggcaagtgttgcacaacctgatgcagaacgcccaggatgcagtccttgacgttggcatcccgatgattcaaattagcagccgacaagaagaaggaaacgtgctcgtttgcgtcgaggacaatggcgcgggcttcagccccgacatcctccggcgcgcgttcgagccttatgtgaccagtaaagccaagggaaccggtcttggactggccgtggtcaagaagattatggaagaacaccatggacaggtcattttggggaatgccgaacagcaaggtgcgcgcgtccttctctccctgccattgctggaggcctaa

SEQ ID NO: 4462 - DNA, 1269 bp, Chromobacterium substugae
atgcgtagcagcgatattttgattgtggacgacgagatcggtatccgagaactgctctccgagatcctgcaggacgaaggttataccgtggccctggcggaaaatgccgaagtagcccggcagttgcgcaaccagacgcgtcccgcgctggtgctgctcgacatctggatgccggattgcgatggcgtcacgctgctgaaggagtgggccaagtccggcctgctcaacatgccggtggtgatgatgtccggccacgccagcatagacaccgcggtggaggccacccgcatcggcgctttcgacttcctggagaagccgatcgcgctgcagaagctgctgaccaccgtgcagcgcgcgctgaaatacggcgacatgcaggccaacacctcgttgaacctggacaagctgggccgcagcgagcctatccaggagctgaaacgccagctggaacgcgtggccaaggtcaagtcgccggtgctgttgaccggcgagtccggctccggcttcgaactggtggcgcgctttttccaccagggcaacacgccgtgggtgacgccggccaagctggaacagctggccgacgcgccgctggaactgctgcagaaggccaacaacggcgtgctctacctgccggagatcggccagtacagccgccgcgtgcagcagggcttgctgttcctgctgtccaagctcgatcgcttcaacgtgcgcctgctgtgttcgtgcagccgtccgctgcaggagctgctggtggatccggagtgcgacaaccgcctgctgacggcgctgtccagcgtgatcgtgccgattccgccgctgcgcgagcactcggaagacatcaccttcatcgccgagcagatcctggtggagctggtggagtccaagcaggtgccggcgcgcaagctgaccaccgccgcgctcaacgcgatgcgccagtatgactggccgggcaacctggagcagctgcgcagcatcatcaagagcctggcgctgaccgcggagtccgacgaagtggacgccggcgaggtcaacaaggtgctggcgcagttccgccatgaaaagccggtggaggagtcgggcttcgacttcaacatcccgctgcgcgaattgcgcgaacagctggagcgccgctatttcgagtaccacatctcgctggaaaacggcaatatgagccgggtggcgcagaaagtgggactggaacgtacccacctgtaccgcaagctgaagcaactgggcataaagttcgcccgcaaggtggcggaggagtaa

SEQ ID NO: 4463 - DNA, 762 bp, Chromobacterium substugae
atggaatacccgcgcgaactggacgacgaggcgctgctgcgctacggccgccacatcctgctgcccgagattgatatcgaaggccagcgccggctactggcggcgcgcgcgctgatcgtcggcgccggtgggttgggatcgccagctgccttgtacctggccagcgccggcgtcggccgcatcaccatcgccgatgacgacgcggtggagctgtcgaatctgcagcgccagatcgcccatgacaccgccagcctgaagcagggcaaggccgagtcggcggcgcggcgcatgctggccttgaatccatcgatagaagtccggccgctggccgagcggctgtccggcgagcgcctgatcgaggaggtggcggcgcacgacctggtgctggattgctcggacaacttcgccacccgccacgcagtcaaccgcgcctgcgtggctgcgcgggtgccgctggtgtccggcgcggcggtgcgcttcgccggccagctggcggtattcgacagccgcgacgccgcctcgccgtgctaccactgcctgtttcctgaggagggcgaggcgagcgacggcccgtgcgcgaccttcggcgtgctgtcgccgctggtgggcgtgatcggcagcctgcaggcggcggaggcggtcaagctgctggccggcatcgcgcccagcctggggcggctgaccctgtacgacgcgctgcgcggcgatttccgccagatccgcgtgccgcgcgacctggcttgcgcggtgtgcggagagtag

SEQ ID NO: 4464 - DNA, 486 bp, Chromobacterium substugae
atgaagaagggtctgatcgcggcgctggcgctgctggccatcgccggcatcgcttattcgctgctgtttagccgcaatccggcgccggaagtgaagctgacctcgctcgccggcgtcagcaccagcactgcggcgctgaaaggcaaagtggtcctggtgaatttctgggccaccagctgcccgggctgcgtggaagaaatgccggaaatcaagaagctgcaccagcaatacgccggcaaggggctgaacgtggtggcggtggcgatgagctacgacccgcccaactacgtgcaaagcttcgtcgcccacaaccagctgcccttcttcgtggcgctggacccgcaaggcgaggtggccaaggccttcggcgacatccagctggcgccgaccaccttcctgatcgacaagcagggcaacatcatcaagcgctatgtcggggtgatgaacttccccgaagtgcgccagctgatcgagcagcagctgtag

SEQ ID NO: 4465 - DNA, 414 bp, Chromobacterium substugae
atggcgcatcacacccggatcaaggtccgcggctaccacctggacctgttcggccacgtcaacaacgcccgctatctggaatttctggaagaggcgcgctggaaccagttcgaagacgagggcaacctcgcgctgttcctggaatcgggcctggcgctggtggtggtcaacatcaacatcgactaccgccacccggccaccatgggcgaccagctgctggtggagaccggcgtgcagtcgataggcaagcgcagcgcggtcatccatcagcgcgtgctgctggaaggcagcgacaccgtggtggccgaggccgacgtcaccttcgtggtgttcgacgccaagcagaacaaggcggtggcgctggaaggcccgctgcaggaacaattgcaaaagatgatggcccaaccggcctga

SEQ ID NO: 4466 - DNA, 378 bp, Chromobacterium substugae
atgttcgaagtcaaccgcagcgtcgcgctgctccgcccgcaagcgcccttcctcgcctggctgaaaagcctgcccggcggcctggaccacaatctgagcctggagcagctgtccgccaactgcaacgcgctgctgatcccgcccgtcgacgactacgacgacgcgcgcgccttcgtgctggcgcaataccgccagctgttcgaagctgagctggccgattggtgcgaggacgacagcctttggccgcagaatctcagtcccaacctgttccaacaatggttcaagctggaaatccacggcgtgctgaccgacctggtggaccagccgctggaacgcgaagctttcgtgccgctgaacctggacggcgacgccgaataa

SEQ ID NO: 4467 - DNA, 858 bp, Chromobacterium substugae
atggccgaccacctgtaccgcacccgcctctccgcgcccaacagccgcctgctatggctgatggcggcgctgtcgctgctgctgcacctgttgctgctcagcctggccggcctgccgtccggcgcatcggcgcccgcgccggaaagcgcgccacagatcagcatccgcctgcagtccacgcccgcgccggcgccgccggacatcacgcgcgtggccgaaaacgaccatcagggcgccggcaataccgccgaggccgggcatctgctcagccgcagcgccatgccggcccgcgccgccgaagcccaagccgcgccgcctcctccgtcagcgccagccgccaagcccgccccgatagtcaagcctgaaaccgctccggccaagctgacggccgccccggccgccagcgccaggccgcccagcgccggctcgctgctggcacaagtcggagaactggcccgcagcggcggcgacaacgccgtcgccgacagcgacctggaaagtggccaggccggcgccgacatcggcgccgccgcccgcggctacccctgggcgcgctatcaagccgactggcggctgaaagtggagcgcatcggcaacctcaactacccggccgaagcccgccgcttggggctgcacggcgcggtgacgctggaagtgaccataggcgccgacggcagcctgcaggcgcagcgggtcacccgctcgtccggcagcccggtgctggacgaggccgcgcgccgcattgtcgagctggcctcgccatttccgccgtttcccgcggcgctttcgcgcggaccggcgctgcggatcagccagcgtttcgtcttcacccgcgataatctgttatccagccattga

SEQ ID NO: 4468 - DNA, 465 bp, Chromobacterium substugae
atggatatcggcatcaacgaacaagacaggcaggacatcgcccatggtttgtcccgcctgttggccgacagctacaccctgtacctgaaaacccataatttccactggaacgtcacaggaccgatgttcaacaccctgcacctgatgttcgaggcgcagtacaacgaaatggcgctggcggtggacctggtggccgagcgcatccgcgcgctgggccattacgcgccgggcagctacgccgactacgcgcgcctgacctccatcccggaagccaacggcgtgcccaaggccgacgacatgatccgccagctggtggaaggccacgaaacgctgtgccgcaccgcgcgcggcatcttcgccgtggtggagaaagccggcgacgagcccaccgccgacctgctgacccagcgcctgcaggtgcacgagaagaccgcctggatgctgcgcagcctgctggagaaataa

SEQ ID NO: 4469 - DNA, 297 bp, Chromobacterium substugae
atgaaaacctggttgcgatgcgatgagggccgggtgaggctgacgctgcacgtgcagcccggcgccagaaagaccgaagccgccggcgagcacggcgattgcctgaagatcagattggccgctccgccggtggatggcaaggccaatgccgcgctgctggcctggctggccgagcgcttcggggtggccaggcgggaggtggcgctgctgtccggcgacaagagccgccgcaaggtggtggaaatcggctgcgcgctggacgcggccgcggtgctgagcctgttcggcgttcattga

SEQ ID NO: 4470 - DNA, 444 bp, Chromobacterium substugae
atgcgcgcgctcctgttgctgttgctgatctacccgttcgccgaaatcgccgtgctggtggcgctggccgaccacatcggcggcctggcagtgttcctgctggtgctgctgtcgtccatgctgggcctgtggatgctgcgcaaccagaagctgggcgcgctgctgacgctgggcagcgtgatgcgccagggcgaaaaggtttcgctgtactcgctgctgtggccgctgcgctacgcgctggccggcctgctgttcctgctgcccggcctgctcagcgacgccttggcggtgctgttgctgttgccgataaaaggccccgacatccagattccgaccggcggcccgcggccgacccacggcccggacgccggcgccggcgacgtgatcgaaggcgaatacagccgcgtcgacgacaagccgcggccaggccgccaccttcaatga

SEQ ID NO: 4471 - DNA, 348 bp, Chromobacterium substugae
ttgaatacttttccatctagcgattgtttattggtcgtctgcaatgtacccgatccgcagttggccggacagattgcggcgacgctggtggcggaacggctggccgcctgcgtcaatatcttgccgccttgccagtcggtataccgctggcaggaggcggtggagcgcgccgaggaaaccccgcttttgatcaagaccgtccgcgccgcctatccgcggctggagcggcggctggccgagctgcatccgtaccaggtgccggagatcgtcgcgctgccgctggagcgcggcttgccctcctacctgacatgggtatcttccagcgtggtttcaagtggcgacgtttga

SEQ ID NO: 4472 - DNA, 153 bp, Chromobacterium substugae
atgaaatccttccgcagcgtcaagccattctgtgaaaaatattttcagcgcatgcctggcggcgggaacgaaatccgccgccaaacagtcgcaatacagccgaatcaaacgtcgccacttgaaaccacgctggaagatacccatgtcaggtag

SEQ ID NO: 4473 - DNA, 73 bp, Chromobacterium substugae
gggtcgttagctcagctggtagagcagcggacttttaatccgttggtcgcaggttcgaatcccgcacgaccca

SEQ ID NO: 4474 - DNA, 73 bp, Chromobacterium substugae
gggtcgttagctcagttggtagagcagcggactcttaatccgtaggtcgagtgttcgagccactcacgaccca

SEQ ID NO: 4475 - DNA, 73 bp, Chromobacterium substugae; identical to SEQ ID NO: 4474

SEQ ID NO: 4476 - DNA, 73 bp, Chromobacterium substugae; identical to SEQ ID NO: 4473

SEQ ID NO: 4477 - DNA, 73 bp, Chromobacterium substugae; identical to SEQ ID NO: 4474

SEQ ID NO: 4478 - DNA, 73 bp, Chromobacterium substugae; identical to SEQ ID NO: 4473

SEQ ID NO: 4479 - DNA, 73 bp, Chromobacterium substugae; identical to SEQ ID NO: 4474

SEQ ID NO: 4480 - DNA, 73 bp, Chromobacterium substugae; identical to SEQ ID NO: 4473

SEQ ID NO: 4481 - DNA, 633 bp, Chromobacterium substugae
atgaacaccataatcgacaccacccgcacccaggacctgaaagcccgcacccacgccacccacgaccagctggaccagcgcatcatggccaagcagccgttcgccagccgcgacaactacgcccgtttcctggacgcgcaataccgcttcctgcgcgacgccgacgcgctgtacgacaatccggagctggccgagctgttccccgacctggccgagcgccgccgctatcacagcatcgccgccgatctggccgatctgcagcggccgctgccgcagctccgggacgcgccgatcagcgaaaccctggacgtcgccaccgcgatgggctggctgtacgtggtggagggttccaagctcggcgccgccatcctgtacaagctggccggcaagcttgggctggacgagaattgcggcgcccgccacctggccggccatccggacggccgcgcccgccactggcgcgccttcaccgcggcgctggatggcctgaatctggacgaggcggcggaagcgcgcgtcaccgccggcgcggtggcggctttcgcctgcatgaacgcgcatctggaccaggtgtacgctacgaagcccgccatcccgccgtgcgctggctgtatctggcgggcggttgcctga

SEQ ID NO: 4482 - DNA, 1806 bp, Chromobacterium substugae
atgccgacatattcgctgctgcaactcggactgttcctgctggccctgctggccttgatcaaacccgccggccattacatgttcctggccatggccggcaagccgccattgctggccggccccgggcgctggctggagactcggctctaccggctggcggcggtggaaccggagcgagagatgggctggaaaaactacgcgatcaacctgctgctgttccaactcgtcggcgtcctgttcctctacctgctgcaacgctgccaagcctggctgcccctcaatccccaatccttccgcgccgtcgctcccgattccgccttcaacaccgccgtcagtttcgtcagcaacaccagctggcaaggctatgccggcgaaaccaccttgagccacctcagccagatgctgggcatcaacgcgcaaagcttcctctccgccgccagcggcatggcggcgctgctggcgctgctgcgcggcctgacgcgccagtcgagcgcgacgctgggcaatgtctgggtggatctcacccgctgcacgctgtacatcctgctgccgctatccttcatcctggcgctgattttcgtccagcaaggcgtgccgcagacgctggcggcaggccgaaccgtcgccacgctggaagccagccactaccgggtgccgctgcaggatgcgcgcggcaacgcgctgaaagacgcggatggccggccgctgctgcagcagttgagcgcgcgccagcaatacctggcgctggggccggtggcctcgcaggagccgatcaagatcatgagcggcgacggcggcggctttttcaacgccaactccgcccatccgtttgaaaatcccactccactcaccaacttcctgcaactgctgaccctgctgatcctgcccgccggcctgtgccatgccttcggcctgatggccggcgacacccgccagggctggaccatcgtcgcggcgatgagcctgatgatggcgctgggcgcggcggcctgcatgcgcagcgaaatagccggcaatccgctactgagtccggccctggtggaccagagccatggcgcgcggcaaagcggcggcaatatggaagggaaggagacgcgcttcggcgcggccggttcggcgctgtacgccgccgtcaccaccagttccggcgacggcgcggtcaacgccatgcacgactccttcacgccgataggcggcatggtgccgatggtgatgatgcagaccggggaagtggtgttcggcggccccggcgccggcctctacagcatcgtgatccacgccatcctggtggtgttcgtcgtcgggctgatgatagggcgcgcgccggaatacctgggcaagaagatagaggcgttcgaaaccaagatgatggcggcggtgttgctgctggcgccggcgctgatattgctgcagtcggccatcagcgtcagcgtgccggcggggctggccggcctcggcaaccccggcgcccacggcctgagcgaggtgctgtacgcctacacatcggccgccaacaacaacggcagcgccttcgccgggctatcggccaacacgccgttctacaacctcatgctgggcatcgcgatgtggttcggccgctacggcgtgatcgtgccggtgctggcgctggcgggttcgctggccgccaagccgaggcgcgcgcccggcgccggcaccttgcccagccacggcccgctgttcgcgctgctgctgatcgccgccatcctgctggcgacggcgctgacctatctgccggcgctggcgctggggccggtggccgaacacatcacgctggccgtcccttag

SEQ ID NO: 4483 - DNA, 330 bp, Chromobacterium substugae
atgagaatagataaggcgggcgcgctgttggcggcggcgctggcatccggcgccgcgtgggcgcagacggcggacgagcagctgctggcgtcgcagatggcttttcagcaggcgcaaagccagcagacgcaggcggacgccaggctgaaggcggcgcaggacgccaagacgctggccgagcagcggctggccggcgcccaggcggcgctggacaaggcgaatgcggatctggccactgcagccgcggcgcagaacagcgcgcagcaggtgctgcaaggcgcgacgcagggcctgaaccaggcctggcagcgcaaggacagcgggcagtag

SEQ ID NO: 4484 - DNA, 597 bp, Chromobacterium substugae
atgacgcgtctggccggccttttcaccctgttgtcgtgcgcggcggcctttgccggcggcgcgctgtacaagtgggtggacgacgccggccgggtgcattacagcgattctccgccgctgcaaagccaaagcggcggcgtggccgaactgaaccagcagggcagcgtcaggaaaccggcagagagcgacgcgcagcgcaaggcgcgcgaagcgtccgccgccgccgccctgctgctgcagcaaagacagcaggacgccgcccgccacgaccaggcgctgattcagagctacccctcgctggccgacctgaaggccgaccgggaaaggcagctgtcggtgctgcaatccgcctatcacgcgctggagttgcgcgcccagggcctgctgctccagcagcgcgacctgcaaaaagacctggacctgagcgccaagctgcgccagccgccgcatccttccaccacgcacaatctgcaggccttgcgccacgaacagctggatctcgacgcgctgatccgcgccaaacgcggcgaattggacgccttccgccgcaagatgcagcaggacatccagcgctaccagcagctgaacgcccgctga

SEQ ID NO: 4485 - DNA, 645 bp, Chromobacterium substugae
atgagcgatttccgtcaggattttattcgttttgcgctcgacaagcaggttttgaagtttggcgagttcatcaccaaggcgggccgcaagtcgccctacttcttcaacgccggcctgttcaacgacggcgcctccacgctgagcctgtcgcgcttctacgccaaatccatcacggaaagcggcatcgcgttcgacatgctgttcggaccggcctataaaggcatcatcctggccgccgccgccggcatggcgctggccgaacagggccgcaacgtgcctttcgcctacaaccgcaaggaagccaaggaccacggcgaaggcggcaccctggtcggcgcgccgctcaagggcaaggtgctgatcatagacgatgtgatctccgccggcacctcggtgcgcgaatcggtggaactgatccgcgccgccggcgccgaaccggccggcgtagccatcgcgctggaccggatggagcgcggcctgggcgaattgtcggcggtgcaggaagtggcgcagcagcatggcctgccggtggtggccatcgccaccctgaaagacctgctgggtttcctcgaacacagcccggaactggccgcccacctcgatgcggtgcgcgcctaccgcgctcaatacggagtcaacgactga

SEQ ID NO: 4486 - DNA, 777 bp, Chromobacterium substugae
ttgcttcgaatcgtttccgccaacctcaatggcatccgctcggcggacaagaagggctttttcgactggctggccaccatcgacgccgatttcgtctgcgtgcaggaattgaaggcgcaggcggccgacctgtccgagcgcatgcgcgcgccggacggcctgaccggctatttccattacgccgagaagaaaggctacagcggcgtcggcgtgtatgcccgccgccagccggacgcggtggtggaggggcttggcgtggactggatcgacgccgaaggccgtttcctgcagctggatttcggcaatctgtcggtggtgtcgctgtatctgccgtccggttccagcagcgacgagcgccagcaggtgaagttcgacttcctcgacgtgttcatgccgcacctggaacagctgcgcgccgccggccgcgacatcgtgatctgcggcgactggaacatcgcccacaacgagatcgacctgaaaaactggaagggcaacctgaagaattccggcttcctgccggaagagcgcgcctggatgaccgacctgctgggccgcgtcggctggcgcgacgcctggcgcaatctgtacccggacgcgcctggctacacctggtggagcaaccgcggccaggcctacgccaaagatgtgggctggcgcatcgattaccatatcgtcacgccgtcgctgatggagcaggccgagtccgccagcatctacaaggacgaaaagttttccgaccacgcgcccttgatcgtcgattaccgccgggagctgtga

SEQ ID NO: 4487 - DNA, 597 bp, Chromobacterium substugae
atgtgggacgacgatgatgtcacgctgctgacggcgccgggctggggcaattccggcgacgcgcactggcagagccgctgggagctgacctatccgctggcgcgccgcgcggagcagcgcgactggctgtatccgtcccgcgacgagtgggtagccggcctggcggcggcggtggccgccgcgcccggcaagctggtgatcgcggcccacagcctgggttgccatgccgcggccgcctggctgctgcaagcgtcgctgctggagcagcgccggctgaagggcatgttgctggtggcgccgccggcgctgccgatcggcgcggacatcgcgcgcgccagcggcgaactgccggcgggcgcgcccttgccggatttcgccggtttcgcggctgccgacgagcggcggctgccggttcccgtcatcgtcgccgccagccaggacgacccgttctgcgatttcgccgtcgccaagcgaatggcggcggattggggcgcggagctgttcgacgccggccgctgcggccatatgggcagccatgccggcctgggcagctggccggcgggccagcggctgctgcagcggttgatcctgggctga

SEQ ID NO: 4488 - DNA, 840 bp, Chromobacterium substugae
atgtacaccacgctgatttcccccgcccagttggccggcctgccggccgaacggctggtggtgctggattgccgcttccagctggaccagcccgactacggccacgccgcctactccgccgcgcacattcccggcgcccattacctgcatctggactaccacctgtccggcagcaaaaacggccacaacggccgccatcccttgccggatggccagcggctggcggtggatctgggcgcgataggcgtggacgaagacacccaggtggtggcctacgacgacggcgccggccaatacgcggcgcgcgcctggtggctgctgcgctggctgggacatgagaaagtggcggtattggatggcggcttcgccgcctggcaggccggcggcggcgcggtggacgccgaaacaccgcagcgccgctcctgccgcttcgccatccgcccgccgctgcagcaggcggtggacgccggcgcggtgcaggccaatctggcaagccgggacttcaccgtggtggacgcccgcagcgccgagcgcttccgcggcgtgggcgagacgatagatccggtcgccggccacattccgggcgcggccaaccgcttcttcatgaacaatctggacgccggccagcgctacaagccggctgcacagctgcgcgcggaatgggaagcgctgctgggcgccggtttcgatccggccgccatcgtccaccagtgcggctcaggcgtcaccgcctgccagaacctgctggctatggagatcgccggctttgccggcagccggctctacccgggctcgtggagcgaatggtgcagcgacccggctcggccggtggaacgctga

SEQ ID NO: 4489 - DNA, 1650 bp, Chromobacterium substugae
atgttcagtgcatttaccataggccagcgcatcctgctgctggcctgcagcctgttgctggcgctgtgcctggtgggcggcggcggctggtggtcgctcaacggcataggccgcgaactgacggtgctgttcggcgaaaagatcgccttccgccaccatctggacagcatgcagcgcagcatgctgcgcgtgcgccaggacgagaagaacattttcatcagcatcggcaatccggcgaataccgaccaaagcatccagaccaacaagcagctgctggacaaggaaatcgcactgttcaaggagctggccggccaggccaagacgatgccgatggcggccgagcaccaggcggagttcgatagcatggtgcagggcatagacggctaccagcagggcatggaaagcctgtaccagcgcatcgccaagggcgagatcaccgcggccaacgccggcgacgccgccatcatcccgttcaaacccaagctgtacgccgcgcgcgacgcgctgaacaagctgaccgacctggccgaccagacctccaaggagtccgaggagcagatggcggcgacgatggcgcgcacgatacaggcgatgctggcgctggtggtcttcgcgctgctgctgggcggcggcctggcctggctgatctcgcgctccatcacccggccgctggcagcgatgcaggagcggatgcgccatgcggcggccaataacgacctgacggtggaaatagaccagaccggccgcgacgaagtcagcgagaccggccgcgcgctggcgcaattgctgggcaatctgcgcgctttcatcgagcgcacgcgcgaggactcggcccaggtcaccagcaccgcccgctcgctgtctcaggtgtcgcagcgtatcgccgacgcttcgcgggtgcagaccgacgcctcgtcgtcgacggcggcttcggtcgaggagatgacggtcagcatcaacctggtggccgaccactcgaatgaaatggccggcgaggcgcaaagcagcatgcgcgaggcggtgagcggcagccaggtggcgggggaagcggcgcgcgagatgcaggagatcgcgcgggtgataggcgaatcggaggcggtgatcgatacgctgaaccagcgctcggacgaaatcggcaatatcgtcgaagtgatccacgacatcgccgagcagaccaatctgctggccttgaacgcggcgattgaggcggcgcgcgccggcgagatgggccgcggcttcgcggtggtggccgacgaggtccgcaagctggccgagcgcaccgcccaggccaccggcgagatctcgtccaagatccaggcggtgcagggcgacaccaccaccgcggtggccagcatgcgcgaggccgcccagcgggtgggcagcggcgtggcgctcagcgcccaggtcagcgagcggctggcgcagatacgcgagctgtcgtcgcggctgctggagaaaaccagcgagatcgccgccgcgatgcgcgagcagagcaccgccagcaacgacgcggccaagagcgtggagcgcatcgccagcatgggcgcggaaaacggccagtcggtggaggcgtcgtccgacatggcgcagcagctgtcccagctggcgcacggcctggatcaggctatcagccgcttccgcaccgcctga

SEQ ID NO: 4490 - DNA, 399 bp, Chromobacterium substugae
atgcattgcgaactatgtgaacaagccaagggcgaactgctgcaccaggacgacgcgctgcgcgtgatgctggtggacgagcccggctatccgggcttttgccgcgtaatctggcgcggccacgtcgccgaaatgaccgatctgtccccgaccgagcggaaccacctgatggactgggtctaccgggtggaggcggcgctgcgcgcggtgatgcggccggccaagatcaacttggccagcctgggcaatatggtgccgcacctgcactggcacgtgattccccgcttcgaggacgacgcccacttccccagcccgatctgggccgcgccgcgccgcgacggcgccgaccacggccaggcgaacctggccggcctgctgcgcgccgcgctggcgcgctaa

SEQ ID NO: 4491 - DNA, 1317 bp, Chromobacterium substugae
gtgagtttcgccaacagtcttttcgtcatcgcccttctgatcgcggccagcgcctttttctcggtatcggaaatctccctggccgccgcgcgcaagatcaagctcaggcagctggcggacgagggcgtggccagcgccgagcgggtgctggagctgcagcagcagcccggccatttcttcaccgtggtgcagatcggcctcaacgcggtggcgattctggccggtatcctgggcgaagccgccttcaccccctacttcgccacgctgctgcacatggtgacgccggcgcagtgggtcgagcacctcagtttcatcctgtccttcgtcaccgtcacctcgctgttcgtgctgttcgccgacctgatgccgaagcggctgggcatggtggcgccggagcgcatcgcgctgttggtggtcgggccgatgctgttctgcgtgcggctgtgcagcccgctggtgtggctgttcaacggcctggccaatgtgttcttccgcctgttcggcgtgcccaccggccggccggacgacctcacctccgccgacatcgtggcgatgatggacgccggcgccgaggccggcgtgctgcagcagcgcgaacatcatctgatcgaaaacgtgttcgagctggagagccgcaccgtgccttcgtcgatgaccgcgcgcgaaagcatcatctacttcacgctgcacgaggacgaagccagcatcaagcagaagatcgccgaacatccgcataccaaatttctggtgtgcgacggcgtgatcgactcggtgatcggctatgtcgactccaaggacatcctgatgcggctgatcaaccagcaaagcctgtcgatgaagcgcgagctgacgatacgcaatgtgctgatcattcccgactcgctgacgctgtccgaactgctggagcgcttcaaggcttcgcgcgaggatttcgcggtggtgatgaacgagtacgcgctggtggtgggggtgatcaccctcaacgacgtgatgagcacggtgatgggcgacctggtcagccagttccaggaggagcagatcgtccagcgcgacgagcgctcctggctggtggacggcgcgacgccggtggaggacgtgctgcgcgcgctggacatcgaagccttccccgacgacgagaactacgagaccatcgccggcttcatgatgtacatgctgcgcaagattcccaagcgcaccgacagcgtcgagttcgagggctacaagttcgaggtggtggacatcgacaactaccgcatcgaccagttgctggtgacgctgattccgccggcgccggcggaaatcgaatcggcgcgctga

SEQ ID NO: 4492 - DNA, 243 bp, Chromobacterium substugae
atgaaaaaactgaccgccctcctgctggccgccaccctgggcctggcctccgtcgccacctacgccgccgacgcgtccgctccggctgccaaggccgccgcgccggcgcatcacaagcatcaccataagaaacaccacgccaagaaggcaagctcggctccggccgcgcaaaaggcccaggccgccaagaagcacggccatcatcaccatcatcacaaaaaacaccaccgccacgtgaagtaa

SEQ ID NO: 4493 - DNA, 156 bp, Chromobacterium substugae
atggataacggcagagggctcgctcttgccactgcaatcaccgacatgagcgcctcatgtggtattacattggtatttagaatcgaaatctctgctgaaaaatacaagaggaaatttaaacatctgtcatttagtacaggttttgacaatccataa

SEQ ID NO: 4494 - DNA, 1617 bp, Chromobacterium substugae
atgctgcacttccccctgtcgcgcgtactgctggccgtcggcacggcccttgcgttgacccaggcggcgtacgccgcgccaagctgctcgccgtgggccagcggccaggtttacaacgccggcgactacgccacctacggcggcaagacctggcgcgccagctggtggacccagggcgaaacgcccggcagcagccagtggggcgcctggcaggagcgtccggccagcgagtgcacgcccggcgatccgagccagcccggccagcccggcaacggcgtgccgccggaaccgaagccgacggtgggccgcaatgtcggctcctacttcacccagtggggcatctacgaccgcaattacaaggtcagcaacctggtgcaggccggcggcgacaagcagctgaccttcctcaactacgcgttcggcaacgtctacgccaacggccagtgcggcatggtcaccaaggccgagagcggcaacggcgacggcggcgacgcctgggccgactaccagcgttccttcgccgccaacgagtcggtggacggcaaggccgacaactggaacgatccgctgcgcggcaacttcaaccagctgcgcaagctgaagctggccaatccctcgctgaaagtgctgatctcgctgggcggttggacctggtcgaagaacttcggcaccttcgccgccaccgacgctggccgcaaggcgatggtcagttcgtgcatcgacctctacatcaagggcaacctgccggtgggcgaaagcgccggcggacagggggcggcgctgggcgtgttcgacggcttcgacatcgactgggaatacccgggcggcggcggcctgccgaccaatagcgtcgatcccaacgacaagcagaactacacgctgctgatggccgaattccgcaaccagctgaacgcgctgtccaccgccaacaagcgccgctactacctgaccgccgcaataggctccggcgtcgacaagatccgcaacaccgagccggccgcctacagcgcctacctcgactggatcaacgtgatgacctacgacttccacggcggctgggaagccaagggcccgaccaacttccagtccaacctctaccgcgatccggcggcgccggtgactggcgaccaggtctactacaccgtcgacgacgcggtgaagaccctggtgaacgccggcgtgccgcgcgccaagatcaacgtcggcctgccgttctacggccgcggctggacaggcgtggcggcgggggccaagggcgacggcctgtaccaggtggccaccggcccggccaagggcacttacgagcagggcatcgaggactaccgcgtgctggtgaaccgcagcaccaaacagttcaacagcccgatagccaagcagttgtggacttacgacggcaacgagttctggagctacgacgatccggccaccatccgcggcaagctggactacgtgcgctcgcagcagttgggcggggtgttcagctggtcgctggatggcgacgacgcgcaggcgacgttgctgaagaccagcgcggaagtgcggctggacgccgccaccgccgccaagcgcaaggcggcggccgcagcggccaaggccaaagccgccaagaagcagtaa

SEQ ID NO: 4495 - DNA, 525 bp, Chromobacterium substugae
atgtccgataccgccctgctgatcatcgacgttcaagtcggcgtcgtggaaggcgaactgcgcgccgcccgcctcgacagcgtgctcgacaagctcaacctggccattgccaaggcccgccagcgcggcatgccggtgatcttcgtccagcacgaggaagacgacctgccgcgcggctccgacgcctggcagctgcatcccgccctcgcccgccaggacggcgatcccatcgtctacaagcgctacggcgacagcttctgcgagaccgatctggtgcagctgctgtcggcgcacggtgccagcaagctgtggataggcggcgccgccaccgatttctgcgtcgacagcacgctgcgcaacgcggtgtcgcgcggctatcaggccaccgtgatcgccgacggccacaccaccgtcagcgccttcgcgctgagcggcgagcaagtggtcgaccacttcaccgccgcctggcgcgccaccagcgccacgccgcagccgctgctggtcaagcccgccgccgaactgtaa

SEQ ID NO: 4496 - DNA, 1017 bp, Chromobacterium substugae
atgacgctgggttataatgcggacttttaccgcatgccagccgccatgaccgccatatccctgctggtagccgacgactaccaactggccagccgccagatcgccgccttgcatcagaacccgagctacccgtgccgcgcgctggccgatctcgcgcgcgacccgcaagccgacgcgctgctggcgcaagctcaggggctgctgttgatacgcgagcgcacggtggtggacgcggcgttgctggcgcgcatgcccaagctcaagctggtgagccagaccggcaagctggcgcgcaatatcgatatcgccgcctgcagcgcggccggcgtcgcggtggtggaaggcagcggctcgccctacgcgccggccgagctggcctggctgctgatcatggcggcgcggcgccggctggcggaaaacctggacagcctgcgcgccggccattggcagggaccgataggccgggccgtgcgcggccaaacgctggggattctgggtttcggcaagatcggcaagttggtggccggctatggccaagctttcggcatggacgtgttggtatggggcagcgaacgcgcgcgcgcagaagcgctggaactgggctaccgcgccgccgcctgccgcgcagattttttcgccgccgccgatgtcgtcagcctgcatcagcggctggttcccgccaccgcgggcggtgtgacgcaggccgatctggccgcgatgaagccggacgcgctgctggtcaacaccagccgcgccgaactgatcgcgcccggcgcgctggaagcggcgctggacgccggccggcccggcttcgccgcgctggacgtgttcgagcaagaaccgatctacgacccaggccaccccctgctgctgcgccccaacgtgctgtgctcgccgcacctgggctacgccgagcaggccagctaccgccagtacctggagatcgcccatcgcaacgctgtccgcttcttcgagggcgacgcctcccatgtgctgaacccggaagccttggcctga

SEQ ID NO: 4497 - DNA, 1488 bp, Chromobacterium substugae
gtgtccggcccactcgcccgctaccgcctagtcatcatcgtcaccttgctgctgctgggcggcatcgtcgtcaacgcctgcctgtactaccggcagagcagcgacgagatccgccgcagcatcgtcgagcaaggcctgccgctgaccggagataccattttttcccagatagaccagggcatcctgcggccgctgtcggtggccgcgctgatggcgcacgatacctttctggccgactggatgcaaaacggcgagatcagccccgaacgcgccagccgctatctgagcgcgatcaacggcggcaacggcatcagcggcagcttcctggtttccgagcgcagccgacgctactactacgccggcggcatccacaagatcgtctccgccgccaacccccacgacgcctggtatttccgctgccgcggcatgcggcaagaccatgagatcaatctggaccgcgacatgaccaatggcggccaggccaccatgttcatcaaccaccggatgctggacgaccagggccgcctgctgggcgtgatcggcgtcggcctgccgctggatcagttggccaggcaactggccgcgcacgagcagcgcttccgccgccgcatctacttcatcgaccgcgccggccgggtcatgctgagcagctcgcgcgcctttccaagcggcaaacggctgcaggagctgccgggcctgtccgcgctgagcccggcgatattgtccggccgggaagcgccgcagcggctggaatacagcctggacggcaaccgctacctgctgaccagccgcttcctgccggaactgggctggcatttgctggtggagcagaacgcaagccgcgcgctgcagccgctgcgcgcctcattgctggccaatctggcgatcaacagcgcgatcctgctgctggtggtgatggcggtgctggccaccttgcagcgccatcagcgcaagctgcgccaactggccaccaccgaccagctgaccggctgcctgaaccgcctcgcctttctcgacctgctgcccggctggctgcgccattgccagcgcatcggcgcgatcccgcaactgctgatgctggacatcgaccacttcaaacaggcgaacgaccgctacggccaccaggtgggcgaccggctgctgcaggaaaccgccgagctgctgcgttcgcagctgcgcggcaacgatttgctgatacgctggggcggcgaagaattcatggtgctggtggccagccacggcctggacgactcgctggccgaacggttgcgcagcatcgtcgcgcgccatctcatgcagggcgcgccggacaagctgaccatcaccatcagcgtgggcatcggcctgtggcagccgccggagaccttggaagccgccatcgaccgcgtcgaccaggcgctgtacgccgccaagcaggccggccgcaaccgcgtctgccaggccattcccgccccggcgaccgggcaggcagcctccgcagaaagatga

SEQ ID NO: 4498 - DNA, 807 bp, Chromobacterium substugae
atgctcactatcggacaactggcccgctgccacggcctcagcaccaagaccctgcgccactacgacggcatcggcctgttctgccccgccttcaccggcgcggacaacggctaccgctactacctgccggcgcaggtggaggagctgggcctgatcgtccggctgcgccggctgggtttgtcgctggaagacatccgccggctgtgccaggaaggcggcctgcgggatggcggcgcgctgcgcgagcaattgcgcgcccatgccgcccgcctgcagcagcagatcgaggaaaagcgcgggcagatcgcgcagatcgcgcgctatctcaaccaagccgactggagccttcccgccatgcagacccccgacatcgtcaccctccccgccttccgcgtcatcggcctcgcctggagcccgcaggacgaatacggcatccccgaactctggggccgcttcctgctgcgcgagcatgaaatcgccgacgcccgccccggcagcagctacggcatctgccagccgctggccgacggccaatggcgctacctggccgcattgcaaaccgcgccggatgcgcccgtccctgacggcatggacgccgtggacgtgccggcgcagcgctacgcccgcttccagcaccgcggcccggtggccggcctgcccgacaccttccgcgccatccacggcagctggctgccggcggccggcctggaggcgatggacggcatcgagttcgaatacatggatcagcgcttcctcgcgcccgaccacccggactcgctgaccgagctgtacatccccattcgctga

SEQ ID NO: 4499 - DNA, 3855 bp, Chromobacterium substugae
atgacagccatcaccagcgaacagcgcctgcgggagatcccgtacaactacacctcgtattccgaccgtgaaatcgtgatccgcctgctgggcgagccgatgtggaaattgctggatgcattgcgcggcgagcgcaagaccggccgctcggcgcggatgctgttcgaggtgctgggcgacatctgggtggtggaccgcaacccctacctggtggacgacctgctggacaaccccaagcggctgtccgcgctggtggaggcgatgcgccaccgcctgaacgaagtggaaaagcgccgcgacggcaacggccgcgtcggcgagatgatcgcttcggcccgccaggcggtggaacagttcgcccgccagttcgatgaaacccgcgagctgcgcgcccgggtgttgaagaagctgacccggctgacccgccgcgacaacatcctgttcgacggcctgtcgcgcgtcgcccacgtcaccgacgccactgactggcgcgtcgaatacccgttcgtggtgctgagcccggacagcgaggcggaaatggcgccgctggtgcgcgcctgcatcgagctgggcctcaccatcatcccgcgcggcggcggcaccggctacaccggcggcgcggtgccgctggaccggatgagcgcggtgatcaacaccgaaaagctggaccgccacctgggcatagagcatatcgagctgcccggcttgtccggcccgcaggcgacgatacaatgcggcgccggcgtggtgaccgcccgcgtctccgaagccgccgccgccgccggcctggtgttcgcggtggacccgacctcggccgaagcctcctgtatcggcggcaacatcgcgatgaacgccggcggcaagaaggcggtgctgtggggcaccacgctggacaacctggccagttggaaaatggtggatccggacggccactggctgctggtggagcgcataggccacaactacggcaagatccacgacgtggccgaggcgcgcttccgcgtgtcgcggctggccgacgacggcaggaccgcggtgtccagccgcgagctggcgattcccggccaggccttccgcaaagtgggcctgggcaaggacgtcaccgacaaattcctggccggcctgcccggcgtgcagaaggaaggctgcgacggcatcatcaccagcgcccgcttcgtgctgcacaagatgccgcaacatacccgcaccgtctgcctggaattcttcggcaccgtcgccgaggccacgccggccatcgtcgagatcaccgacttgttccagccgggcggcgcctgcctggccgccggcgtccggctggccggcctggagcatctggactggcgctacgtgcgcgcggtcggctacgccaccaaggccaagagccgcggccggccgaagatggtgctgatcgccgacatcgtctccgacgacgagaacgccgccgccgaggccgccagccaggtggtgcgcatcgccaacgcccgccacggcgaaggcttcatcgcggtgacgccggaagcgcgcaagaccttctggctggaccgcagccgcaccgccgccatcgcccgccacaccaacgccttcaaggtgaacgaggacgtggtgatcccgctgccgcgcctcggcgactacagcgacggcatcgagcgcatcaacatcgaactgtccatcgccaacaagattgagctactggacacgctgaccgagtacttccacggccggctgccggtggacaagatggacaccaacctgccgtcggaagagctgatcggcgacaggcgcgccgccgcgctgtcgctattggcgatcagccgcgaccgctggcagtggctgctcgaccacatggacgcgccctatcccgactacgccgcccgttggccggacgccccgcgcgaagactccgccgcccagcccgacaccgtattccacgcgctgcgcgacttcgtcctgcgcgtcagctggaagcgcgaagtgctggccgagctggagcagctgttctccggcaccgccgccgccggcatccgcgccgctatcggcgaattgcagcagcacgtgctgcgcggccgggtgttcgtcgcgctgcacatgcacgccggcgacggcaatgtccataccaacatcccggtcaactccgacaactacgagatgctgcagaccgcccaccgcgcggtggtgcgcatcatggcgctggcgcgggagctgggcggggtgatttccggcgagcacggcatcggcatcaccaagctggaattcctcaccgaagcggaaatccagcctttccgcgactacaaggcgcaagtggaccccaacggccacttcaaccgcggcaagctgctgccgggcgcggacctggcgcttgcctacacgccgtcgttttccttgctcggcgccgaatcgctgatcctggaacagtcggacatcggcgcgatcaacgactcgatcaaggactgcctgcgctgcggcaagtgcaagccggtgtgctccacccacgtgccgcgcgccaacctgctgtattcgccgcgcaacaagatcctcggcgtcggcctgctgaccgaagccttcctgtacgaggagcagacccgccgcggcgtcagcctcaagcacttcgaggagctgtccgacgtggccgaccactgcacggtctgccaccgctgcgtcaaaccctgtccggtgaagatagacttcggcgacgtgtcggtggcgatgcgcaatttcctgcgcaagtccggcaacaaaaccttcaatcccggcaccgctctgggcatggccttcctcaccgccaaggacccggccaccatcaagaccatccgcgccggcctggtcggcgtcggctacaaggcgcagcggctgggcaacgccgtcggcaagcggctgggcctgatcggcgggcagaaaaagcagccgccgtccaccgtcggcccggcgccggtgaagcagcaggtgatccacttcatcaaccggccgatgccgggcggcctgccgaagaagaccgcgcgcgcgctgctggacgtcgaggacgccaacatcgtgccggtgatccgcaacccgcgcttggccgaagacgccgaagcggtgttctacttccccggctgcggctcggagcggctgttcagccaggtcggcctcgccacccaggcgatgctgtggcacgtcggcgtgcagacggtgctgccgcccggctacctgtgctgcggctatccgcagaccagcgccggctaccaggacaagggcgacgccatcaccaccgagaaccgggtgctgttccaccgcgtcgccaacacgctgaactacctggacatcaagaccgtggtggtcagctgcggcacctgcttcgaccagctggcgcactaccgcttcgaggacatcttccccggctgccgcgtgatcgacatccacgaattcctgatggagaaaggcgtgaagctggacggcatcagcggccagcaatacctgtaccacgacccctgccacacgccgatgaagacccaccagccgctgaaagtggtcaacgagctgatgggcggcggcgtgccgctgtccgaccgctgctgcggcgaggccggcaccttcgccgccagccggcccgacatcgccacccaggtgcgcgcgcgcaaggaggaggagatcaacaagaacctgcaggcgctgaccggcggccagccgccggccctgccggtgaagatcctcacctcctgcccgtcctgtctgcagggcctgtcgcgctacaacgacgacaccggcaccgaggccgactacatcgtggtggaaatcgccaagcacctgctggggcagaactggctgccggaatacgtggctcgggcgcgcgacggcggcatcgagcgagtgctgctgtaa

SEQ ID NO: 4500 - DNA, 978 bp, Chromobacterium substugae
atgccgacggcccggcccatcctggccgtgaccgccggcgagcccgccggcatcggtcccgacctcgcgctgcaactgcggcgcttgctgcccgagcggcgctgcgtcgtcatcgccgaccgcggcctgctggcccagcgcgccggcctgctcggcctggatgtcagcctggccgactaccgcgccggccagatcggccccgccggcgcgctggaagtgctgcacgtgccgctggcggcgccggccgcgccgggccggctggacccggccaacggccgctacgtgctggatacgctggacgcggcgatagacggctgcctggccggcgaattcgccgcgatggtgaccgcgccggtgcacaagggcgtgatcaacgaggccggcgtgccgttttccggccataccgaatacctggccgagcgcaccggcacgaaaaaagtggtgatgatgctggccggcggcggcatgcgcgtcgcgctggccaccacccacctgccgctgcgcgcggtggccgacgccatcaccgcgccgttgctgttcgaagtgatccgcatcctgcacgccgacctgaagcgcaaattcggcatcgccgcgccgcgcatcctggtggccggcctcaatccgcacgccggcgagagcggccacatgggccgcgaggagatcgacgtcatcgagccggcgctgcacgcgctgcgcgccgaaggcatcgagctgatcggccccttgccagccgacaccctgttcaatcccgacaagctggcccaggccgacgcggtattggcgatgtaccacgaccagggcctgccggttttgaagcacgccagcttcggcgccggcatcaacatcacgctgggcctgcccatcatccgcacctcggtcgaccacggcaccgcgctggacctggccggcagcggcctcgccaatcccggcagcctggtggaggcggtgcaactggccgcccagctggccgcgcgctga

SEQ ID NO: 4501 - DNA, 1290 bp, Chromobacterium substugae
atgaaaaagaccctgcttgccctgttgttcgccagcgccatgcaagccgcgctggccgctcccgccaccccggtacgcgaagtggatcgcatcgtcgccgtggtcaacaagaacgtgatcacctggcaggagctgaaggcgcgcgtcgacgaggccatcaagcagctggaggcgcagaaagtggcgccgcccgcccgcgacgtgctggagcaccaggtgctggagcagatgatcaccgaggaagtgcagctgcaatacgccgccagcggcggcctgcgcatcgacgacgcggcggtcgatcaagcggtggccaatctggccaagcagaacaagctgagcgaggccggcatgaaggcgcagctggccaaggacggcatcacgatggatcgcctgcgcggcgacatccgccgcgagctgaccatctcgcgcctgcgcgacagcgaagtgggctcgcgggtgatggtcagcgacagcgaggtggaccaggtgctgaagagcgcgcaaagcgccaaccgcaccgaataccatctggccagcatcctggtcggcgtgcccgaacgcgccgacgccaagcagatcgacgcgctgtcgcagaaggtgcacaaggcgctggccgatctggacgccggccagccgttcgccaaggtttccgccgcctactccgacgcgcccaacgcgctcaagggcggcgacatgggctggcgcagcgccacctcgctgccggtggagttcgtgcagatactggagcagctgaaaaccggcgcccacaccgacgtgatccgcacccagcaaggcttcttcatcttccagctgcaggagaagcgcgccggcggcgcgccgatgctgatcgagcaataccatgctcgccacatcctgatccgcaccaatgaagcggtgtccgaagccgacgccaaggcccgcatcgaccaggtgcgcgaccgcatcatgcgcggcgccaagttcgccgacatggccaagctgtactcggaagacggcagcaacgccaagggcggcgacctgggctgggtcagcctgggcgacctggtgcccgacttcgagaaggcgatggtggccttgccggtcggccaagtgtcgcagccggtgcgctcgccgttcggctggcacctgatcctggtggaaggcaagcgcaaccaggacgtttccagcgaccacgagaagatggcgatcaaacagcagatccgcgcccgcaagatggagcaggcttacgccgactgggtgcgccagctgcgcgattccgccttcgtcgaagaacacctggacgacaagtga

SEQ ID NO: 4502 - DNA, 2274 bp, Chromobacterium substugae
atgcacagacaaaaactgactccgctggccctggctgtcgccaccgcctttgccctgaacgcccagaccgcccgcgccgacgacgacgcgccgatcgcgctgcccgccccgcccaaacaacaaggccagaccgtagtcaccgccgaccagcttgacggcgaaatgaacgtgatcctgcacgccaagggcaatgtggtggtcacccgcgacgatcaaaaggtggaatccgactggctggactactaccaggccaaaaaccgcgtcaaggccggcgaccgcttccacatgacgcgcggcagcgacgtgatcgacggaagcaccctagactacaacgtcgacgactacaccggcaccggcatggatccggtgttttcgatgtcgcggcagaacccgccggcggccaaaacgcccggcggccagcccgccaaacccgtcaccatgcgcggcaacggcagccaggtggacttccagggccagaatcagtacaagatctacggcagccggatgaccacctgcgatccgggagacgacgcctggtatctgcgggccgccagcaccgacctcgactacaccagcggcgtaggcgtggcgcacaacgcctggatgcaattctacggcgtgcccatcctgtacacgccgtggctggacttcccgctgaacggcaaccgcaagtcgggcctgttgacgcccaccttcaagaccggctcgtcgggcaccgagctgtcggtgccgtactactggaacatcgcccccaacctcgacgccaccatcacgccgcacttcaacgacaagcacggcaatatgctggccggcgaattccgctatctggaacccgattacaacggcagcatctacaccgaacagttgcccaacgacaaggtcaccaacacctcgcgctatgcctggagcgcgcgccatcagcagaatttcggccacggcctgaccttcggcctcgactacaaccaggtatcggacaacaattacttcaccgacttcggcgaccaagtcgccatcgcctccaacatcaacctcaaccgcgaagcctggctgaactacgcgctgggctggcagggcggcggcggcaacgtcacgctgcgcacccagcactaccagaacctgaccatcaacccgcagccgaccgacatcccctacgcgcggatgccgcagctgaccttcaacgccaaccagtcgctgcccagcggattttccgccaacctggtcaccgacctgacccgcttcgaccatcccacgctgcaaaccggcgaccgcttcgtcgcctaccccagcgtgacctggagcttcgaccgcagctggggcttcatccggcccaagttcggcgtcaactacaccgaatacaatctgaacgcttaccagggcaacgcccaaggcacgctgagccgcacgctgccgatcttcagcaccgacgccggcctgtatttcgaccgcgacaccaccttcatggggcgcgatcacctgatgacgctggaaccgcgcctgttctacgtcaacatccccaacaaggatcagagcaagcttcccaacttcgacacctcggtcaacgacttcaacttcgcgcagctgttcaccgaaaaccgcttctccggctacgaccgcatcaacggcgccaacgagatcaccaccgcgctgaccagccgcttcatcgaccagagcaacggcctggagcgcctgcgcatcgccatcggcaagcgctactacttcagccagcaaagtattgttctagatggcacgccgccgcaggtgaccaataccggcaatgactggatgctgagcgccggcggcgacctgaccaagaccttccggttggacagcagctacgagtacaacccgaccatcaacgccacccaacgctacaacgttcagctgcgctacaacccggagccgggcaaggtcgccagcatccgctaccgctacggcatctacgagctgcaggacgacaacggcacctacggcccgctgcgccaggtggacgtggcggcgcaatggccgatcgccaagcgctggtacgccatcggccgctacaattactcgctgatccagcagcgccctattgagcaactggccggcttcgagtacaacgatggctgctggtcggcgcggctgtacagccagcgctacgccaccgacctgaccaccaccaagaacgcggtattcttccagctggaactgaagggactgggagcattgggcagcggcagcctgcaaagcgcgctgcgcctggccatcccgggttacaccaagactaacgagcaataa

SEQ ID NO: 4503 - DNA, 1035 bp, Chromobacterium substugae
atgcaaagactggaacagctcaagaaatggctggcgcagcaatatcctggtgttgaaatccaggtcgagttcgccgccgcagacgccgacttccgccgctatttccgcgcgatctggcccgacggcgccagccgcatcgtgatggacgcgccgcctgatcggatgaacaccgacgcctacgtcatggtgcgcgacgtcttcgcgatggtccgggtgccgcagatcctgctgcgcgaccgcgagcagggcttcatgctgctggaagacctgggcaagatcacctatctggccgcgctgcagcacgacgagcggccgcaggtgcaccagcatctgctgctggaggcgctggacacgctggtggatatccagaaagccagccagcccggcgtgttgccggaatacgacgaagcgctgctgctgcgcgaactgaatctgttcccggaatggtactgcgcgaaagaactgcaaaagccgctcaatttcgcgcagaggcaattgtgggacgccggcgtcaaggcgctgctgccggcgttgctcgcccagcccaaggtatacgtccaccgcgacttcatcgtgcgcaacctgatgctgagcgccggcgcgccgggcgtgctggacttccaggacgcggtgtacggcccgatcagctacgacctggtgtcgctgctgcgcgacgccttcatcgagtgggaagagccggtcgtgctcgacatcgccatccgttactgggagaaggcgcgcgccgccggcctgccggtgccggaggcgttcgacgatttctaccgcgccttcgaatggatgggcgtgcagcgccacctgaaagtggccggcatcttcgcccgcctgtaccaccgcgacggcaaggacaagtaccgcgccgagattccgcgcttcatcaaatacctgaagcgcgcctgccgccgctaccacgagctggcgccgttctaccagttgctggtgcagctggtgggccaggacgaaaccgacgccgagctgcagtccagctacccggtgttgggcgtgaagggcggctga

SEQ ID NO: 4504 - DNA, 663 bp, Chromobacterium substugae
atgcgggcgctgggagccggcctgttgctgatgtccggcctggccggcgcggccggcttgcaagcgcgcgtctgcctgccgtcgcaggatttgaaaatctgcctgtatcaggacgcgcggctggccggcgagcgcaacggcggcatcggcagcggcggcggcgagggcggcgactggtcgccgccgctggcgccggccgaattgcgtgtgtatacgcgcggcggcgcccaactgagccggctgcgggtggggcggctggcggatatccgccgcagcgcgctcgccgacgccggcaagccggtgttcctgctggacgaagatcattccgccggcttcggctcctattccggcgtggagacgcggccgttcaccgtgagcgcgcgcggcctgcgcttcgcccagccgccaggcggcgatccggccaagcccttcatcctggcccaggcgctgaaaagcggctggaaggagagccgtgatggtttcctgctggtgtcctgcgcgccggactttccggccaagggcaagtgggacggcgaaactttccgcgtccgctatgcccggctgacgctgcgggacggccaatggcggctgagcgagcgcagcgaacgcggcttctgggagaacgaaggcgctttcccggccgagcgcctgttcccgaaatga

SEQ ID NO: 4505 - DNA, 714 bp, Chromobacterium substugae
atgagcgagaagaacatgaaggcaatgatactggccgccggccgcggcgagcggatgcggcccctgaccgaccatacgcccaaaccgctgctgacggccggcggcaagccgctgatccagtggcacgtcgagcggctggcccgcgcaggggtgacggagctggtgatcaaccacgcctggttgggcgcgcagattgaagacgcgctgggcgacggctcgcgcttcggggtgtccatcgcctactcgccggagggcgaggcgctggagacggccggcggcatcgccacggccctgccgctgctgggagacgcccctttcatcgtgctcaacggcgacgtgttgagcgattttccggttcagcgtctggtcgaggcggctggccgtctggatggcgaatcgatgctggcccacctgacgctgacgcccaaggcaggctataagaccggccgcgacctgacattgcgcgccgacggccgggtggcggcctgcggcgacggcgacacgccatacaccttctgcggcctggccgcctatcatccggccttcttccgcggcgtggcgcccggcgtggccagcccgctgctgccgtggctgctggccgcgatggagcaaggccgggtccgcggcgaggtgcagtccggcctgtggctggacgtcggcacgccggagcgcctggccgaggccgaccgcatcgccgccggctggaccgcatga

SEQ ID NO: 4506 - DNA, 531 bp, Chromobacterium substugae
atgagccggcgcatcctcggcatcgaccccggcagcctgatcaccggcttcggggtgatagacgtggtcggcaaccagcgccattacgtcgcctccggcgcgatccgtaacaagagcggctcgacgctggcggagcgggtcaaggtgctggttgacggcattcaccaggtggtcgacacctaccagcccaccgaggcggcgctggagcgggtgttcgtcaacgtcaacccggcggccacgctgatgctgggccaggcgcgcggcgcctgcatggcggcgctggtgctgaaggacctgccggtggcggaatacaccgcgctgcaggtcaagcagtcggtggtcggccagggcaaggcgcccaaggagcaggtgcagtacatggtggtgcggatgctgaacctgtccggcacgccgcaggccgacgccgccgacgcgctggcggtggcgctgacccatgccaatcatagcggcggggcgataggcaagctggcgctgagcggcctgaaggtgaagggcgggcggctggtgtag

SEQ ID NO: 4507 - DNA, 594 bp, Chromobacterium substugae
atgatcggacgccttaccggcaaattgatcgagaaactgccgccgcaggtggtggtggacgtgggcggcgtcggctacgaagtggacgtgccgatgaccaccttctaccaattgccggcgctggggcagaataccacgctgttcacccacctggtggtgcgcgaagacgcccacctgctgttcggcttcgccagcaaggaagagcggcagaccttccgccaactgatcaaggtgaccggcatcggcgccaagatcgcgctggcggtgctgtcgggcatgacggccgacgagctggccgtcgcggtggccagcgaggacatcaagcgcctgtcgtcggtgccgggcatcggcaagaaaaccgccgagcggctggtgctggaattgcgcggcaagctcgccaccggcggcaacctgacggtgccgggcggcctgcctttcgccgccactccggatgagaagagcgacatcgtcaacgcgctgctggcgctcggctacaacgacaaggaagcggcggcggccaccaagagcctgccggcggacgtcaccgtcagcgagggcgtgcggctggccttgaagagcctgatgaaggcctga

SEQ ID NO: 4508 - DNA, 333 bp, Chromobacterium substugae
atgcgcaaaaccctgatcctcgccagcctgatccccgccctgtacgccggcgccagcttcgccgaacagagccagcccgccagcgcgccggcggcggaacgccacgccgcagccgccccggccgacgccgagctgggccgccaggtcaatgaagtgctggccaaggcagcgcagctgggcgccaaggtggaagcccaggtcagcaacggcgacgtggtgctgagcggcaccgcgccgagccaggaggcgatttcccgcatcgccgaggaagtgtcgcgggtgcccggcgtgaagagcgtgcgcagccaggtcagcctgctgccggccggctaa

SEQ ID NO: 4509 - DNA, 1341 bp, Chromobacterium substugae
atgaacgcccccgcccgcatcgtcctggtggacgacgatcccgacctgctgtgcctggtgcggctgcggctggaagccgccggccacgaggtggaggcgctctccagcgccgaagccgcgctgacggcgctggccgctcgccgcgccgacctgctgctgaccgactggcggctgccgggcatggacggcctgcagctgttcgaaaccgcgcgccgccgctatccgacgctgccggtcatcctgttcaccgcgcacggcaccgtgccggacgcggtggaggcggtcagccgcggcgtgttctgctatctggagaaaccgttcgacggccagctgctgctggacaaggtggcgcagggcctgacgctgtcggcgggcgacggcgccgccggcgacgcttggcgcgccggcatcgtcagccgcggcccggcgatggaggagctgctgagcgaagcgcggatggtggccgccaccgacgccagcgtgctgctgcaaggcgaaagcggcagcggcaaggaggtgttggcgcgcgccatccaccaggccagccgccgcgccggccggcccttcgtcgccgtcaactgtggcgcgattccggaaaacctgctggaaagcgagctgttcggccacgaaaaaggcgccttcaccggcgccgccgtccgccacgagggcctgatccgccaggccgacggcggcacgctgttcctggatgaggtcggcgacatgccgctgccgctgcaggtcaagctgctgcgggtgctgcaggaccgcgaggtgaggccggtgggcggcgcccggccgctgccggtggatatccgcctgctgtccgccacccaccgcgacctgccggcccgcatcgccgacggccagttccgcgaggatctctattaccgcttgaacgtggtggcgctgacgctgccgccgctggccgagcggcgcgaagacatcccgctgttggcccagcatttcctgcaacaggtctcagcgcgctacggcaagacggtgacgggcttcgccccggacgccctcgccttcctcgccgccgcgcgctggccgggcaatatccgccagttggccaatgtggtggagcagtgctgcgtgctggccaccggccccttgctgaccctggcccaggtggagaaggcggtggcaggcgaggcgcaggccattccgacgctggccgacgcgcgccgcgaattcgagcgcgattacctggaacgcctgctgcggctgaccggcggcaatgtcagcgacgccgcccggctggccgaccgcaaccgcaccgagttctaccggctgctgcaaaagcatgagctgaacgccgccgcgttccaggacgattga

SEQ ID NO: 4510 - DNA, 486 bp, Chromobacterium substugae
atgaccccacccgtttttccgcgccgctggctgccgctgttatggctgccgctgctttccgcctgcgcgctgcggccgccggccgcgccggtccgctactgccccggcggcgacgcgctgctgatcgcgctggattggccggacgaagccctgcgccaacgctggcaggcctacgaagcctgcgacagctaccgcctgctgcgaatcctgcgcgccaatcgcgccgagccgggccgcctggccagcgagctggacaaactgctggccgacaagagcctgtcgccggccagcgccgcgctggcgcggctgcagctgcgccaggcccagacacagttccggctgcaggaccaaaacgagcgccagcaacagcaattgcgcgaccagcaaaaacgcatcgacgaccaggccgccaaactggacgcgctgcgccgcctggagctggatctgcccaaacccaatggcctgagtgaaggaagcaagcgatga

SEQ ID NO: 4511 - DNA, 1392 bp, Chromobacterium substugae
atgctccgcttcctttccttccgcggcctgctgctggccggcttcctcggcgtcgcgctgatccccgccgcggcgctgatgcaactgcgccacgagttgggccaggccgccgacagcgcccagcgccaacagcgccaaacccagcgctggcaagacatcgcccgcttgtcgcaggagcaggcgctgcagtacgagcgcgccagccgccaggctgcgatcctgcgcgaccgcaaactcgacgaaaccgccagccaggcccgcgccgaattgcaaagcgcgcaacggacgctgcggcaggatgcgccggccgaggcgctgcccggcatcgacgccgcgctcgccctctgcgcccagacgccggcccacagccaacagcgcgaggcgcgcttccgccaactgcgccgcgtgctggaacagcaacagcaaatcctggtccaggccggcgagaaacggcaagcgagctggcgcggcgacatcgagcggatgcggctgcaagccaaccgcctggcctggctggcgctggccgccgccgtgctgctggcgctgatcgtcaccctgctgatccacgcccccttgcgcggcctgcagcgccgcatcgcccggctggccggcggcgcccgccaattgaactggcgccaggccggccccgccgacctgcagcggctgggccgggaattggagcagctggaccggcggctggtggagctggagcagcagcagacccgcttcttccgccaggcgtcgcacgagctgaaaacgccgctggcgtcgatacacgaagccgcggcgctgctgcgcgaacaagtggccggcccgctcaacccgcaacagcggcgcatcgtcgacatcctgggcaacaatgcgctggcgctgcggcaaagagttgaggcgctgctgaagcgggacgccggcccctggctgtccaccacgctgaacgtttccgcattttcgctgcgccgcttgctggaggccaggctcgccagctgccagccgctgtgccaggccaaagggctgatcgtggcgctggacggcatgccgggcgaagtgcacggcgatccgtccaaagtggaaaccatcgtcgacaacctgttgctcaacgccatccgccacagccctcccggcggccggctgacgctgcgctgcggccgcgagcgcggccaggtctggctggagatggccgaccagggcccgggcgtggccaaagcatgccgggacaagattttcgaacctttctggagcggccccgcgcccgacggcgagcgccccggcagcggcctcggcctgaccatggcgcgcggctacgcgcagctgatgggcggagaacttagcctgctggaccacggccccggcgcgcgcttccgcctccactggccagaaccggagccgatatga

SEQ ID NO: 4512 - DNA, 711 bp, Chromobacterium substugae
atgttcagcggcatcacccaggccatcgcccgcatcattgccgtccaggatggcgacggcagccggcggctcaccctcgctttcccgccgggcttttgcgacggcttgcggcagggcgccagcgtcgccgtaaacggcgcctgcctgaccgtggcggcgccgccgcaggcagacaacgccgagttcgacctgatcctgccgacgctggtcaccagcacgctggcccgctgccaggccggcgacgcggtcaacgccgagcgggcgctggccgacggcgcggagaacggcggccacgcgctatccggccatgtcgactatcaagccaccatcgcccaacgagaggcatgcggcgacaacctgcgcctgcggctgagcgtgccgccgggcgccttgcgctacctgttcgccaagggctacgcggcgctggacggcgtcagcctgaccatcgccgacatcgacaagcgcgaaggctggttcgaagtgtggctgatcccggaaacgcgccaggccaccaccttgggcggcaagcaagcgggcgaccggatcaacctggaaatcgagcggcagacccaggtgctggtcgacaccatgcgcgaggcgctggaggacaagttcgcggcgctggcgccgctcctggccgccaggctggacgacttggcccccgcgctgctgccggctgcgcgccgccagccggcgctggcggcgcgctga

SEQ ID NO: 4513 - DNA, 633 bp, Chromobacterium substugae
atgaacgcccacaccgatatcctttccctgcgcgtccacgccgcgcttgacgccttgcgccgcggcctgccggtgatcgtcgccgacgacgccgaccgcgaaaacgaggccgacctgatcctggccgccgacatgctcaccgtgccggaaatggcgcggatgatccgcgacggcagcggcatcgtctgcctgtgcatcacgccggagcgcgccgcgcagttggcgctgccgccgatggccgccgacaacggcagccgctacggcaccgctttcaccgtcgccatcgaggcggccgagggcgtgaccaccggcgtctccgccgccgaccgcgtcaccaccatgcgcgccgccatcgcccccgacgccaagcccggcgacctggtgcgccccggccacgtctaccccatcgtcgcccgcgccggcggagtgcgcgagcggcgcggccacaccgaagcctcggtggagctggcgcgtctggccggcttcagcccggccggcgtgctgtgcgagctgatgaacccggacggcagcatgatgcgcggcccccagctggacgcttatgccgcacggcacggcctgccgcagctgacggtggcggagctggccgaatggctgcaacggcaagacgcctga

SEQ ID NO: 4514 - DNA, 1038 bp, Chromobacterium substugae
atgatagaaaccgacaagctgttcggcgccgcgccggagcgccgcatcgtcaccgcgcaacgcgcgtccgagcaggaagaggcgctggagcgcgcgctgcggcccaagcagctggacgactatgtcggccagaagaaggcgcgcgagcagctggagatcttcatcgaagccgccaagcgccgcggcgaggcgctggaccacgtgctgctgttcggcccgccgggcctaggcaagaccacgctggcccacatcgtcgcgcgtgagatgggcgtcaacctgcgccagacttccggcccggtgctggagcgcgccggcgacctggcggcgctgctgaccaatctggagccgcacgacgtgctgttcatcgatgaaatccaccggctgtccccggtggtggaggaaatcctctacccggcgctggaggattaccagatcgacatcatgataggcgaaggtccggcggcgcggtcggtgaagctggacctgccgccgttcacgctggtgggcgccaccacccgcgccggcatgttgaccaatccgctgcgcgaccgcttcggcatcgtcgcccggctggagttctacaccgccgatgagctgacgcgcatcgtcagccgctcggccggcctcttgaacgtacagctgtccgatgacggcgccttcgaagtggccaaacgctcgcgcggcacgccgcggatcgccaaccgcctgctgcgccgggtgcgtgactacgccgaagtgaaatcggacggcgtggtgacgatggcggtggccgacgccgcgctggcgatgctggacgtcgatccggccggcctggacgtgatggaccgcaagctgctctccgccatcctggagaagttttccggcggcccggtgggcctggacaacgtcgccgcggcgataggcgaatccaccgacaccatcgaggatgtgatcgaacccttcctgatccagcagggctatctgcagcgcaccccgcgcggacggatggccacctcccaggcgtatctgcacttcggcctgccggcgaaagacgcctga

SEQ ID NO: 4515 - DNA, 420 bp, Chromobacterium substugae
atgttctacgtgttgttcgccaccatcctgatcgtggtggttgccgcggccgtcgccgccgcgcgtttcttcgacccggccgtggccaagatcctcggccgcaccctgggccaggagctggccgacgcctggcgcaagtatgtgttcttcgccattgtggtcagcggcgtgtccggcggcgtgcggccgtggtcgctggagcgctatctggcgccgctgccgggcaagggcagcagccagctgcaactgggcggcgagcgctggatgctggagctgtacaccgccggcatcgaaacgctgcgctccatcgcctgggtggtgctgctgttcttcctgtgcgcgatgctggcctatgtgatcatgcgcgcggtggaattccgccgcctggaagcggaagaacgccgcagccatccggaatag

SEQ ID NO: 4516 - DNA, 573 bp, Chromobacterium substugae
atgctggaagagcggctgcgggggctggttcgcgccagcccctggctgatggaggctttgcgcgcggcgcgggcgctgcatctcgccgactggtgcataggcgccggcgcgctgcgcagcctggtgtgggatgcgctgcatggcttcgcgtcccagccgtcggccctgtccgacatcgacctggcgcatttcgacgccagcgacctttcccccgggcgcgacgccgcgctgcaagcccgtctgcaagcctcccatcccggcctgccctgggaagtgaccaaccaggccgccgtccatctgtggttcgccgattatttcggctacgcggttgagccgctgtcttcgctggaggatgcggtggcgacgtggccagaatacgccaccgcggtgggcgtggcgctgaacgccgacgacagcctgcgcctgatcgcgccttatggcctggacgacctgttcgccatgcgggtgcgccgcaacccggcgcgggccagcgtggagatctatcggcagcggctggcgcagaagcgctatgccgagcgctggccgcgggtgagggtggtggagtcggcctga

SEQ ID NO: 4517 - DNA, 1074 bp, Chromobacterium substugae
atgaacaagctggctctcgcggcgctgatgacactagcctggggctcggcatccgccgcggatgtgctgcatgtctacaactggaacaacgcgctgtcgcctgacaccgccaagcgcttcgagcaagcgtgccgctgccagttggtgcaggactactacggcgacaacgaggaaatgctggccaagctggccgccggcgccaagggctacgacatggtgttccccaccgccttcgcggtgaacgcgctgctgaagcagggcaagctgcaggcgctggatagagccaagctgcccaattggaagaacctgaaccccggctacctgcggctcaaccagcccttcgaccccggcaaccgctatgccgcgccgaccgtggtgtcgctgacgctgctgggctacaacgccagccaactgaaaaaagccggcctagccgacaaggccaatagctgggcgctggtcttcgacccggcgctgctggccaagatcaagggcaaggtgacggtgctggacagccagcgcgaactgatggccgccgcgctgatgtacctgggccgcgacgccaactccgtcaaccccgccgactggaaggccgccgccgacgtcatccgcaaggccaagccctactgggcggcgttcaacaaccagagctacatcaaggagctgaccgtcggcaacatctgggtggcgctgggctattccaacgacctctaccaggcgcaacaggatgtgaaagccgccaagcgcccgttcgagctggcctaccagccgcagaaggaaggcaatgtgctggcgatagacaatatgaccatcctgaaggacgcgccgcgcccggacctggcctaccagttcatcaacttcatgctggacggcaagaacgccgcggagatctccaaccagatcggcgccaccaatccggtgaaggcggccgaagctttcttcaagccgcagatcaaggccaatccggtgatcatgctggacccggccaagggcaggtacgtggccttgaaggatctggacgcgaaatcgcgccgcgagctgaaccgcttgtggacgcaggtgaagatcgggcgctag

SEQ ID NO: 4518 - DNA, 1119 bp, Chromobacterium substugae
atggattcggtgatacacgcatccgaccgcatcgtggtcaaggtcggttccagtctggtaaccaacgacggcaagggcctagaccttgccgccctggcgcgctgggccgccgaaatcgccgaactcaagcgccgcggcaagcaggtggtgctggtttccagcggcgccatcgccgaaggctgccagcgcctgggctggaccgtgcgccccaagggcgtgcacgaattgcaggccgccgccgccgtcggccagatgggcctgtgccaggcctatgaaagcgccttccgcgctttcggcctgcagaccgcgcagatcctgctcacccacgaagacctggccgaccgcacccgctatctgaacgcccgctccacgctggtgagcctgctcaatctcaacgtggtgcccatcatcaacgagaacgacaccgtggtcaccagcgagatccgcttcggcgacaacgacacgctgggcgcgctggtcaccaacctgatcgaagcggacgcgctggtgatcctcaccgaccagcaaggcctctatagcgccgacccgcgcaagcatccggacgccgaattcatccgcctggccgaagccggcgatcccaggctggaagagatggccggcggcgccggctccagcgtcggcaccggcggcatgatcaccaagattctggccgccaagcgcgccgcgcgcagcggcgccgccaccgtgatcgcctgcggccgcgaggcccaggtgctgtcgcggctggccgacggcgaagccatcggcacccagctggtggccgccaccagccgcatggcggcgcgcaagcaatggctggccgaccacctgaagctgtccggccgcctgctgctggacgacggcgcggcgctggccatccgcgagcgcggcaccagcctgctgccggtgggcgtcagcgcggtggagggcgacttcctgcgcggcgaggcggtggcctgcgtcgacgccgccggcaacgaggtggcgcgcggcctggtcaactacagttccgacgaggcgcgccagatcatgcgcaagagcacccgcgagatcgagggcgcgctgggctatatcgtcgaacccgagctgatccaccgcgacaatatggtggcgctgtaa

SEQ ID NO: 4519 - DNA, 1530 bp, Chromobacterium substugae
atgccgccactcgccttgccgaagaaggatatggacccgcaactcgtcgacacccagccagccagcgtcgcggcctggctggaacgccttccctacaccgacctgccggaatgcggccggctgctcagccaggcgctgtaccagctggcgcgcacgccgctggagccgacgcagcgcttcaagctgctgctgctctatctgaaggcgctggatcgctattacccgctgctggaagccgaatcgcagcacaacgatatcctgtcctcgcccaagacccggctgctggcggtgctcagcgtcaaactgttcgccaatctgtacatcgccttcaaacagaccttgaacgaaaagctgggccgccacgcgctgctggagcgagagcagcccaagatcgaactgctgctgtacaccatgatggccgcccgccagtacctgaacgtcagccagcagaattactgcccgctgccggcgggcttctggctggactgccaccagctctacgcgctggcgcgggagcgcggctggcaggacaaggcgctgtccggcgacgactcgctggccgtcatctaccgccagatcctgctgctgggcctgacctccaccaaccgcctgtcggttgtcgacatgcacctggcgcgccagctgatctacgacctggcgcgccaagtatcgctgctgccggtggcgggcttgaacgacaaccgccacggctatctgctggacccgctggaagacaatccgccgcgccacctgctgatcacccccggctcgctgcacggccattgcagcatgctggagttgagcggcgcggtggacaccatgcgccgcagcctggaacagctgcagagcgccagcggcaacgccgccgcgcagctgggcgatgtcgtgcagctgctgagcggcctggtggaagaatggcagcatccgcgccgccgcaagcacggccgggaagacagccaggcagtggtcgaggtcgtctccaccctctcctcgatctggcacctggccaaccacggcagctggcagctggccggcgccggctcggaagaggagaacgcccgcctgcgcagcccgccgtcctcctgcctgctgaccctggtcaaccgcagcgaatccggctatctgctgcgcggcctgccgcgcgaacagacgctgcgcgccggcgaagcgctgctgctgcatccgcccgaccagccggaagcggcgcagctgtgcgcggtgcgctgggtgctgatgcaacccaccggcaaggaagtggaatgcggcgtggaaatcctcggcggcctgccgcagccggtgctggcgatgcccagcatcacccatagcggcgacagcttcctgcgcggcctgcggctgccggccgccgccggccgccccgacctgctgttgctgcccggacgccagttcagccagctgcgcgaattccgcctgcgcgacgacgccggggaaaaactgatacgcgccgccaaactgctgcagcaatcccctcactttcaactgatcgaataccggcccagcgagtacttttga

SEQ ID NO: 4520 - DNA, 1350 bp, Chromobacterium substugae
atgagcaaccaagcctggctggagcgcagcttcgccgccgtctggcatccctgcacccagatgaagcgccatgaaagcctgcccatcgtccccatcgccagcgccgacggcgtctggctgaccgacttcgacggcaaacgctatctggacggcgtcagctcctggtgggtcaacctgttcggccatggcgagccgcgcatcaagcaggcgatcaagcgccagctggacagcctggagcacgtgatgctggccggcttcacccaccagccggtggtggagctgtcggaacgcctggcggcgctgtccggcctcggccgcgccttctatggctccgacggcgccagcgccaccgaaatcgcgctgaagatgagcttccactactggaaaaaccgcggccagcccggcaagacccgcttcgtcagcctggagaacagctaccacggcgaaaccgtcggcgcgctggccgtcaccgatgtgccgctgttctcgtccacctacgccgacctgctcaagcctggcctgcgggcgcccagtccggacgcccgccaggccgcgcccggggaaaccgccgccgacccggcccgccgcgccgccgtggcgctggaaaacctgctggccaagcgcgccggcgagatcgccgcggtgatcgtcgagccgctggtgcagggcgcggccggcatggcgatgcacgatccggcctatctggccgaactgcgccggctgtgcgaccgccaccaggtgcatctgatcgccgacgagatcgcggtgggcttcggccgcaccggcaccttcttcgcctatcagcaggccggcatcctgccggacttcctgtgcctgtccaagggcatcaccggcggcttcctgcccctgtcctgcgtgctgacccgcgacgaaatctaccaggccttctaccacgacgatgtggcgcgcggcttcctgcattcgcacagctacaccggcaacgcgctggcatgcagcgccgcgctggcggtgctggacatcttcgaggccgacgacgtgctggccgccaaccgggagaaggccgccgaattcacccgccgcatgcggccgctgtcctcccgccccgacatccgccacttccgccacaccggcatgatctgggccttcgacgtggccaccgagcgcgccgactttgcattggcctttttttcggccatgctgaaacgcggatgtctgttgcggccgataggcaagaccgtctacttcatgccgccctataccctgaacaacgaagaaatggattggctggtcgagtcgagctgctcagcgctggacgaagtcctggccggcggctcgcagacggcaggcgcggaaacgccgctgccctga

SEQ ID NO: 4521 - DNA, 477 bp, Chromobacterium substugae
atgaagagacagcagatccagcagggtttcaccctgatcgagttgatgatcgtggtggccatcgtcggcatcctggcggccatcgccatcccggcttatcaggactacaccaagcgggcgcgggtgacggaaggcctggcgctggcggattcggccaaaaccgcggtcaccgagtactacgcatccaacaatgcttttgtcgcgtcaggcaccgcaccgtataacactagctatgggcttgccacaaccatcaccggcagttcggttggcagcctgtcggtgctggccagcggcgtgatccaggtcgcctacaacagcacggtgtccagcggtgccctgctggatctggtgcctactgttacttccggctcggtttcctgggtctgcacctataccggcaccggcggcggcaccaccgccatcgcagccgccaaccaactgtcggccaactgggtgcccagcacctgccgccagtaa

SEQ ID NO: 4522 - DNA, 471 bp, Chromobacterium substugae
atgcggaacagaacgacgcagcgcggctttaccctgatagagctgatgatagtggtggcgatagtcggcatcctggccgccatcgccatcccggcctaccaggactacgccaagcggtcgcgggtggccgaggggctggcgctggccgacgccgccaagaccgcggtggcggagtactacgccagcaaaagcgcgttcgccagctccacgccgtacaacagcgcgtacgggctgtcgacggcgtcgtcgatcaccggcaacgcggtcagcagcgtgtcggtgctggccagcggcgtgatccaactgacctacaacaacacggtctccagcggcgcgcagctggatctggtgccctcggtcacctcgggttcggttacctgggtttgcacctataccggcaccggcggcggcaccacggccatcggcacgcagttgcaggccaactgggtgccgaccaactgccggcagtag

SEQ ID NO: 4523 - DNA, 1872 bp, Chromobacterium substugae
gtggcgcagatgcaaggatcaagccagttgagcgacaagacctggtggcgcgatgccgcgctgtatctgtttttttgcggctgtttcgtctttccctttttcaatttcgcccgctacacgccgctgcaggactggtggaccaatgccggcgtggtgctctgcgtcggcatcgccggcttgttcgcgctgcgccgcgggcaaagcggcgtgcgggtgccattggcggcggcggcgctggcggcgctgctgctgttgctgtccttcagcaatggcttgctgctggagaattaccagcccgccattctgatcctggccagcctggccgcgatgctggtgctggcggtattcctcgtcaaccggctgcggccggacctggcgcgcgtctgcgtcatcctggcctcctgcctgttgctgggcagctgcatccagatcgtgctgggcagcatccagctgctggacctggcccggtattgccgcggcctggtgacgttgaactatctgaacccgaccgaagtgatgggcaatgtcggccagcgcaaccagtacgcgcagtacttgagctggggcgtggcggcggcctgttacctgtatgggcgcggccggctgcgcgccggcttctgcgcgccgctggtgttgttccagctgctgttgattacctggtgcggcgcgcggctgccgctggcctacagcctgggcatttgcgggctgtgctggttctggcaccgccgcgcgcccggcgacgaggcgttgctgcgcatgctgaaggccctggcggcggcgatcatcgtgctggcgctgctgcaattgttcaatgaagagatcgtctggctgctcaaccggctgggcttgcccatccatgtgcaaagcggctccgaacgcctgctggacgccggattcggcgcccgccgccgcatcgagtggaccaaggcctggatggtgtttcagcagcacccctggttgggggtggggctggcgcgctatccggcgcagtcggtctggctggaggcgtttggcggcctgcccaagtacccggaaggggtgttgttcacccaaagccataatctgattttccagctgttggccgaaaccgggctgtccggcgcgctggtcgcggggctgggcttgtgcggctgcctgctgccgtttttcgcccgcggccggcagagcccggaaaacctgctgctgatctgcatcgcgatgatgctgctgacccacagcatgttcgagtttccgctgtggtacctgccttttctggcgatgctggtgacggtgtgcgcgctgggtccggcgccggtttggcaggtgcccacccgcacgatgctgttgcggctggcctgcgccggcggcggggcgctgatgatcgcgcatatcgtcagcggggtgttcatcttctggaatctggtggcctacagccggcccagcctgtcggcggcggaaaacatccggcgggtgaactacatcgaaaaagtggagcgcaatcccttgtggatagacgcggcctcgatggtgatgggcaattacctgctgccgggccggcggcagctggcggtggtgctgccgttctacgagcaactggcgcgcaaccagccgtatatcgccgtgctgcagcggctgagcgtatgccaggcgctggccggccagcccgaggccgccagacgcacgctggtgatggccatcgccagctatcccgacgaagtgttgaagttggacgccagcctgcagccgtggcaagagcccgaggtgcgcgcgctggccgaactcaccagccgggtgaaggccatctatttgcggcacggcgcgtataccgacgccgcgcggatggcggcggtgacggcggtggcgtcgccggtcacgcgcaaaccgttgttttga

SEQ ID NO: 4524 - DNA, 1833 bp, Chromobacterium substugae
atgcggtatgctgccggctttgctgttttcgatatctggtccgccatgacttttcagaaaatatccgaacgcctggccctgctggcattgtgcctgatcgccatcgtgccgttcgcttcccgcgtccatttcgtgccgctgccgcagtggttcggcgaaatcaacgtgatctggctgctggtggccgccggcgccttgctgctgcccggcggcaagctgttcgacgcggtgccgcgagccggttggtggtgcctgctgctggcgggggtctgggcgctgcagccgcagctggtcagcctgatgttccccggcatgagctacgccaccgcgctgggctggttggcgctggcgttgctggcctcgatcaccgcctccttgcgcggcgctttcggcgaacgcgagttcgcggtatggctggcgcgcgccgtcatcgtcggcggcctggtgcagtcgctgatcggcgccgcccagctcaccggcctggccgcgccgctggggctgttctacgatggctcccaccccaccaccaacattttcggccacatcggccagcgcaatcagtacgcccattacctgatgtggtcggtggtatccggcgtctatctgttcgcggtgggcaggctggggcgcaactggctggtggcgctggtgctgtggatggcgctgatgctggcctgggcggggtctcgcaccacgctgctgtatctggtggcgatttcggcattggccgcgctgtggcactggcgcagccgcaatgaggtttcgcgccggctgatgctggcgatgtgggcttgcagcggcgcggtgctggccggccagttcgccctgccgctgttcaatcacctgatttcgctgttgacccattccgacgtggaaaacgcttccggcgtggcgcggctggcggccaacggcgacgacatgggcgcgcgccgcttcgccgagatgcacaaggcttggctcaccttcaaggcgcatccgctgtggggcgtgggctggtcgcagtatgcggcggaaagcgtgcgcctgcagccgctgccgcagttcgccgccgcaggctacaacagcggcctgttcaccaatgcccacaacctggtgctgcaattgctggccgaaatgggcggcgtcgccaccgcgctggtgctgggcggcttcgtctgggcggtatggccgttcttccgtcgccaggccgagccggaaggcgtgctggcgctggcttgcatcgcggtgacgctgacccacagcatgctggagtatccgctgtggtatttctatttcctggcaatgctggtgctgttcatggcgatggcgccgcgcggcgagtccaggtccttgccgttgccggcgcgactgccgttgctggcggcgctggcatgggtaggctggctgtcgatcagcaccacgccgatgttctgggagctggtcaacctgtacacccccaccggcaacgcgcagaaggacgccaagcgcgccgagcggctgatcgaaatcgtcaagaccaagccgctgttcgcctaccacgcgctgtacacgctggacgactacctgccgatcacccgcgacaatctgaagcagaagctggcgctggaagaccggctgaccgagttccgcccgtatccggacgtgatgctcaagcgcgcgcagatggaagttttggccggcgagcaggccaaggcggaacagacgctgcgcaccacgctggcctcgttcccgacctatgccggccagttcctggaaacgctgggcgacgccaacccggaatgggagccgctgcgcaagatcagccgcgaggcctacgacaagctgccggccaagttccgcactttgccggagtaa

SEQ ID NO: 4525 - DNA, 783 bp, Chromobacterium substugae
atgctgtcgccggagcaggaaaccgagctcgcgacccgtttccagcaggaaaacgacctggaagcggcgcggcagatggtgctgtcgcacctgcgcgtggtggtgtcggtatcgcgcggttacgccggttacggcctgcagcaggccgacctgatccaggaaggcaatatcggcctgatgaaggcggtgaagcgcttcgagccgggccgcggcgtgcgcctgttctcgttcgccatccactggatcaaggccgagatccacgaattcatcctgcgcaactggcgcctggtgcgcatcgccaccaccaagccgcagcgcaagctgttcttcaacctgcgcagcatgaagagcggcttctccgcgctgtccgaacaggaagccaagtccatcgccgccgacctgggcgtcaagcccgaggaagtccgcgaaatggaaatccgcatgaacggccaggatgtgtccctgctggccgacagcgacgacgaggacagctacgcgccgatagactggctggccgactcgcacagcgagccgacccgcgcgctggagcgccgcgctttcgaccacttgcagtcggaaggcctcgaatacgcgctgtcgacgctggacgcccgcagccgccgcatcgtcgaagcgcgctggctggccgacgacagcggctcgacgctgcacgagctggcggccgaattcggcgtgtcggccgagcgcatccgccagatcgaggccaaggcgctgaccaagatgaaggccgcgctcagcgagggcgtggtgctggacaactga

SEQ ID NO: 4526 - DNA, 909 bp, Chromobacterium substugae
atgaaacactttctctatctgaactggcaaagcgccaagcaggcgctgatcaagatcctgcgccaaccgttcggcagcctgctgaccctgctgatgctggccttggcgctggcgctgccgctgtgcctctacctgtcggtcagcagcgtgcaggactgggtcggccgccttaccgccacgccgcagatcacgctgttcatggagcaatcggccgaggaggccgacatcgccgccgtcaacagcaccctgtcgcaccaccccaaggtgaagagcttcacctttatcagcaagagcaaggcgctgcaggacctggagcagcgcaacggcctgtccggcctgtccgacggcttggacggcaatccactgccggacgccttcgtcgtcaccccgatttcgctcgaaccgcgcgaaatggaaatgctgcagaaggagctatccggcctgccgatggtggaaatggcgcagttcgacgcgcattgggccaagcggctgtacggcatggtggacatgggcaagaagctgacctggttcctggccgccgcgctgggcctggcgctggtgctggtgacccacaacgcgatccggatgcagattctggcgcggcaggatgaaatcgaggtgtccaagctgatcggcgccaccgacagcttcatccgccggcccttcctctaccacgcgctgtggcagggcgtgttcgccgcgctgctggcctggggcctgtcgagctggctggcggcgctggccaatccggccatccgcgaattcgccatgctgtacggcgagcgggtggagctgcgcggccttaatctgcaggagctggcggcgctgatcggcgtggccgccttcctggcgatgctgggcgcccgcctcgccgccgaccatcacctgcgcaaggtagagccgaaatag

SEQ ID NO: 4527 - DNA, 654 bp, Chromobacterium substugae
atgatacagttcgaccaggtaaccaagcgctacccgggcggcaacgaagccctgaagaacctgtccttcaccatcgaaaccggcgaaatggtgtttctcgccggccactccggcgccggcaagtcgacgctgctgaaactgatcgccggcatcgagcgcgccaccagcggcggcgtgctggtcaacggccagaacctgtccaaactgcgcggcagccagatcccctatgtgcgccagcatctgggcatggtgttccaggaccacaagattctgttcgaccgcagcgtgttcgacaacgtgatgctgccgctggacatcataggcttcgaccgccgcgacgcagccaagcgcgtgcgcgccgcgctcgacaaggtggggctgctcagcaaggaaaagatgatgcccatccgcctgtcaggcggcgaacagcagcggctgtgcatcgcccgcgcggtggtgcaccgccccagcatcctcttggccgacgagccgtcggccaacctcgaccgcgcctacgcgctcgacatcatggagttgttcaagtccttccaccaggtgggcgtcaccgtgctgatctccgcccacgacgaaaccctgatggaagactacggccgccgcatcatccgcctgagggaaggacagttcgccgcatga

SEQ ID NO: 4528 - DNA, 1149 bp, Chromobacterium substugae
atgttcagcttcttcaagaaaaaaccgaagccggtggagacaccgcaaaccgaaacgccggcagccgtcgtcgatgccgctccggcactcatcgccgagcccgccagtccggccgccgccgcgcttgaagcgcctgctccggcgccggcccctgatgccgtcggcgatctgccggccgaaaccgccgccgctgttgccccgccggtaccgtccgaagacgccgcgccgacgccgctgaagaaaatgagctggaccgagcggctgaaggccggcctggccaagacccgcgaccgcctgggcaagcagctggccggcctgttcggcggcggcaagatagacgaagagctgtacgaagagctggaaacggtgctgctgaccgccgacatgggcatggacgccaccgtgcatctgctgaaggacgtgcgcgaacgggtatcgttgaagggcctgaaggattcttccgaactcaaaggcgcgcttaaggattcgctgcaggacctgatcggcccgctggaagtgccgctggacgtcgaaggcaagaagccgttcgtgatcatgatgaccggcgtcaacggcgccggcaagaccacttccatcggcaagctggccaagtactaccaaagccagggcaagagcgtgctcctggccgccggcgacaccttccgcgccgccgcgcgcgaacagctgatcgcctggggcgagcgcaacgacgtcaccgtgatcgcgcagcagggcggcgactccgccgccgtctgctatgacgcgatccaggccgccatcgcccgcggcatcgacatcgtgctggccgacaccgccggccgcctgccgacgcagctgcacctgatggaggaaatcaaaaaggtgaagcgggtgatccagaaggcattgccggacgcgccgcatgaagtggtgctggtgctggacgccaatatcggccagaacaccgtcaaccaagtgaaagccttcgatgacgcgctgggcctgaccggcctgatcctgaccaagctggatggcaccgccaagggcggcgtgatcgccgccatcgccaagcagcggccgatcccgctgcgcttcatcggcgtcggcgaaagcatagacgacctgcggccgttcgacagccgcgactacatcgacgcgctgttcgaataa

SEQ ID NO: 4529 - DNA, 570 bp, Chromobacterium substugae
atgagtcagtcacgtaacaaggtcagaatcatcggcggcgaataccgccgccgcctgctgccgtttcccgacgccgaaggtttgcgtcccacgccggaccgcgtccgcgaaaccctgttcaactggctgggccaggatctgtacggcaagaactgcctggatctgttcgccggcagcggcgcgctgggcttcgaggccgcctcccgttccgcccgtcgcgtggtgatggtggagaaatcgcgcaaagcgcacgaatcgctgcaagccaatcgacagctgctgcaggccggcgcgctggacgtgcagtgcggcgacgcgctgctgtacctgaagaacagccgcgaacagttcgacgtgatcttcctggatcctccctatgattccgacctgctggagcaggcgctgccgctgctgctgccgcggctggcggaggagggcatggtgtacctggaggccaggctatggccggagcagctgccggaaggcctggaactggtgcggcgcgacaaggccggcctggtgcagtacggcctgctgcggcgcgtcgcggccgcccccgttttgttgtga

SEQ ID NO: 4530 - DNA, 252 bp, Chromobacterium substugae
atgtctttgataattaccgacgaatgcatcaattgcgacgtctgtgagccggaatgcccgaacaacgcgatctcgcagggcgaagagatctaccagatcgatcccgacctgtgcacccagtgcgtcggccactacgacgagccgcaatgccagcaggtctgtccggtggattgcattccgctggatccgtcccatcaggagagcgaagaacagctgcatgccaagtatctgaagatttccggcaaggcctga

SEQ ID NO: 4531 - DNA, 82 bp, Chromobacterium substugae; identical to SEQ ID NO: 4286

SEQ ID NO: 4532 - DNA, 71 bp, Chromobacterium substugae; identical to SEQ ID NO: 4287

SEQ ID NO: 4533 - DNA, 72 bp, Chromobacterium substugae; identical to SEQ ID NO: 4288

SEQ ID NO: 4534 - protein, 273 aa, Chromobacterium substugae
MSTQWKRWLSGAALAALLAACAQVSTTGGGAVGVSRSQSMLLSSQEVAQMSAKAYAQQLGEARAAGRLNTNAALTARVRRVSQRLIAQTPAFRADARGWPWEVNVLATDDMNAYAMAGGKIMVYSGLVSQLKLTDAELAAVIGHEISHALREHTRESMSQEYAQQAGLSLVGALAGFSADQLKLASLVTDVTLSKPHSRTMESEADIMGLELMARAGYDPNAAVNVWQKMQAAGNGGGMEFLSTHPSGPTRIRDLQAHIPQVWPLYLAAPKKG

SEQ ID NO: 4535 - protein, 489 aa, Chromobacterium substugae
MRKQQLMLRGLVLSALAVFSSAALAAERIDLEKLGKIQANGAVAFTGVNQADLKPLRSTQFATGKVVTRFQQYYQGVPVWGEAVVEEKQAGAVAKTSGKLSGQYIAGIQSDLASAKPTLSSAQALSQAKSLKANGNPTYNEKADLVVRLNERNTAQLVYLVSFVVDGKEPSRPHLIIDANNGQVLKQWEGLNHAEANGPGGNAKTGKYVYGTDYGPLIVTSDCKMDSGNVATVNLNGGTSGTTPYKFACPTNTYKAINGAYSPLNDAHYFGNVVFNLYKDWFNLKPINQKLLMKVHYSRNYENAFWDGTAMTFGDGASTFYPLVSLDVSAHEVSHGFTEQNSGLVYDGQSGGINEAFSDMAGEAAEYYMKGKNDFLVGAEIFKKTGALRYFADPTKDGQSIGNAKDYYDGLDVHYSSGVYNKAFYLIATSPNWNTRKAFEVFVDANRLYWTANATYNSAACGVVKAADARGYNSADVTKAFTAVGVTCK

SEQ ID NO: 4536 - protein, 183 aa, Chromobacterium substugae
MQQFDGTTIVSVRRGERVALGGDGQVTLGNIVIKATARKIRKLHGGKVLAGFAGGTADAFTLIERFEAKLQKHQGNLLVSAVELAKDWRTDRMLRRLEAMLIVADKDHTLIITGNGDVLEPEQGIAAIGSGGAFAQSAARALFENTDLAPEVVVKKSLEIAGDICIYTNHNHLIETLGPDDEA

SEQ ID NO: 4537 - protein, 448 aa, Chromobacterium substugae
MTQMTPQEIVHELDQHIIGQHAAKRAVAIALRNRWRRQQVAEPLRSEITPKNILMIGPTGVGKTEIARRLAKLSGAPFIKVEATKFTEVGYVGRDVDTIIRDLAEVAIKETRDAAIKRNRVRAEDAAEERILDALLPRVHQPQTGFFAGEPAVEDKHEDGATRQKFRKMLREGKFDDKEIELEIAAPIAQMNVMAPPGMEDFASQLQGMFQGLGAGKKQAAKMKVADAFKQLVDEEAAKLVNEEELKAEALKNVEQNGIVFLDEIDKVTSRGEGQGGADVSRAGVQRDLLPLVEGTTVSTKYGMVKTDHILFIASGAFQLSKPSDLIPELQGRLPIRVELSSLSVDDFKAILTSTNACLTRQYQALLATEGVELAFEESGIQRLAEIAWQVNEKTENIGARRLYTVMEKLLEEVAFDAKSGERKIDGAYVDCKLGEVAEREDLARYVL

SEQ ID NO: 4538 - protein, 481 aa, Chromobacterium substugae
MMKRRLLCALLASVLAQPLTVRADLPDLGEISDASLSLSDESRIGRDALRAMREAGDVLDDAEISAYLNDIGGRLSSSVTLPGIHFTYFCVADTGINAFAMPGGYIGVNIGLILATQSEGELAAVMGHETAHVAQRHIARMQAANSATSPLLLLGTIIAAALAAKAGSGDGAMGAVSAGMGLSISRQLAFSRDFEREADRVGMQFMSNAGYDVRYMATFFQRLEQAGRYSDTMAYAFLRTHPVTVERISEAQNRALDYPVRMRADSIDYLLVREKLRTLTMTPEEALFYYNSTLQRGLYLNEGASWYGLARAKLLQHDRKGAEEALAKARAKLLDNPMLHGLEVEIARDGRDWSAAAAAARDGLAAFPRNVALQLAQIDVALDSGDRAGAQKLLRQQLNDRSGDPALYRREAKLYADRDPLRYHEALGNAFYYEQRYSSALEQYQLASKAKGDDFYLRSMLEARLREVEKLAKDERKAARN

SEQ ID NO: 4539 - protein, 597 aa, Chromobacterium substugae
MTQSLPVHYSLRPVSPAAHLFEVSLTVTHPAKNGQVFFLPAWIPGSYMIREFSKHISGLSAASAGKPVALRQLAKNRWQADPVKGPLTLSYQVYAYDLSVRGAYLDSERGFFNGTSVFLAAEGYENDACSVDIHAPEGKSYAEWKVATSLPAADVKKKSGFGRYQASSYDELIDHPVELGDFHKVSFKACGVPHEFVVSGRFQGDLKRLADDTRKICEYQIGMFGKPAPFDRYVFMLFVGKDIYGGLEHRASTALVANRDDLPAPGATEISDGYLKLLGLISHEYFHSWNVKRMKPAVFAPYDLNQEGHTRLLWAFEGITSYYDDLALVRSGLIDEKRYLGLLAETITGVQRGAGRMKQTLEQSSFEAWTKYYRQDENSPNSIVSYYTKGSLAALALDLLIRRDSQGKQSLDDVMRALWAKWLADGKGLEEDEWEKIAIETTGLDLKPFFDLALRSTAELPLAELLASQGIELQFEAAQGGSDRGGVVEAFAAKPAPLALGVKTAPDAAGVKLAHVLDGGAAQAAGLSGGDVVVAVDKLRAVDLDKQIARYQAGDKIKLHAFRRDELMAFELTLQAAPADTCRLKPQPQAGKWIAGR

SEQ ID NO: 4540 - protein, 209 aa, Chromobacterium substugae
MPRHNPDADDDDKPVPLYRQYETQGTVRQISFYLSDEIGAAIHYTDLLYTLRTASSTDIVFLHLNTPGGNFDAGLQIINNITASPAHVVTILEARAYSMGALIFLAGDELIVHDTCQLMFHNYSSALIGKGNEQQAQVMASGKWFEKVMRHICRPFLTDEELDRIQKGEDIWLDSDNIRRRLNHIRKGEPAAQPRKPAKRGGRAEPDAG

SEQ ID NO: 4541 - protein, 236 aa, Chromobacterium substugae
MKNASVWHRLPLPDGEVPVLLTRRARKSIGIKVHGGVVELIAAPGVSQQRLHQVLELRRDWIVGHVLRQRSQLAAGAELTHLTLLGQPLPLQLAGGLRKTARRSGDALLVGGVAAGDRDGLKAVVAKFLKREAATLFPGRLALLAARCSRQPSSLQLSSARTRWGSCSADGRIRLNWRLMQAPLAVVDYVIAHELAHLLHMNHSPAFWAETERLCPGWRDARRWLRQYGGALFAFD

SEQ ID NO: 4542 - protein, 209 aa, Chromobacterium substugae
MIQQLAISILPILFAITVPAGAQAYMADHLGDRTAYMTGRRTFSPLAHIDPVGSILLPLLGVALGGFIIGWPKSLQLNAGAMRKPRSALAKVAVVTPLANLAMALLWAGLILASAHVPAYFAEPLALMALVGVKINVALMIFTLIPLPPLPGGVILQALLPQRAAWQFSRIEPYSFWILLLLMFSGLLGKLLLPLVQVIFQLIVGVAAG

SEQ ID NO: 4543 - protein, 212 aa, Chromobacterium substugae
MEIDQLVRQITIYALPLLFAITLHEAAHAYAARRFGDSTAYMLGRMTLNPLKHIDPIGTVLLPLLLLMTGGFIFGWAKPVPVNFSALRKPRQHGRWVAAAGPLANFAMVILWASLQKLASVGVGEFSEPLWLMGRAGVAINISLMLLNLLPILPLDGGRIVESLLPPRWAWRFAQTERYGMWLVLILLATGGLGLILQPFYRLMYDLIRLFF

SEQ ID NO: 4544 - protein, 480 aa, Chromobacterium substugae
MNIRQAILGGLIGGMAAGMGGAAWAAERVDLAAAGAAFPGIEQAGLKAQRSAQFPDGKVVTRYQQYYQGVPVWGEAVVEDKRPGQPAQYSGRYIAGIEADLASAQPTVKRDAALAQAKALAANGYPTRNDKAELWVRVNESGVAQLVYLVSFVVEGGRGPSRPNFFIDAHGGQVLQRWEGLAHAEAGGPGGNVRTGKYVYGKDYGPLIVTSDCAMDSGEVATVNLAGGTRGDAPFKFACPTNDYKAVNGAYSPLNDAHFFGNAVVKMHKAWFGAAPLRQKLYVKAHYGNGSEAAFWDGQALNLGDGSSRFYPPTVLDVIAHEVHHGFTEQNSGLVYQGQSGAINEAFSDMAGEAAEYYLRGRNDWLVGAEIYKQGGALRYFIDPARDGHSIGHARDYRDGMDVHYASGVYNKAFYLLATRPGWNTRKAFEVFADANRLYWTANATFNSAACGVSRAAETRGYGKQDVAQAFAAVGVVCAA

SEQ ID NO: 4545 - protein, 312 aa, Chromobacterium substugae
MSDTPNWERQLLEKLATAALVEQRRARQWKIFFRLAWLLIIGFVVASLFMRSEDKAGAGLSGSGHSAVIKLDGVISSDNDSGQKMVDALDHAFRDRNTKGVIIDANSPGGSPVLSGMVYDEIRRLKKKHADIPIYVVVSDVCASGCYYIAAAADKIFVDKASIVGSIGVLSDGFGFTGAMEKLGIERRLKTAGENKAMGDPFSPVNPKHDAIRQQLLDDIHQQFIQAVRDGRGKRLQNDPQMFSGMVWLGAKAIPLGLADGLGTVPSVARDVVKAEKTVDYTQQDDFSSRVARRIGVQFAGGVKSLFDTALF

SEQ ID NO: 4546 - protein, 449 aa, Chromobacterium substugae
MIKAPELLLPAGTLDKMRAAYDYGADAVYAGQPRYSLRARNNDFKLEELKIGIDEAHARGKQFFVASNILPHNSKIKTYMADMAPVIEMKPDALIMADPGLIMMVREKWPEVPVHLSVQANTVNYMGVKFWQKLGVSRIILSRELSLDEIAEIRQECPDMELEVFVHGALCIAYSGRCLLSGYFNHRDPNQGTCTNACRWDYKMHDTQGDDAGDVQVIQFDFNKAMEEANQSFSSCGSQQRHPLADKTYLIEEGSRPGELMPIIEDEHGTYIMNSKDLRAVEQVEKLVKIGVDSLKIEGRTKSLYYVARAAQVYRQAIDDAVAGRPFDLKLLSDLDGLANRGYTPGFLERHQTQEYQNYLTGHSKAKQSQYVGDVIEVDADGWALIEVKNRFGVGDRLEVIHPSGNRIIELAEMTRNGESVQLAAGNGMQVRIPGLQGYDSKALITRLM

SEQ ID NO: 4547 - protein, 539 aa, Chromobacterium substugae
MSLKNQTLAMLLGSAISLAAHAAGGWAATGTQAHPVRQLIPSATDNGEIASGELVQIAVSLALRNQAGLDALTAGILAGQGQPISDAQFMAQYAPTAAQVQQVVSHLQQNGFRNISVDPNNLLIHADGSAATVYSAFQTRLHRYNVNGRQAVANVATAQVPASLAGIVLAVHGLQNVHQFHAAFRAQAVAKSSAGVMAHKPADFASIYNAASLPAAKSGVAGIIAEGNLNQTVADLNSYARSAGFAAPSVAIVNAGAPSGDTSGIVEWNLDSQTILAASGGALKQLQFYAAPSMSNADIAAAINKAVSANSAKVVNVSLGECELGAQASGMTASVDQMLQAAVAHGQTFSVSSGDAGSYECGGGTAYQSYPAVSPYVVAVGGTTLATNGSAAYGSEQAWSGGGGGPSYTEAAPAWQTAAGVLSVSKTRRGVPDIAFDADPNSGELVLVAGAAYQVGGTSLAAPLFTGFWNRIQSANGNKLSSPATAIYKYFKANPALYHDVSGGGNGAFKAAAGWDYATGWGSLNVANLNSFIGKTAGF

SEQ ID NO: 4548 - protein, 542 aa, Chromobacterium substugae
MFVKQHAIALIIAGMFGAGANAAEAWVNTATQAHPVLATLTAAKATTEVAAGQSVHVAVTLKVRNKAQLDALTSSLLAGTSHKTLSHAEFMAQYAPTQAQVDKVVAHLQKSGFRNIKVAANRMLVSADGSAATAKTAFNASLRHVSVNGRSGFANSTAAQVPQSLGNIVLSVHGLQNVHQFHTTLQKAGVKTLAAAKTNSVTGHNPTDFPLIYNASSLPAATNTTVGIISEGDLTQTLQDLQQFEDSAGYSYVQTNVINAGDASSDTDGIGEWNLDSQDILAAAGGALQQMNFYVATSMTNADITAAYNSAVSDGSAKVINVSLGECESDAQSDGTVASDDQIFQTAVAQGQTFSVSTGDSGSAECGSSAGQSYPATSPYVIAVGGTTLSTSGTKYSSESVWNGGGGGPSVVEAAPAWQTKAGVLTTSKTKRGVPDVSFDADPNSGALVIVQGSSQQIGGTSLAAPLFTGFWARIQSANGNNLVSPNTAFYQYFKANTGLYHDVTSGNNGGYKAAKGWDYATGWGSLNVSALNTFIGSHSGF

SEQ ID NO: 4549 - protein, 470 aa, Chromobacterium substugae
MSVKKLIISVMLSASFFAAQLPAAMAAELPDFSGIVESEGKAVVNISTTSMVKEATADVPEGMEGDPFFEFFRRFAPPRQQERQENSLGSGFIISSDGYVLTNAHVVARAEKITVKLTDKREYQARVIGSDARSDVALIKIDANNLPVVRRADPKTLKVGEWVLAIGSPFGFENTATSGIVSGKNRQLPDESSVQFIQTDAAVNPGNSGGPLFNMRGEVVGINSQIYSRSGGFMGISFAIPIDTAMNVADQLKAKGKVTRSRIGVVIQELSKDLAASFGLAKPSGALVNALDPKGPAQKAGLKAGDIIVKVNGQDVNSGGDLQRLISDMPPGKAIALDIWRNRAPLSIKVVPEELKAEDARVAQREYRKPGSENEQSLAQIGLRLQELSPAQLQRAGIAYGLLVRQANGVALRAGIQPGDVIVGIGSDPLQSFAQLKKALEQAKNGGTVALQVMRQGMVQFVPLTIGEAK

SEQ ID NO: 4550 - protein, 613 aa, Chromobacterium substugae
MIRLRRTKQRKSEDKTMHHRISSSAVLLALASLSSHAAAEQPRNTPLQPGDPLAAQQWHLQNTGQNAFSKRGGVKGVDLNLAFTHLRGIRGVGTTIAVIDDGLEIRHPDLAANIVPGSKNLVNGSNDPTPDSPDNAHGTSVAGIAAAVGFNGIGGRGVAPSASLKGFNWLLAQTLDGWLLSHGKQPGGRPLEAFTDSRVFNQSYGSSAVRSTPGNPDQDIELKTEEETYEDVSRNSHWGRGATFVKSAGNAYSYFRAGNGYLIGYKGNEGLPVQDANLTTDNSNYWNVVVSALNADGVRSSYSSVGANVLLTAPGGEYGTDSPAMITTDLTGCQRGWNIAGSSDNALHGGNALDPNCDYNGVMNGTSSAAPATSGAFALVMSANPALNARDVRHILITTARQVDAANPGVALAFQDAGGGSHRYQAIPGWQKNAAGLPFHQFYGFGLINVDKAVEKALFYNRPLPPLEKTRWQTISAQASIPDADEKGVESVYTQPDNLTVEAVQILVDAEHSRASDLAVELISPAGTRSVLLSPRTALVAEDYGLNQQRLLSNHFYGESAKGQWRIRVIDTNGGDYQFIHRVGAKNTTYTLPNAAGKLKSWSIRFFGHRSAT

SEQ ID NO: 4551 - protein, 192 aa, Chromobacterium substugae
MRKGNQIAIAADSQTTFGDDQKLLAPYDCFHNKIFRHGDSYLAVSGSAAHDLVLQGALKDLKKKDLSSRQGIFDTFRKLHPKLKDAFYLRPEEDEEDPYESSQMMVVIANAHGIFGVYPMREIYEFSRIWAIGSGRKFAMGAMYAVYDQDLSAREIAEIGVRAGCEFDVSSSMPMSVYTVELAASAAGEVKA

SEQ ID NO: 4552 - protein, 409 aa, Chromobacterium substugae
MMKPAIARLSSWIAMLAAPAAFAAAETSDLSLRQAAIAAFAPQPSLAKQVLEPLVEESRVSADRLWVLGALTQPLPMLAGDAAADMVPPSRQFLARQTPQGWQVAPEGSEAFAALLAAAPAGWLSNDELRAWQSQAARGKRLAPDATGLGLPWQEGAAWSLTGGAHGYSGESQPYDSIDFAGGDGRVLAPLAGVIYKSCVRNGSALVKLVHDNGYSTTYYHMVKLSAAPDGQRVAKGAYLGTIGNGLPCGGSTTGPHVHFSLIHQGQAEPVHRKQIGGWQFFAGNRAYQGYAQRNGNRVNVGGRLVNYGAGDSTPAPGGVSGIATPGNGDSRVNLRRAPSLSADVAGSAARGEQVALQCHVRGEMVNGVWGRTDIWNRTAAGHWISDGFLDTGSNAPVAPPCPSAQPLW

SEQ ID NO: 4553 - protein, 302 aa, Chromobacterium substugae
MNPITSFIVAVFFLSGLLAYASSYLPLAILLWVCAAIVAQALRMANTWQKCVVLRAGKLRGVNGPGLFLIIPVVDRVVATIDERIQTTAFNAEQALTRDTVPVNVDAIIFWHVHDAQKAALAITDYTQAIDRIAQTSLREMIGSSMLAVLLSDRQGTVQALCAKIADKTAEWGITVRSVEIRDVAIPVALQDAMSRQAQAEREKQARIILGSAEAEIAGKFVEAANIYAEHPAALQLRAMNIIYETTKERGTTILIPSAMVDSLNPLAAIGKKASPRHAAAAAVANHASPLKIDLAKTGGTR

SEQ ID NO: 4554 - protein, 804 aa, Chromobacterium substugae
MSQPAEIREETTLPLLPLRDVVVFPHMVIPLFVGRAKSIRALELAMDEGKQILLVAQRSASKDEPSAEDLYGVGTIAAVLQMLKLPDGTVKVLVEGRQRATIKEVGEEDGCFVAEFSPLSSELEESNETEAMRRALLAQFEQYVKLNKKIPPEVLNSLAGIDRAGRMADSIIAHLPLKLEQKQEVLEMFDVQTRLEHLMSQLEGEIDILQVEKRIRGRVKRQMEKSQREYYLNEQVKAIQKELGEMDEVSDLDELERRIKAAGMSKEGRDKTLAELKKLKMMSPMSAEATVVRNYIDTLLDLPWKKKTKISKDVAAAEAVLDEDHFGLEKVKERILEYLAVQQRVDRLKAPILCLVGPPGVGKTSLGQSLARATNRKFVRMALGGVRDESEIRGHRRTYIGSMPGKVLQNMSKVGVKNPLFLLDEVDKMGADFRGDPSSALLEVLDPEQNHAFIDHYAEVEYDLSDVMFVATANSLNIPPALLDRMEIIRLSGYTEDEKVNIALKYLLPKQMEANGVREGELAVQESAIRDIVRYYTREAGVRSLDREVAKICRKVVTGALLKPGKTGKVTVSAKNLDKYLGVRRFDYGLAEEENRVGQVTGLAWTEVGGELLTIEAVTLPGKGNIVRTGQLGEVMQESITAAMSVVRSRARSLGIKPDFYEKSDMHIHVPEGATPKDGPSAGIAMTTAIVSVLTGIPVRADVAMTGEITLRGEVLPIGGLKEKLLAAHRGGIRHVLIPRGNEKDLAEIPSNIKQKLEIHPVKWIDEVLALALERQPEELSQEEQSADIPPAQDASGGVSVLKH

SEQ ID NO: 4555 - protein, 426 aa, Chromobacterium substugae
MADKNSNEKLLYCSFCGKSQHEVQRLIAGPQVFICNECVELCNDIIREELEKGSSSEVVGGASADRPLPTPQEIRADLDQYIIGQDFAKKTLSVAVYNHYKRLYQKSGKDDVELAKSNILLIGPTGSGKTLLAQSLARLLDVPFVIADATTLTEAGYVGEDVEHIIQKLLQKCDYDVEKAQRGIVYIDEIDKISRKSENPSITRDVSGEGVQQALLKLIEGTVASVPPQGGRKHPNQEFIQVDTTNILFVCGGAFDGLEKIIRQRSEKGGIGFGAEVSSKDDGKSLSTLFKDVEPQDIIRFGLIPELIGRLPVVATLEELDEEALVTILTQPKNALIKQYQRLFSMESVELEVRPSALRVIAKQALIRKTGARGLRSILERALLDTMYDLPSMQDVEKVVVDEKVIEKGDKPLFIYREEGGVAQSA

SEQ ID NO: 4556 - protein, 210 aa, Chromobacterium substugae
MKSMMEPQGLGLVPMVVEQSGRGERAYDIYSRLLKERIVFLVGPVSDESANLVVAQMLFLESENPDKDIHFYINSPGGSITAGMSIYDTMNFIKPDVSTLCIGQAASMGAFLLSAGAEGKRFALENSRVMIHQPLLYGGGLSGQVTDIEIHARELVKVKAKMNELMAKHSGKTMEQLEADTERDNFMSAEEARVYGLIDKVLSSRKDVTA

SEQ ID NO: 4557 - protein, 486 aa, Chromobacterium substugae
MLALPGCAWANPTAGFDRAAWQQDYQLLKQTLQQRYSHLAWMASPQSGIALPALDRQAQAALRQARDDAEARQAIIGFQQGFRDGHFSLLANTPSAAESSGRDEPAPRDLARDKPLDGCAALGYEQDSKIGFSLPFETLPGFHLTSDGLSESMRSGLADLGRAGQAAVLRIPTFSPKGYPLACQRVWRAAMPQTGAFDSEKLFQLTYRQWFADVAQRLAELRQAGARVLILDVGNNPGGNDSGDAMTRLLTPGVVRSPSLWMARSPAGKAYLDQWIEDLSSGLPASASASDKAKLQGLLQDFRQKRAELDSRPAPDMSWVWREQRRWDPQAGYSRLIAAGYASGAVAHLEPGSYSREVAETLFWPAQTEKLKGAWQGPVYIVADQKTYSAAEMFVAVSRDNGLAKIVGARTGGDGCGFMGKLEPLLLPHSGLRLRIPDCVRLRADGGDEVAGIQPDLPVPAQPGESRRARAQKTLQAIAADLLAQP

SEQ ID NO: 4558 - protein, 316 aa, Chromobacterium substugae
MDTALIPLILFLAVVVFIFKSLAVVPQQNAFIVERLGRYHATLAPGLNIILPFIDRIAYRHSLKEIPLDVPSQICITRDNTQLKVDGILYFQVTDAKLASYGTSNFIVAITQLSQTTLRSVIGKLELDKTFEERDDINRTVVASLDEAAINWGVKVLRYEIKDLVPPQDILHAMQAQITAEREKRARIAQSEGVKMEQINLATGAREAAIQKSQGEMQATINNSEGDKQAAINKAKGEAEALRLVADATADALNRIGGAIQNDGGLEAVNLKVAEQYIAAFGKLAKENNTIIMPGNVADVGGLVASALSVVKQTNR

SEQ ID NO: 4559 - protein, 141 aa, Chromobacterium substugae
MSQAITFWFACALIALIAEFMSGTFYLLMIALAMGAGGLAAWLGLAEFTQWLIASACGAAGVLLIRQRKRRHPSPPPPRDDPDWGQQVSIRSLTSPGHARVFYRGAEWDAQLLDAGLNAGDAGYICGREGNLLKISSTQPE

SEQ ID NO: 4560 - protein, 1119 aa, Chromobacterium substugae
MPSRFPARPAILALAFPFALPALAALPSGPEAVDSRALGYYRQAAAGPDSIVFVAEGDLWSVPYSGGMARRLTSRPADAYSPALSADGRWLAFVGRYDGAPEVYVMPAQGGATKRLTIDGDRGVKVEGWSRDGRVLVSSSRYSGKPDTRLYLIHPDSGERTPLPLAEAAEACLDAQGLPTLFAREPQPSDNVVGYVGGKRQQLWSWQPGREAKPAFPGHPGTSRQPMCDDGQAYFISDKGGRLNLWRARLDADGALADSQPLTHYQDFEVRGASLARTAAGSRIVFTRAGQIHVLDPRSGQDQTLSIALNSDFDQLRAKMINNPVNYLSALALSPNGDRVAVQARGYVSIFPVGAGRRVDALADSGQRARELAFSADGKSLLLVSDKDGEQEFWRVSARGGDAAEQLTRGSDSPIYQPTPSPDGRKLAYADGRRRLWLLNLGSRDKKLIRQLEQGELSDFKWSPDSRYLAYRADAANEFSQLWLYDSQEGRGQPLSSDRYHARSPAFAPDGKTLYFLSDRNLDSQVSSPWGQRDPGPYFNRQTKIYGLMLDASARWPFLPKDELAGKRAADGDDKEQDEAKGKDKDAAAKPVKIDPGLGQRLYEVPLEPGNYDNLQVDAKRLYFTRADTPEAEVKQLATLAIEAPNPTPPKPETFSEGVREFRLSADRKQLLLVKEVNKQPSLLVLPAAAQAPKELDKYTVSLRAWSLPLDPRAEWRQIFNDTWRMHRDKVHAATIRAVDWQAARRRFEPLLDKITSRQELNDVLAQMIAQVGIQHSQVGLREAGGGGEPEVGQLATDFRRAPGGLQVAAIWNGDPELLEERSPLAQPEAGIRVGDLIRQINGQPLKSEYALASALRGQVGKQVLLGIQRGDGKPRDVIVTPVSLGRDRDLRYLGWESQRKARVERETGGRVGYLHLQAMGKEDAARWAREYYPVFEREGLILDLRHNNGGNIDQWLLEKLLRRVWVWWQDGNQTLASPNPPHAFRGRVVALVDGDTYSDGETFALGLQRLGIATLIGERTAGAGMWLSDDNWSRDKGIARAASSPQFVTDAGGSRWVVEGRGVTPDIEVDNPPWASFQGQDAQLEAAIRYLKQGLPSQPAGRPQAPAGGAQGSRYQGF

SEQ ID NO: 4561 - protein, 486 aa, Chromobacterium substugae
MAGALLAASLLSGCDRIEQLVKGNSQPAPVAIPAQQDGRVAMLLPDFTQLVSRDGPAVVNIQTTRENAAPQQSSNMPFPVPEDDPLYDFFRRFMPNQPQQPDQSPEESISYGSGFIISSDGYVLTNAHVVADGGQIRVMLTDKRELRAKLVGLDKRSDVALLKVEAADLPVAKIGNPADLKVGEWVAAIGAPFGFDNTVTAGIVSAKGRSLPDETLVPFIQTDVAINPGNSGGPLFNLRGEVVGINSQIYSRSGGFMGISFAIPIDLAMQVVDQLKTKGKVSRGQLGINIQEVTQELAQSFGLQRPSGALVVRVDPKGPAARAGLQPGDIILKLNTQAIDSSKDLPMLVGALGPGTRIKLVIWRKGFEKTLEATLVEQAPDAGSPAKPANDTVPQGYQFGKLGLTLSELTQEQRADLGIRGGLLIQKAQGPAARSGLQPGDIIMGLNQNDITSINAFEKALSSAGGHAALLVKRGESVLFIALRTD

SEQ ID NO: 4562 - protein, 476 aa, Chromobacterium substugae
MSSQRMKKIAWLVAGAMAGGVLTISMQALADKEASPLPLGELRTFVEVFSLIKQSYVEPVTDKKLIDEAIKGMLTGLDPHSDYMDPEEFKELREGTQGEFGGLGIEIGAEDGLVKVVSPIEDTPAQKAGIKSGDLIIKIDETPVRGLSLNDAVKKMRGKPGSKVTLTIARKSETKPLIFTLARAVIKTKSVKYKMLEPDYGYVRIAQFQEHTAEDLAAGLQKLYKDNKQPLKGLVLDLRDDPGGLLNGAVGVAAAFLPKDKLVVYTEGRTPDAKMRLTATLQNYAGIGGSDPLAKLPADARNVPMVVLVNGGSASASEIVAGALQDQKRAVLVGTQTFGKGSVQSILPLGSQGGIKLTTARYFTPSGRSIQAKGIVPDVVVEDATLTAADQALRVREADLENHLANPNGDDKPAKAAKPAPKLVPPPAAPEKGKEAPAPDDASQFGPRDPSPKNDYQLSQGLNVLKVQQILQKRAD

SEQ ID NO: 4563 - protein, 223 aa, Chromobacterium substugae
MKLLALDTSTTYLSLALSLETETLVFHECVAQKHAERTLPEVSRLLAEAGVALSSLDGIVFGQGPGSFTGLRIACGLAQGLAYSADLPVTGIPTLDNLAWQAGEGQVLVCFDARMQQVYTALYQTGADWRRLSPISVMSPEDIRLPAGTTLLAGDGFDSYPQLLADSRAQLPLSPFPRPHAEAYIRLAESGRYPAGHPREAELLYVRNKVALTSVEQQQVRSR

SEQ ID NO: 4564 - protein, 364 aa, Chromobacterium substugae
MDKRLPAVAAALLLAASAAHAGDLQVSLGQPVVSAGQDVDVALTYRNTGKETLHVYRWFVPGKELQEQFLAVNVNGKPAEYLGPRYKRVVPSLRDTVALAPGATLNAKVRVSEYYDLSKPGQLSVRFESSSNKVLNRSLPAGVNAKQAAAPQADEAISSNVVGAYSAGSVSPLLTKSKAAKQEWQVLSRSAVSGVSYAGNCSVSQQSQSRDGVLAASAMASETAAYLAGTPSGTPRFTTWFGKYSQANWTTAKSHYVNIKDALDSKPIKLDCSCTDGGTYAYVYPGQPYTVYLCGAFWTAPTKGTDSKGGTLVHELSHFTVVAGTQDHVYGQAGAKSLAKSNPAQALDNADNHEYFAENTPAQQ

SEQ ID NO: 4565 - protein, 637 aa, Chromobacterium substugae
MANAFKIKMVVAALAAAVSSSAMAAAALDLGKVEQAAPSKTLTVTVALNLRDRDAATRYLQAVHSPADANYHKFLTPAEFRSRFAPNDATVNRVSARLQAAGLTVKRIGSTLLQVSGPAATVQQAFGAEVHVFQNKTAVQGTARYIAPVRAGTPKVDLSDVQAVIGLDSRPHFRPHLRQVPNHLQPSLSKGASAVTSGNAPGQWTVTDLARHYDITPLYNKGIHGKGSTIGIVTLASFTPSDAFQYWSAVGLSTDPNRLSVVNIDGGPGAPSDAGGSDETTLDVEQSGGIAPDAKIIVYQAPNTTQGFVDAFAQAIESNAADTVSVSWGEWEWFDQQSQAVDPVNGKTTNVLQAYHDLFLQAALQGQTLFAASGDSGAYDVNRAAPLPQYNKVLSVDSPANQQFITAAGATTVPTTLTFHPNGKEMKVKISSERAWGWDYLSGLCKALGKDQVACGIFPVGDGGGVSGFISRPFYQNWIPGMQNTPAGQQLVDTSQTPPQVIGSIPANFKGRNLPDISMNGDPETGYVVYYTSDKTGFSIQSNSGGTSFVAPQLAGITALLNQSMGGRLGLLNFSLYSLLATGHAYHGSGHHGAPLRDITAGGNWGYNAHRGYDQATGVGAPDVANLDAALHRYFWF

SEQ ID NO: 4566 - protein, 291 aa, Chromobacterium substugae
MDALQDFLRRAEAVLTRLEPMLPPPRREPDWSAQAFRWHRQGLAGWLEAVCDPHTVELARLTQVDSQREQLLANTRQFVAGLPANNALLTGARGTGKSSLVKALLPLFGADGLRLIEIDREHLADLPQLVELVAGRPERFILYCDDLSFEHGDAGYKALKSALDGGLSRRCDNLLVYATSNRRHLLAEQMADNREGWLKDGEIHPGEAVEEKVSLSDRFGLWLSFYPFDQDAYLAAVKEWLGHFGLKYGDKAERAALQWSLTRGSRSGRVAWQFASHWAGSQRLAKQAGKK

SEQ ID NO: 4567 - protein, 80 aa, Chromobacterium substugae
MYKVLLLNDDFTPMDFVVQVLQQFFHMNREKATHIMLQVHTQGHGVCGVYTKDVAATKVEQVLQYAKAHQHPLQCVMEEN

SEQ ID NO: 4568 - protein, 759 aa, Chromobacterium substugae
MIAQELEVSLHMAFMDARRKRHEFISVEHLLLAMTDNPSAAEVLRACGANIDQLKKQLSDFIDEHTPTVPGETEVETQPTLGFQRVIQRAILHVQSSGKKEVSGANILVAIFGEKDSHAVYYLHQQGISRLDVVNFISHGITKQRSQQPPQEPRDNSGNDVENEEQSTGPGGALENYTQNLNQMARDGKIDPLIGREHELERTVQILCRRRKNNPLLVGEAGVGKTAIAEGLARRIVGGEVPEILAKSTVYALDMGALLAGTKYRGDFEQRLKAVIKQLTDDSNAILFIDEIHTLIGAGAASGGTLDASNLLKPALSNGSLRCIGATTYNEYRGIFEKDNALSRRFQKIDVSEPTVQQTVEILKGLKSRFEAHHGVKYTQSALSTAAELAARYINDRHLPDKAIDVIDEAGAAQKILPKSRQKKVINKSEIEEIVAKIARIPPKTVSSDDKNVLKNLERDLKNVVFGQEKAIEGLASAIKMTRSGLGNPQKPIGSFLFSGPTGVGKTELARQLAYILGVELIRFDMSEYMERHAVSRLIGAPPGYVGFEQGGQLTEAINKHPYAVVLLDEIEKAHPDIYNVLLQVMDHGTLTDNNGRKADFRNVVLIMTTNAGAESLSKPALGFTQTKVAGDEMGDIKRMFSPEFRNRLDAIIPFGVLDEQIILQVVDKFLMQLEQQLAEKHVDIHFTDELRRFLAKNGFDPLMGARPMARLIQDTLRKALADELLFGRLVGGGEVTVTEADGKVELLFDQPALAAEPA

SEQ ID NO: 4569 - protein, 642 aa, Chromobacterium substugae
MTPEAAGERRWPALLALAWCALPLAWHLPPWLLALFWLALAGRAWLEAGGRGLPSRWLLLPVLLAAVAVLWLSLRTLVGREGGVALLALLIAFKAFETASLRDWRVLLALGFFLAAMPLLFDQSPLMAGWLVACLLLLTWATAALAGQLPRGSWRSAAQALLLSLPMMLVLFVVMPRLPEPLWSMPGQEGAAASGLGDSMAPGSISQLILNREPAFSAVFAGAAPPQDQLYWRVMLLDDFDGRRWLNVGGERGESLPPALGRRVAYSLTLKPDRGRLPALDLPQQAGGDSHLEAGGLLRQDEKRDELARYALASSLGGRYPAALSAASQAFYRRLPPGNPRSRALAQRLARQAGGERAFAGEALQYLRLGGFRYTLRPPLLGEQAVDQFLFDTRQGFCEHYASAFAFLARVAGIPARVVVGYQGGEYNPVGRFWQVRSSDAHAWVEIWLSDTGEWQRVDPTAAVSPARVEQAAEQALPGLSGGAGVSAILPPGWLRSWRLQWTAVNFAWQQWVVGYDASRQQRLFQRLGLGARVDAGSVARGVSAGMLLATLPLLLWWRRRPAQAPMAEGWRLIRAGLARRQIPTTAAQGPLEVLKAARGLPLDDYRGLKRLVDDYMALRYRRSEPDAAEERRWLRRARRWK

SEQ ID NO: 4570 - protein, 252 aa, Chromobacterium substugae
MRRTLDLLPRAERQAAAVLLVSSLCMVWLQYPANRYWMLETLALAQPRAADAFRAAVIANPHTELFRAAYWALASIAGYALLPLLHIKLKGERLADYGVAWPDRAALKTDLKLFPLFYALMLPLVWWASAQPGFLAIYPFFRLSPGETLWPHWLLWELLYFAQFAALEFFFRGYMVHGLKPRLGWLAIFVMIIPYCMIHFEKPALESLAAILAGAALGWLSYRYKSIWLGVALHCSVALTMDLMALWRKGLL

SEQ ID NO: 4571 - protein, 278 aa, Chromobacterium substugae
MKLPRLALCLSLLSTLAHAAPLSKEHRILFFGKDDRVLEHPDHMPWQTVGQLETRSRTICTGTLVAPDVVLTAGHCFVDEKGRFDPAVSFTVGLWGNEYQALSRIKEVQVDKAFLKGLIHKRDGLYIPPRIAPRDFAFVRLATPLGHSQGTVPVFSGDAQALKTLLAKQNWTITQGGYPVDDQRHLRVHHGCKATKLRDDGRLTHRCDTLEGNSGSPIFVIDAKGQATIVAVQSSAPPASRRKLEDNMSVSAPMFRQALQAFIAKSAKPAKPAKSARP

SEQ ID NO: 4572 - protein, 139 aa, Chromobacterium substugae
MSSSTKPYMIRALHQWCGDNGYTPYVVVWVNERTDVPLEYVKNNEIVLNIAEGATKNLRIDNDWLSFSARFGGVSRDIWVPIGNVMSIFARETGEGMGFEVEPSPEAEQDAKPVDADPPKGGDPGPDRPSGRPSLRIVK

SEQ ID NO: 4573 - protein, 338 aa, Chromobacterium substugae
MPASQRLPELVCPAGSLPALKAAVDNGADTVYFGLKNDTNARNFAGLNFDDHTARIGIRYARERGRQVLMAINTYAQGGDISRWQRAVDQAADLGVDAVILADLGLLDYARRRHPALRLHLSVQGSATNHEAIRLAHELFGIRRAVLPRVLTLEQVRQVIARSEVEIEVFGFGSLCVMVEGRCLLSSYATGESPNSHGVCSPAKFVEWRHTPASLDARLSGILIDQYGPDQPAGYPTLCKGRFAVQGDTYYALEEPTSLNVLAMLPQLLDAGVAAIKVEGRQRSPAYVAQVTRIMREALDAAGRERQRFTPQPAWQHGLAKVAEGRQQTLGAYDRPWK

SEQ ID NO: 4574 - protein, 298 aa, Chromobacterium substugae
MLFFWSRDEILRFYAEAAEWPLDAIYLGEVVCGRRQQLRGQDWIALAADLAAAGHEVVLSCQALIESESDLKRLARLADNGQLTIEANDLGAARLASERKLPFVAGHHLNIYNTDTLALMLRLGARRWLPPVEMGRDALAAILAEAARRQLDIETEVFAWGRLPLALSSRCFTARHYNLNKDDCRFRCLEHPDGLRLATRDGQGFLAINGTQTLSDGCQALLPHLPAMPPLGVDRVRISPQAQGTAAVVSVFRRMLDGHGDAAALMAELAPQAPGAPVDGYWRGLAGILPLETSDAHP

SEQ ID NO: 4575 - protein, 912 aa, Chromobacterium substugae
MRIQTLGLLLALAVSQAAPARAAALPAPYASVEGVSEYRLDNGLRLLLAPDASQAAITVNLTYLVGSRHESYGETGMAHLLEHMMFKGTTRIANVMDELSRRGMQANATTFLDRTNYFETFPADDDNLAWALRMEADRMTDSRIARADLDREFSVVRNEMEMGESDPFRALWKQLTAVSFDWHNYGHNTIGARSDVEKVRIDNLRAFYRKYYQPDNAVLVISGRFDPARALALTRDSLGAVPRPARALTPTWTEEPQRDGARKVTVRRAGDTTLLAALYHASAGSHPDWAALQALDHILTNAPSGRLYQALVDGRHAVKVSALSPALAEPGYVSYWATLSKGQKPAEARRVMLATLEDIRRHPIVQAELDRARAAWLNQFEQTVSDPQALSLALTEAIALGDWRLFFLERDRIERLTVADVQRVAENYLKPSNRTLGEYLPTPHPDRSVIPPAPDVAAMVKDYQGKPALAQGENFDPSPANIEQRSRKLTLDNGAEAALLPKQTRGHAVSGYFSFAFGDAEGLAGQRLASRLTAAMLDKGAAGLSQADIANRIEQLKSSLQISGSGQEVRVGFTSQRDTLPQLIDLIARLLREPSFPPAEFDKLREANRTRLAALRDNPQAQAARALGQRLNRYPAGDIRHVPALDEELAELNAVGLEQLRRFHRGFYGAGQARLALVGDFDADAIGRQLNQRFGDWRSAAPYRRLDDKLPQPQAGRQLLQIADKANAAYLAALPLAVQDTDDDYPALLLANHILGGESQSRLFQRLRQQDGLSYGAGSALSVDSRQPVASWQLYAIYAPQNLAKLQHGVGEELARLLRDGVSAQEVADAKRSLLQSAQLARAQDDTLSRMLSQQLDQGRDMAFQAALERKLQQATPADVNAALRRYLKPASLVEVYAGDFAAKAPAALKRD

SEQ ID NO: 4576 - protein, 200 aa, Chromobacterium substugae
MVAAEYRLAPENPYPAGLNDAASVVKGVWDVLDERRLPYRRQLALAGDSAGGALCASLSGKAAADGAEPGIARQVLIYPCVDYTLAQPSVAENGDGYFLTANRTEWYFDQYFQHDEDRRQASPLYWPAAPNPPATLLITAGRDPLRDQGLQYGNQLKAAGAQVEQLHLDDQMHAFLNMEALVPEVCQLVYRRIGAFLNAE

SEQ ID NO: 4577 - protein, 194 aa, Chromobacterium substugae
MKSHIHASLSEAKSALDNLLDNAEALAGIEAAGAAIIAALEAGGRVFSCGNGGSMCDAMHFAEELTGRYRNNRRGMAAIAISDPSHISCVGNDYGYDEIFARYLESHARAGDVLLGLSTSGNSRNIVRAAETARELGVKVIILTGRAGTKLEPLADVYVNTPGGQYADRVQELHIKVLHILIELTERHFFPENY

SEQ ID NO: 4578 - protein, 254 aa, Chromobacterium substugae
MEFYMENSLQQPDFRQRLELLIGAEKPYAWAARMGINKGSFTNMWYKGGVPRLATAQKIASSSGCRLEWLLHGEEPAQADAAAGAAAEEIAVEAARLEPMRGSEDEHFVPDGVREEFCFIPRYNLRASAGFGTAACDEQPLFYMAFRRYWVKNHLNASPRDLAVISVKGDSMSGVLEDRDTILINTAERHPGEGLFVIRIGEDIFVKQLQRLPGGAVQVKSANPLYETFTVDLARAAGEFEVIGRVVWFGRQIA

SEQ ID NO: 4579 - protein, 139 aa, Chromobacterium substugae
MNATAHFPALPATMQLVAQLIGMPRTLQLVQALGGTTLPFSKNQSRAGQLRFAALVDVIGQDAAELLTRHFGGDILYIPRCSQALRQARNQQLIRDFDALLIDGLGANEAVGLLAMRYRLSDRMIWRVLKTPPAPHEVH

SEQ ID NO: 4580 - protein, 134 aa, Chromobacterium substugae
MASRAISDLHPQLQPLAEAFLRRCRDQGVDPLLTCTWRSPAEQDALYQQGRSKPGPIVTRARAGQSAHNAMLHGSPAALAFDVVPLQAGKPVWDADHPHWQVMGQIGLALGLRWYGAADAPFREYPHFQLTQET

SEQ ID NO: 4581 - protein, 73 aa, Chromobacterium substugae
MRLSDLVRGPHSRRLSHSRLWANVACAAATAMFVVDGWRGTLTPDLWLIYLGVVGGYSASLRLISAYRGRSPA

SEQ ID NO: 4582 - protein, 187 aa, Chromobacterium substugae
MMPAAALRLGACLLLPLAAGAGGYALGSQRSGQYWQARLQASVSQLQADDSRAAEQRQQAALMQQQQWRQRIDQLEDSLLRQQQARQAQQRQQAQRIDDVTRHDGSAFTGLGPDGLRLYRQLLGYPAELPGAQPLPAGNAGQAAGAGGGLPAPDLLAHAADYGAWCQQLEQRLAALKQLYAPQEPTP

SEQ ID NO: 4583 - protein, 65 aa, Chromobacterium substugae
MTDFFDRASELETEFREQALARHFQQLQHGGYSHCEDCGDPIPQARRVALPSCTRCVICQQLAER

SEQ ID NO: 4584 - protein, 71 aa, Chromobacterium substugae
MEHDNLLALGRIEGKLDMIVAHLAKQDKKLEELDGRLRDVEVQAAKSGALSGALSALLVTLAGELLKRALH

SEQ ID NO: 4585 - protein, 231 aa, Chromobacterium substugae
MLISVQTAIADRLRQGLGRMVREVAADLDETALCGLQLAHGDYASRLTPGQASPVINTQALARLPALWTVAGGIAASTPQASQRQRYKANAQFTVIVGDRLQADAGYAGAGVWQLVYAVRRLLASQDFGLAIQPLQPEKVRPLGQTPRDGQPWSLVACDFATYWLDEALDNGRWPAPQGDADPDALFRSFGGRLEDPAKDWQSTQLNYSLAGNPTLKAQDTLIQPAPKPAP

SEQ ID NO: 4586 - protein, 481 aa, Chromobacterium substugae
MASPNISFDQIPASIRKPGKYFEFNTKLAVRTLPGNPQRVLLIGQRLADDPANPGKNATQPALSALDVFSDEQAAQAFGRGSYAHLMARAAINANPYLQLTVIAVDDAAAGVPAAGSFTFSGPAAAAGVMSLYIGAVRVDVAVAAGDDATKIAANAQAAIAKLTDLPVSAAAAKEVLTLTARHKGGIGNGIALKAQEQIAGLTVAIAPMKGGAGDPDIAPALAAVVSGGHQIVVNPFNTDAALAALRTHLDFVSGPLEQRGAIGVIATVGALADAAALSAKLDSGRITAAWYRGSAKLPGDIAAAYAAVLASEEDPARPLNTLELKGLDVVDLASRTSRTEQESALYSGVTPLEVAAGNRVQIVRAISTYTKDAQGVDDVSLLDITTIRTLDYVRRACRERIALRFPREKLSDRTPSKVRSELLDVLYKLEELEIIEQVDANKDGLIVERDLQDANRLDAKIPVDVVNGLHVFAGRIDLLL

SEQ ID NO: 4587 - protein, 123 aa, Chromobacterium substugae
MALKEYAGSIVLEVNGQEIDVIDLNVSSKTGRKLVKTMNSSGRAKGFSRGVTEYDLSITVSIPLTGDLDWEAIEGAKLTEFPLAGGKRTSYLDCFTMEVGEKYGVESEARRDIKLMSLRKVVE

SEQ ID NO: 4588 - protein, 561 aa, Chromobacterium substugae
MPIEKKPQKASIKNTYSRGKDKRLSTDKTSSQKIAETLFSQENSDPSPPETKSIFSNQQVSDSKSILEGFLDAITKEHGELSAPGALAKAGKDRLKLLGNIDNATKVLQHVIAGNDDEAIVQLSRIIGEYAGDKIGGEIGGKLGAAGGSLIGPEGTVAGGIAGGTYGAMYGSQKMGDIAERIAREQLNYVVSNDDVPPTIEKKDGGKYFLAKHGENYQWYDAPPQEATQSRSVGSLASSNEKKYKPVKDEKLTDELTQEYAEKTGYINRRIKEQNKKNQEDRRKNIKRGLAPDGKEFNKQYTTDGKGVHASQIWVEDKKKNQLIGVNTVDTQGKSISSADYYDKETGRHLGTETAITEGGKTTKSSTLPSDKNSPPSPKPHKISAKPKNTPNSADNKKEKTNSAPNIQKRTPQKNTALGLNEQQSPVQKGIANSISPATNSATEPNAIEKDPNPNVAAATEEQVVKTHASGQLSTVADEMPDKTKTPAQDTTLSPHGQTDKTQIPAPSTGGNSDSQLAALIAQLSSALAQLTQPIRVVVDVQHGNIIAAVNAANSQQQRRS

SEQ ID NO: 4589 - protein, 434 aa, Chromobacterium substugae
MFSLNLSAGTAAGSLVDASFRGVRFDCLKSQDSAQRDQAMHEYPYKDGADVEDLGRKARKVTLNAMFWGEGYQDRLREFVAALDAAGPGELVHPVFGSMPQAQVLDYQISHDADAPDSCAVDINWVEATPGNPFFAQHKPLQQSEAIDAKVDELRGMAGEAYAKAQELVATAKGALARLGALRQQLVATVKALADMANQAVAQVNDLLAYPQAFVSEVNGLVDQVADWKFDQALDLGPLPALKTAASLPAATLADWNALRRRLDGLPERIRQNTTPLTASAALTVWSSDQQRIDALLQLNVATKLASAASGIFGSEAERPTLTPPALEQIAGDVRGSLQTAIDQWRANMPADAAYRVVDSLRELGLQVQQGAAGLIAAKPPLIERAVEAEANLRQLAHLWYGDSGRADELLRLNPQLAYPNHLTPGTVIHGYAR

SEQ ID NO: 4590 - protein, 353 aa, Chromobacterium substugae
MATPAKPAAADHAVSLQIAGRRHSDWTHYSIDSDLAVPADGWQVALGLPGGVFPPEVEPGAMIQVQVGAETVLMGRVDDISHSVAAGSHQLALSGRDLAGMLLDCSAPLLTAKNMTLRDVLENVVKPLGIARIRVDAKGSRPLEKISVDPGNSAWDVLTRAAQANGLSAWFDPDGTLVVGGPDYSQPAGARLILRRDGQGNNLLSLAETRSHAQRYSELTLLGQGHGQALTPGRHAMKHHSFDSDVCYHKPRIQVEPDAASPAELAARADKMLADSRLAGYTLSATVAGHRDSRGMLWTPGQRIEVESEPHGINGVYFLMARTFEGGRGQGSVTRLTLKEDKCWIPVMRAGKQ

SEQ ID NO: 4591 - protein, 228 aa, Chromobacterium substugae
MWHEVDHRIRRAFSNVRQGFRAALTHVDSAGAVQTAQAEGLAGEQLQDAELFQHYGYTSNPPPGSMAMVLPLGGRTSHSVVLATEHGSYRLQSLQPGEVALYSDEGSKIVLKRGKIIEATCDHFVLNCQTMQVKASDSIALQCQTMQVNADQQAAFATPTLQTSQQLVAQGQISGNGGLAVQGGGGASFSGDIKLSGAMNASGDVNAGGKSLVSHIHDAPNGPTSPPK

SEQ ID NO: 4592 - protein, 116 aa, Chromobacterium substugae
MDPLLDPATGDYAGTSTDTLANAVYLRLMTPLGGWWADPTLGSRLHELSRAKDSGRVDLLACQYAEQALQPLRQDGRASRIEVSSSRQGPGRLLLQIRVAEAGGRTRHFQHQVRIA

SEQ ID NO: 4593 - protein, 362 aa, Chromobacterium substugae
MPLPTPDFASIRDTLLRDLQNLRADADTGPDSDFFVRASSVASAAEGLYQHQSWIARQIFPDTADSEYLEQHARLRGIVRKPASAAAGKLQLSGNPNTMVNGSLQVRLGDQLYATPATGGDGGPYAFQLDANGQATVDIRASQPGPAGNQPANLQVDLMQAPPGVAGKALLLSMGGAVDVESDQALLERLLELIRRPPAGGNQHDYRRWALEVKGVTAAYVYPLRRGLGTVDVVVTANNDLPSADTLAAVQAHIEDLRPVTAKSCLVLAPTPRAVDIDLALNLGGISPDVFTPQLQQTLQAYFAGLAPGERLVKSRIEALISDLPGVQDRQLNAPAGNVAPVSDAGKVEWLRLGKLTLRAMP

SEQ ID NO: 4594 - protein, 192 aa, Chromobacterium substugae
MMPQPPYQELLARLLPPASYSPDGPRLQAELASEGAALDRAQNSARQLAGAVTPLAAETLLPDWERVCGLTPPADAPYQQRQQAVLAKLAETGGLSISYFTRLAAGMGYRIRIDEPQPFRAGVNRAGQPLWSADIPWVWQVTVYGSKVRPYQFRAGQSLAGERLTTFGDPRLEELFNDLKPAHTFVYFAYQP

SEQ ID NO: 4595 - protein, 388 aa, Chromobacterium substugae
MQDPIKPVPSPDQKFHDGNPATGELGTIVSADWLNTLQSATQSTQQELVTVIQNSGQKTDPARQDQLLQAMQNLAWGGAQRPSTLAGYGIAIASQAEAEAGSDNSKAMTPLLVGQALNAVGLSGYAKPLAAGSLQTVRPNGLYHIDNNLVDGTPVKSNGMLLANFLSPLWGSQLYSAWGGATYEQRLENGNWQPWIRLLKSGQQSTMADYGIVDGATLAQLKAATAFAGAVLHFAMPNAPDGWLKANGAAVSRSQYAALFAAIGSTYGAGDGSTTFNLPDLRGEFIRGWDDIGKTDPDSPKRKVGDRQAQQTATHKHVIPWGENIAVNATAFGGTNNVGRMGSVANDYDNRWYYSNDGSDFDGVLNPPDTIGSETRPRNIALLACIKY

SEQ ID NO: 4596 - protein, 121 aa, Chromobacterium substugae
MWRKQTAQAIQAQIGDTPDSLQATALSPPPFAIWRGDGWSVDEATQLATQTVAAQQQLQRKLAAAYQSRRPLEDASELGVATTDEQARLMDWKRYCVALSRLPQHPGWPRLADADWPNQPA

SEQ ID NO: 4597 - protein, 462 aa, Chromobacterium substugae
MKLINSADGLFHDGNPYSGELGTVVTSDWLNGAQSAIQATQQELLTVIKSNGQKTDPSRQDQLLQAMQNLAWGGAQRPTTLAGYGIADAMKASDWGVQGYTTLQVGPGKAFAGIQDAWDSLIGKVLQADVLIQIADGQYATSGITLTHQPFASRIRIQGNVANPSACKIILVPDANKLSHGVIFSRVQGVNFSGFHIVGEAGANHWSHRCLRVEEASVVYADAGSIVLEGAGNGLELDQNARGNFERLRVLNCKNCAVLVGGGAHAWLPSSTLIGLGRYAETVVPAFVNVDTPKFRPMGLECQEGSKAWASDSSISNVDIGYMTTRNSYLWCDGTAVDQSNIGMYAQYGGVCWSCGAQARPSLPQGRRSKVTNSGKGYYAEFGGIINADMAVAENCEHGFFATWNSVMTVSNGWARNCTKGGYHAEMASTIAAYNTDTTGTATAYDPNQNFSNWNGIVVTKI

SEQ ID NO: 4598 - protein, 334 aa, Chromobacterium substugae
MQDPFKPIHSADGLFHDGNPTTGELGTVVAADWLNGMQSAMQATQQELLTVIQSNGQKTDPARQDQLLQAVQSIAWGGAQRPTTLAGYGIADGASKTDLKSAIDGVVAGAPGALNTLQELAAALGNDQNFAASIAKLLAGKADKATTLAGYGIADGATSTQVNAAAPAGMVAYFAMKDAPAGWLIADGRAVSRKDYPALFAAIGGLYGNGDGSTTFALPNLCGEFIRGWDNGRGVDTNRNFGTSQTEGIRDHKHAGLINSPYGDNWNYIYGYKNNGPTAPSGGVGAFPGNQTLPQITPVSHDGNPNNAIQTYITLNAASETRPRNVALLACIKC

SEQ ID NO: 4599 - protein, 296 aa, Chromobacterium substugae
MMLYDLAAVGAAGCWALGAMLGATPSRHFGPFAFTRLRLTLLTVLLGGYSLLSGGWYTLSAASLWPALLSGLTGIFLGDTVMFASMNRLGPRRTGLLFATHSVFSVLLGVLFLSERLSAGALLGSVLVFGGVLLAVAFGRREVDAHAWERNDKLAAGVALGLAAALCQALGTFFAKPAMAAGLEPVTASALRMGVSCGAHYLLWLSGWKLAKSRGPYTPRMLGQTALNGLVALGLGMTLIMLALQRADVATVGILSALSPVLILPMLWVALKRPPPPLAWLGAAVSCAGTALVVLR

SEQ ID NO: 4600 - protein, 213 aa, Chromobacterium substugae
MTRKQFWSDPYQAELATRVSRVDGARVWLEETIFYAFSGGQESDSGSIGGHPVRLAEKQGADIAYTLDAGHGLQAGDAVAVAIDWPRRYRLMRLHFAAELVLEVICRAVAGVAKIGAHIAADKARIDFALDQPITPWLAGIAAAAQALIDDDLPINSAFSDEAAGRRYWELPGFARVPCGGTHLKRSGEVGRIALKRRNVGKGKERVEIYLLD

SEQ ID NO: 4601 - protein, 153 aa, Chromobacterium substugae
MAWEVDTCPERLDRDMIHRYLAQESYWARSLPREVLERSLAHSLCFGVYAADGAQIGFARVVTDRATFAYLADVFVLDAWRGRGVGKQLVGAALAHPDLQGLRRMMLATADAHGLYAQYGFAALSRPERLMEKLDQDVYLRKAAGGDAQAVLE

SEQ ID NO: 4602 - protein, 147 aa, Chromobacterium substugae
MGRNKHLACKQVTTARRPMFYGISLPNCLQLAVASQSKNSQDIGLPFRRRRHEPLTLLRNLLFALLLLAIALWCYGSWRQQPQLVDAALYLGDALVMSGAYLLPAITAALVKSPRLKKVALINVLGGWLILPWIIAMGLALKRDDLA

SEQ ID NO: 4603 - protein, 397 aa, Chromobacterium substugae
MFQHVDAYAGDPILSLVEAFGKDPRQQKVNLSIGLYYDEAGRIPRLKAVEQAEALLASQPQPPCTYLPMDGLAPYRAAIQTLLFGAEHPAVQSGRIATLQTLGGSGALKVGADFLKRYFPASHVWVSDPTWDNHVAIFEGAGFTVERYPYFDPATRGVDFPAMLAKLQTLPAKSVVLLHPCCHNPTGADLSDAQWDQVVAVAKERQLIPFLDIAYQGFGADLEQDAYAIRAMADAGVACLVSNSFSKIFSLYGERCGGLSVVCDDAAEAALVAGQLKATVRRNYSSPPTHGAKVIAAVLNSPELKALWVAEVNEMRERIQAMRGVLVQVLKEALPQRDFEYLKDQRGMFSYTGFSQAQVDKLREQFGVYLVGSGRMCVAGLNTANAPYVAESFAKVQ

SEQ ID NO: 4604 - protein, 409 aa, Chromobacterium substugae
MMQELLSPLLAYSGSYRDGLSNHLPMELQALAELGADEGRLRRLAARHGHLERLRDDGRDIADSRGWLSDPASEAAWRRRLAWERRQGEWLRHWAGRLQLALAAPAGASFHGLIRLAYAWRSGVEEEIDAALAYALSHWRLLDLPGRSPAMQTLPDLLADWTASPILLPPQGGLISDDIERALALPALSARLPPGLLGSAREQRRHCRLLFLATRDLDALHLITAWEAALSLARAQGLAEVADGTALQMQAALIGVFVYCGCPALAARPPQPRRDATRRRGHPPPGAGLVGPAWRQAGAQQLAPGGAGRRRGLAWAGGPPRRCSLGRKCETAARGCRFWLGRGGLQRVAGENVAPGHVLRQVYHREQHQQRQAQREDAEHGQQQDGQEIDQQRAPVLLHGAYAQLQRWP

SEQ ID NO: 4605 - protein, 293 aa, Chromobacterium substugae
MSHPIPRRLFLLSAALLPFASLAAPAIADRRASAAARLAALEADFGGRLGVCALDTASGAELGHRAGERFPFCSTFKAMLVGAVLARSAKQPGLLAERIHYARRDLVEYSPRTEPHLADGMTVAELCAAAVQYSDNSAANFLLKLLGGPAALTAYMRSIGDESFLLERWEPELNRAVPGEARDTSTPQAMAQSLRRLALGDALAPHAQRQLVEWLRGNTTGAEKIRAGVPAGWVVGDKTGNGRYGSSNDIAVLWPPGRAPAVLTVFTTQALEDAKQRHQVVAAAARIAADWLA

SEQ ID NO: 4606 - protein, 254 aa, Chromobacterium substugae
MADILPKMIDIPAGEWRTDACPGWKEGRVCAPEKYARQTLQIASFQLAATAVTFAQWDACVEDGGCQEPDTGWAYQTRPNQPPCQAGGPCNYPYDEGWGRGDHPVIHVSWKDAQRYVDWLSQKTGQRYRLPTSEEWEYAAAAGSRARFAWGAKLGKNRANCDGCGSRWDGKKTAPVASFAPNRFGLYDMVGNVSEWVSTCVPIRSRRGEDNQTCMAYLYRGGAWSYDAKAVGVDTYNWIDADFRVNYIGFRVAR

SEQ ID NO: 4607 - protein, 510 aa, Chromobacterium substugae
MSILNIVPGRLTLADLRRVSRETGLQLRLDPSSHAGIDASAATVARVLSEGRTVYGINTGFGLLASTKIATDELELLQRSIVLSHAAGIGAPMEDSSVRLVMALKINSLARGFSGIRREVIEALVTLFNRQIYPVIPQKGSVGASGDLAPLSHMSAVLIGEGEAFVDGVRVPGSVAMRSAGLAPITLAPKEGLALLNGTQASTAFALEGLFAAEDLYVSATVAGSLSVEAALGSRTPFDARIHEVRGHQGQIDAARLYRELLEHSQIEQSHENCGKVQDPYSLRCQPQVMGACLTQIRNAAEVLRVEANSVSDNPLVFADDNDILSGGNFHAEPVAFAADNLALAIAEIGSLSERRMALLIDSNLSKLPPFLVNNGGVNSGFMIAQVTSAALASENKSLAHPASVDSLPTSANQEDHVSMATFAGRRLKDMAGNTAGILGVELLAACQGIDFRAPNKSSAKLEAAKGMLREQVPFYDKDRYFAPDIEKAAALVASGRFNGLIDGAALPSL

SEQ ID NO: 4608 - protein, 556 aa, Chromobacterium substugae
MTDPRHDPSRVIRAPRGNQLTCKSWLTEAAYRMIQNNLDAEVAEHPQSLVVYGGIGRAARNWECYDKILETLRRLEDDETLLVQSGKPVGVFKTHENAPRVLIANSNLVPHWANWEHFNELDKKGLMMYGQMTAGSWIYIGSQGIVQGTYETFFAVANQHFGGKPQGRWILTGGLGGMGGAQPLAATMAGFSMIAVECDETRIDFRLKTRYVDRKATTLDEALAIVEDAKQSGKAVSVGLLGNAADVFAELVARGITPDVVTDQTSAHDPVHGYLPQGWSVAQWRDKQKTAAAEITAAAKKSMAVQVRAMLTLQARGAATLDYGNNIRQMALEEGVHNAFDFPGFVPAYVRPLFCEGIGPFRWVALSGDPEDIYKTDQKVKELIPDDPHLHNWLDMAKERIAFQGLPARICWVGLKDRARLGQAFNEMVKNGELKAPIVIGRDHLDSGSVASPNRETESMKDGSDAVSDWPLLNALLNTAGGATWVSLHHGGGVGMGFSQHSGVVIVCDGSDAAAERLGRVLRNDPGTGVMRHADAGYDIAVDCAKEQGLDLPMLK

SEQ ID NO: 4609 - protein, 310 aa, Chromobacterium substugae
MSIDMSGWTGRIDKGEGDGARRWHQLVQPLAEGAAPGVAIIGFACDEGVRRNQGRVGAANGPRALRKALANLAYHPTLPLYDAGDVVCDAGNLDAAQRKLALKVQQAAEAGHLPLVLGGGHETAYGHWLGLADAHPGKRIGIVNFDAHFDLRHADEATSGTPFAQIAADCARRGQHFRYLCLGVAETANTQALFDTARALGAEWRLDTEMTGWQLADIRGQLAEFLDSVDAVYLTIDLDVLPAAQMPAVSAPAGYGVDIAVVETLVGRLAKSGKLIGADLVEFNPEYDIDSHGAKAAARLAWSLTRHLRR

SEQ ID NO: 4610 - protein, 413 aa, Chromobacterium substugae
MSPTPASRPSLWLNARLATMDPARAAPYGCLEQHALLLRDGNIEALLPQAEVDAAAFDGDVHDLQGRWITPGFIDCHTHLVYGGSRAAEWEKRLAGVPYQQIAAEGGGIVSTVRATRWLDEEELALASLPRLKALMAEGVTTVEIKSGYGLTQADELKQLAAARRLQDSLPVEVAATLLAAHALPPEYAGDADGYIDLVVESILPVAARAGLAEAVDVFCESVGFTPAQTRRVFEAARAHGLKVKGHVEQLSNLHGAELVAEFGGLSADHIEYLDAAGVDALKRAGTVAVLLPGAFYFLRETQKPPVALLREAGVPMAVSTDLNPGTSPFASIRLAMNQACVLFGLSPEEALAGVTRHAAQALGRGASHGRLAAGYVADLLVWDIDHPAELAYSVGAPQLKQRVFRGAAQNLE

SEQ ID NO: 4611 - protein, 238 aa, Chromobacterium substugae
MSDSPLPRYQRIKDYILSGIRDRHFLPGCKIPPELELARQFGVSRMTVNKAVRDLAEAGILLRFAGDGTYVAERKAESPLLDINNIAAEIEARGHRHSGQVIVLEALPASEEVALRLGVKAGARVFHSLIVHCEDDVAIQLEDRYINPAFAPDYLAQDFRARTPNDYLMQSCPLTDIEHSVEAVLPGVAEQTLLGIAAGEPCLLVLRRTWSHKKLVSFARLTHPGLRYKLRSQTRVKK

SEQ ID NO: 4612 - protein, 148 aa, Chromobacterium substugae
MMTLPQWLAEYDASHRHPFNIAMHKLCVPLIALSLLGMLIALPGPLPWAWLLWLGAVAWYWRLSRPVALVMAVLCSLALLLLTIAQSQGLPLGYVSLPVFALAWAGQFAGHAREGRKPSFAQDLRFLLIGPLWTLRALWLRLGLLPRD

SEQ ID NO: 4613 - protein, 287 aa, Chromobacterium substugae
MERSMIYPQGLSLAELAPRVGLIELAGAGFSARLSLLGGQLLDYRRDGEAPLFYLSPQAVYQPGKAIRGGVPVCWPWFGPHPSDAGQGAHGVARQQLWTLREASRDGEVFHVKLDGPRHGDLTASLACRIGPDGVAIELVSRNHGAQPQTVSAALHSYFAVSDIDNIALRGLEGAPAHDKVSGERVALPQQPFRFAGEVDLVVYSGQAVTLDDSGWRRRLRIDSQGSATSVLWNPAPAKARQLADLPDEDWRRFVCVETANAGEDARSLLPGASHTLGCRLHFSRAD

SEQ ID NO: 4614 - protein, 181 aa, Chromobacterium substugae
MARPDKISRFLPLTFANGNSVRRFGKHCPQCRAMVGAEHMEGIASLKQGKIFLSAEACCPQCRQRFPVACVITDDKRVHRVLLPLWMFRIWLNSATRHDPQPENQDNWEIEAEEPKGLSLPADAEVVRSEEVLGRFQGEPICAWIEYQGQRFVFDRAAPGNNLTLTPSELLFEGRLIYRQQ

SEQ ID NO: 4615 - protein, 108 aa, Chromobacterium substugae
MLNFISAELHAGSAPLFQSDPPRAARAMLQAKLSQRLDWLDSVLRLRDYLLGDAFSVADAYLYTVLDWLPRFAIDLAGWPNLRAFHARVDGRDAVRQALRAEADSTPA

SEQ ID NO: 4616 - protein, 179 aa, Chromobacterium substugae
MRKPLMTLLLSLPCALASLPAGSAPAAGLAGDYGASIGAPGNRLQLRLSCRDDAHCELATAFEAAGAPSQPVRQRLDQVLALQDKTEAENALRFAVQHRGDQPLPPDLAEAMAKLKPVLSGQPAIRQCWDLNLPQPGEMLACTLSGAPAGSAPLYLFGTLQADGQAGFRRYVIYPLSRQ

SEQ ID NO: 4617 - protein, 505 aa, Chromobacterium substugae
MTRIAGQLSPEQLKAAQDQAAAIPAAAKPAIAAGQFVYFAAFDGTSNDKDKLSRGMQSTNAAQLYQQVAQAAKTRSDIGFHYFSGPGTAGTLPGSAFLPPAVTAEAARTANLAYDDFQKQASTWLKSHPGGSVAVAAAAFSRGNDAASVFAQLLYERGLTDPGSGKMLVPPGQLGLAAAVLYDPVMTGMSGNMAFPPNSRNLLILRAEHEYRSMFQAADFSAQRGAVNASLPGNHCDVGGGYDNGLGALALQAGTGFLQKAGLAIADVPQTRRFDPRQPALVHDEGVNQYGQTIWTTYGSYDQDRVARRTDQVARQAEVSTANGVTTTRFNDFSGKRVQLEQSQGPAGPQGVMTIQDYFNGSTSRVAFPPSAAAAPAAALSPAKQTLLQQARQAVEQLCQRDKLPFNAGQRDNIAAALGHAAWQQGLGKAGFALLHDGQSRISLLHPDSAPGARPATLELAAAALKPAAQSLLALAQSPDAAAHGAEAKPQILPTRRPAAAGMTL

SEQ ID NO: 4618 - protein, 624 aa, Chromobacterium substugae
MTTLAALRQEFDALNHDYLAIHKAKEDLFWDTYMAVSDDHAGFAAAEAAFKDFISSPARLAAVQQALAQLEAQPDGEEKRALTHGYRGWLALFQSNIIESDEARRLMTGLIDLEAALFAKRREFKMQHVNDNGALENATLSMLMTNMGTNRDEAARKSSHDALLGLERWALDNGFIDIVKQRNALARSLGYADYFAYKVEKNEQMTPDELFAILDDFEARTRDANQRALAQLQAKHGDDALKAHNLRFHMSGDVTRQIDPYLPFAKAVERWVLSFRRLGIQYRGATMQLDLVEREGKYQNGFCHGPIPAFQDGAAWVAGQINFTADAKPDQVGSGARAINTLFHEGGHAAHFANVAQNSPCFSQEFAPTSMAYAETQSMFCDSLLDDADWLKRYARDSRGEVIPDALIRARIEATQPFAAFAERSIAVVAYFERALYALPESELTAGRILELARASEQRILGIAVSPRPLLAIPHLLNQESAAAYHGYLLANMAVYQTRAHFLREYGYLTDNPAIGPQLARHYWAPGNSINHNATLVSLTGEPFNARYLAESCTQSVEQAWADAETRIAASAARDYPRQYPDALDARIRLVHGAELIADNGDGDEAMFHRFEAWVAQRYPASVH

SEQ ID NO: 4619 - protein, 39 aa, Chromobacterium substugae
MVSTGGQDAGMHEQVSFHRLETVKTFQYFVAFFAVGTHE

SEQ ID NO: 4620 - protein, 164 aa, Chromobacterium substugae
MLTLPLRSPRLELREFHAEDLLAYQTLRGTPGFGRCYAPAEVSAAFSAMLLRRFIAQQDEPRRAWQLAIARRGDGQLIGSVGLREACGGEAEFGIELAETVWGQGYAEEAARLMLGFGRQRLACSRFRARCAPGNVAMLMLAMRLGFEMQPLRDGSRLDLLLAA

SEQ ID NO: 4621 - protein, 62 aa, Chromobacterium substugae
MASIFTLSRHLLRDVLGDERVHFSSDTLISPRCPAQDAADALRRQQLDSRLQQLRLEKGGLC

SEQ ID NO: 4622 - protein, 98 aa, Chromobacterium substugae
MALYLLSLVFFLTDIGARLALRAQSWRTVELTLLAGLLLAWLLYPRLSGWAVPLMPAEQGMLLYATLVGLQLGLMDAALRTSLERWRLQRQPARRRRG

SEQ ID NO: 4623 - protein, 323 aa, Chromobacterium substugae
MSVGKAVKLCAGIFRLAEYHMSASSSAGASRGVLYTLGAFICWGLFPLYWKPLHAVPALQILCHRIVWSALFVAVVLTFLRQWGDLRAALRQPRQLAIFGLSSTVLSLNWLIYIWAVNAGHVVEGSLGYFINPLVNVLLGRVFLGERLSRPQSLAVALAALGVIWLTVSAGSLPWIALSLAATFGVYGLLRKKAPLASLPGLALETFLMSPLALAALLWFGWQGQGAFGQMGLGRDLLLMGAGVVTAVPLLMFAAGARRLKLATVGLIQYVGPSIQLALGVMLYDEPFGSDRALGFALIWTALLLYSAVGLRALWRERRMAGA

SEQ ID NO: 4624 - protein, 1159 aa, Chromobacterium substugae
MSIRHADLEEKYTAPTGQVLMTGIQALVRLPMLQQELDRAAGRHTAGYVTGYRGSPLGNVDQTMIKAKKHLDAHNVVFHPGLNEDLAATAVWGTQQVNIFEGAKYDGVYAMWYGKGPGVDRSGDVLKHGNVAGTSPHGGVLLVCGDDHAAKSSTFPHQSDHILAASMIPVLSPSGVQEVLDYGLHGWAMSRYSGCWVSIKAITDTIESSAIVDISPERFQFKIPQDFPIPEGGLNIRWPDTPLAQEKRVLHHRLYAALAYARENKLNHITLDSPKARLGIITCGKSYLDVMQALDDLGISEAQAADIGLRIFKVGMVWPLEPEGVRQFAEGLEEILVVEEKRQIIEYQLKEQLYNWRDDVRPRVVGKFAEKGEWALPHGDWLLPAAGELTPAMIARAIAGRLALIFDSPVIHDRLKFYDEKEAQLVKPRESIARVPHYCSGCPHNTSTKVPEGSRAVAGIGCHYMAHWIQADSTKTFTQMGGEGITWLGQAPFTSTRHIFTNLGDGTYFHSGILAIRAAVAGKVNITYKILYNDAVAMTGGQHVDGYLDVPMMTRQLAAEGVARIVITSDDPDKYQNAQGLAAGIDVFHRRELDRVQRELRDTAGVTILIHDQTCAAEKRRRRKRNEFPDPAKRAFINERVCEGCGDCSQKSGCLSVLPVETPLGRKRKIDQSSCNKDYSCVEGFCPSFVTVEGGKLKKPAGASADLAKMPALPEPKIPALHEPFGIMVTGVGGTGVVTIGQVLGMAAYLDNKGVTVLDMAGLAQKGGSVWSHVRIADSQEQLHAVRIAAGDANLVLGCDLVVTAAEEALAKMREGFSHAIVNSYESPTSAFLKNPDVRFPAKAMKDAIVESVGAGRFNEVNATRLSTSLMGDAIAANMFMLGYAWQKGLVPVSLEAIMEAVRLNGAAVKFNQDAFSWGRHAAHDPARVEALVSPTAVVAFVPRETPDAVVHHRATLLAAYQNESLAERYKALVQKTRQAEEALNPASGALTLAVARAYHHLLAYKDEYEVARLYSDGEFQRELASQFDGDYKLRFHIGVAWLTRGQPRKIAIGPWLMPAMKLLAKLRFLRGSALDPFAWQEDRKLERRMIGEFEQQLAGILAALTLDTLPQAVEAVKSWEGVRGFGHIKLKNYQQARSRQQQLLSGGAAAGKASRNVA

SEQ ID NO: 4625 - protein, 188 aa, Chromobacterium substugae
MPALLRRTLLASLSLILVACATQPSKIAQTAGGCVGQVMPPPAGMSAAQNSALLAKAVAAPGNGGLCEGAVYQQDAAAPGVTVYRVWDSAKPNSRLGRWWSFSQPQGPVAKYQADNAICPSWSQLNSVVRCQLKAGVQVAVGTGQSANCAPDPDFPPSPVNQIYVPNTSPDDIQVENCQDEGAFPPAM

SEQ ID NO: 4626 - protein, 317 aa, Chromobacterium substugae
MEKPGKRGYIGINMETIEPTSPLALTFLTVAEAGSITAAAERLSTSKSQVSKQLNRLEAQLGAQLLFRSTRRLVLTEAGHAYLDYCRRLRDLLRESAAAVRELGDAPRGRVRLTVPQMFAGAFIADLLLSFHRQYPQITVELDVSLAERDLEEDGFDLAIRSAPALPPQLVARCLFFTRDWVVAAPALLAELGAPRRPADLARQPCVVHPRYQQGARWLFEREGRVEEVEVSHWLQASDYSLNERLAEAGAGFARLPDFAATAALASGRLERVLADWETPSHPVYLAYPKKTPQPAKVRALIDFIAGWFAAAPPGGN

SEQ ID NO: 4627 - protein, 205 aa, Chromobacterium substugae
MKILLIGGSGNIGRAIRAELSGRHEIIVAGRSHGDVRVDIEDERSIVEMYSRLPRLDAVAVATGGRNGHVAPLAEMSAERYRVGLESKLLGQVNTVLHGVGQLADGGSFTLVGGAWQPQAIVPKISNVYMANAALEAFVNAAAVELPRGLRINLVSPLLLTESEAEYGPLFRGVPLVDARSVARAYSLSVEGAQTGQTYRLGRLD

SEQ ID NO: 4628 - protein, 241 aa, Chromobacterium substugae
MKIGMLGAAARSWLAGAGERAAAAGRGLAARLRGAGNADKPFSAERPAAARSGGWQRFAACFQGGRAAPRQSGLTRGGLSRAPISPGDVKAVMRRQADELGKALAGDAVFCRQALESTYAVMYSEAKNAFHRANGGVMPEGYLRALGEIARDAGLPGREFHGAFIPAGDGASPFVTSLLSPVQKQFSQRVRHPGQQALFREHAKQLTIELVAPHAQRHGWEPPAAFQARLEAVGQPWLGQP

SEQ ID NO: 4629 - protein, 101 aa, Chromobacterium substugae
MQNINWNHWLDLAANFAGNIVAATLDTPDGAQTLAGNNKIFSDTIQNFSANPARRVDLKAQLASRAGHAEAIRLLEFSALGPVLAAAGFPAPEQAMVVRQG

SEQ ID NO: 4630 - protein, 245 aa, Chromobacterium substugae
MSVSPQRQLPYLQQLLDDARRIAVLTGAGMSTESGIPDFRSANGVWSRDMSLAEAVSVDYFRRAPTAFWQAFRDIFRIKLVGDYQPNDGHLFLAALEASGKEVTILTQNIDGLHGRAGNSRVLEMHGTLLTASCPDCRTPHPLDYVQRHEVPVCRRCSTVLKPDVVLYGEAVPLIDVAFQAALNADLLLVMGSSLEVSPVNLIPVEAARAGIPCALINYTPTRFDALFDLCVHAGIGDTCRQLRC

SEQ ID NO: 4631 - protein, 110 aa, Chromobacterium substugae
MTQPTLLDASRLAAALQRFSDERDWNRFHSPRSLVLALMGEVGELAEIFQWLDDDAAARLRDDPARFTHLQEEIADVLLYLTRLAMVTGVDLDAAVRDKMAKNAIKYPPL

SEQ ID NO: 4632 - protein, 203 aa, Chromobacterium substugae
MKLYFSPGACSLASHIALFASGLAFGSEKVDLRAQPHLTAGGADFSTINPKGYVPALQLDNGELLTEGVAILQYIADQAPDKQLAPANGTLARYRLQEWLNFISTEVHKNFSPIFFGKTEEVKDDAWARLQPRLALLQQQLEKTPYLQGGQFSVADAYLFTCLSWAQYVQRSLADFPALLDYLKRVAALPATQQALKAEGLGQ

SEQ ID NO: 4633 - protein, 189 aa, Chromobacterium substugae
MEVEISVEAEKKRLNSLVALTVVLLSVVMGLGKLKDDNIVQARQLLKTDALDSWSEYQSKKIKLHLTEASLRQAKMLELANPASAAALKPQQRELQDEIQRYKAEGEALQRKAEGLEKGFEALNQRHDLFDISDAALSIAVASAAVAALSANLLPLFSAWAFGALGVLFWLAGFAGWNLRIEWLVSLLG

SEQ ID NO: 4634 - protein, 90 aa, Chromobacterium substugae
MNAAQSNNPTHGVTLETMLIELQAHYGWDGLGQRVNIRCFQLDPSIKSSLTFLRRTPWARAEVEALYVQFKTRSAAPADSRPRLFGKKAG

SEQ ID NO: 4635 - protein, 756 aa, Chromobacterium substugae
MAEADKAGWWSLGQHWMDYWTDAAQRGVLFFDVLRERGDTYLEHAASGHPPVLVFDFDIIVDGRELAQPVNYALAAIRPPDGCPAADAGKRPFVVIDPRAGHGPGIGGFKMDSEIGIALRQGHPCYFVMFFPVPVPNQTIECVWRAEKVFLQKVNELHPCGRAGKPFVIGNCQGGWALAMLAASAPELVGPILLAGSPLSYWAGVAGKNPMRYQGGLMGGTWLASLAGDLGHGQFDGAQLVGNFEQLDPANTYWKKAYHLYSHVDGERERFLEFERWWGGHYLLNKQEMEWISQNLFVGNRLSRGEIYLEDGEQRIDLRQIRSPIIVFASWGDNITPPQQALFWIADLYRNVEDIRSNEQTIVYCLHEQVGHLGIFVSAGVANKEHSELASALDLIDVLPPGLYEAVITDTYPETPGLQYLQGRYIIRFEPREVDDILALGDGRDGERAFQVVKRVAEINQQLYDCFVSPWLQAFGSPQSAHWLRESHASRAERRWFSSRNPLLGSLPGWADKVRAARRPLGEDNPFWQWQETLSSWTASALDGWRDQRDALKEMTFRAVYDAPLTAALVGLHPKREYSVRRQQGGWERGEMLRLKRRELEEYYSQGGAVDGFLRLLIYVAIGTGVVDVRPFNAIRRVMQDTGLGEELTLEEFKQVVRRQTWLVRNDEKRALETIGDLLPDEQQRQMALELVMLLLAAAGPISVEKQQRLGRVALAMGVDGGGTRTADPGELYPAPDAAPAKAPAKRARRKAGGAN

SEQ ID NO: 4636 - protein, 48 aa, Chromobacterium substugae
MLPQRPPSRLVRLSHLALPRSRRAPDFTLAQAERLHCGRERYQQGIAG

SEQ ID NO: 4637 - protein, 151 aa, Chromobacterium substugae
MTKLLKPLLLAGLLIAGSGAAYAQDAGADGAPKGWHMDPAKREAMMAKHLQMLHDKLKIQPQQEAAWQTFTASMKHEKMAKPPVDDNATAPEKMERMMQHRQAEMQKHLDALKAFYAQLTPEQQKIMDHLHRPHGKGPHHGKRAASAPANG

SEQ ID NO: 4638 - protein, 140 aa, Chromobacterium substugae
MKGYIRLSGVMLAATLAVAAVAPAEAYYHHGGPPRISIDVWRGGYWNHGYYHGRMGWWWVVGGAWYFYAAPVYPYPSLYAPPVVVAPIAPPAPMAPPAPPIAAAPPEPAQVWYYCKAVKQYYPYVSECPGGWKTVPAKPQ

SEQ ID NO: 4639 - protein, 151 aa, Chromobacterium substugae
MKKRYYALLLPPLLAACTTLPTGPTVAVMPAPGKPFEVFAQEEQQCRAYAASSSGVSNNEAANTSLAANMALGTVVGAAAGALIGGNHQGAGVGAGVGLLAGTAAGGSNGAYAGYDAQTRYNISYQQCMYAKGNQLPGQRMAPSYLPPPRM

SEQ ID NO: 4640 - protein, 62 aa, Chromobacterium substugae
MTRLYAPLMACLFLATGIASAQDANSRPFDTSRVQPSVPLSLHDMTLVDAPAAQTPPPTTAQ

SEQ ID NO: 4641 - protein, 128 aa, Chromobacterium substugae
MADVNRLETWIKYKNGLCGDCVASCCTMPVEVRLPDLIRIGVVDEFELEEPIKNIAKRLEKQRVIQHFNFKNSLFTLAQRANGDCLYLDAKTRLCTIYEKRPNTCRNHPKVGPKPGFCAYTRNPAAPR

SEQ ID NO: 4642 - protein, 100 aa, Chromobacterium substugae
MFPLIVTLEVTLPEDVPLVADALARMRPLCLAEPGCLLWQAYHSQAHPLRFVLVEHWESQAHWEAHGKLSAIQGIYLPEVLPRVSRAAHPSVLLGDGDGD

SEQ ID NO: 4643 - protein, 339 aa, Chromobacterium substugae
MYNNDDLDAAAAAGIFSQQAIDDFRALAAQRRHTQMADEEHFRLLSGFNDIFVVIASVLLLVSVSWVAGSLSKLLAPWLAAAVSWPLAEYFVRRRRMALPGILLLGSFVLCSGGGMMALCLDWLPGGEEAVKPITMLASGLTAALAAWLHWRRFKVPITVAMGVGALVAMTALAVAALLPESLGLSNALLAAGGALAFLLGVHWDRQDPARQKRQSDVAFWLHLLAAPLLVHPLFSMLGIMNGNTGMAMLLAVIALYAVFGLVSLVIDRRALMVSALAYVLYAFNQLLQHAGLESAGFGVAGLLIASGLLLLSAFWQPCRSAALRRLPPKLRAWLPPLK

SEQ ID NO: 4644 - protein, 393 aa, Chromobacterium substugae
MPDLAALFPASAWPDYQGGSLLNLMQTLSSELGGPDLGHAPLRVDALDGIGRHRHVCLLLIDGLGDAQLRRLGPDSQLRARQRARIDSVFPPTTAAAVTTVLTGCAPAEHGLIGWHQLHGEEIIAPLPLYVRHPAGSASAPQALADALYRAPPLFDRLARPAACLLPDFIADSPCSRFHAGGSARLPYRGPADGFAQLAARLRSPRPAFHYLYLPQLDTAMHEHGPAAPQAEILLAELDAGFERLLIEAAQRDAAVVAIADHGFVDAPAGQWLDLDADAELYGMLARPLSGETRLAYCHLRPGSAARFIELARRRLGHACWAVPSQVLLDAQAFGPGPRHPDLARRCGEAVLIAKPGWNIRDTLPWEKPLRLAGVHAGVHPDEMAIPLIAFRP

SEQ ID NO: 4645 - protein, 103 aa, Chromobacterium substugae
MKLASLTLALALSGLAAAAQADTSTIVGGALGGAAGAAVGEAVGGRNGAIIGGAVGGGAGAAIGHDYGRKADAPKRDYRKHRHHHARGKGRSCPPGQAKKGRC

SEQ ID NO: 4646 - protein, 132 aa, Chromobacterium substugae
MIYPMFALVLLTFFVGVRLGATRLAHARSGKVKGSYYRLMQGDAPPDGELKLARNFSNLFETPVLFYVFGAIVIAKNLASPLPLALAWGYVALRAVHTAIHLGHNHPLHRFLAFLASNILLLAMWAWLALVL

SEQ ID NO: 4647 - protein, 72 aa, Chromobacterium substugae
MQSYRFTVYGQMVVAERRDAGWQAFLPGNDGKRRPADFVIPDWVTEDGLAQYLEDLFHENATPRNGGVAPLA

SEQ ID NO: 4648 - protein, 658 aa, Chromobacterium substugae
MSLLPHQVELLSPAKTAEIGREAILHGADAVYIGGPSFGARHNACNSIEDIAGLVRFAHRYHARIFTTLNTILHDAELDAARALIWQLYDAGVDALIVQDMGILQMDLPPIQLHASTQCDIRDADKARFLSDAGFSQVVLARELTIPQIKKIADRVADSATIEYFIHGALCVAFSGQCFISHADTGRSANRGDCSQACRLPYTLTDEKGGVVAFDKHLLSMKDNNQSANLEALLDAGVRSLKIEGRYKDVSYVKNITSHYRLLLDEIFERRPELAPAASGSSEIYFTPDPDKTFHRGATDYFATGRKQDIGAFDSPKFVGVGLGTVHKVGDGWLEIATTEQMSNGDGINFMKKREVVGMQLNTVKQVGKAEGGLLVWRCEPNDPAALQGLKPGVDISRNRDHAWELALLKKSAERRVGVWAALRETAGGGLELSYTDADGCSASASVDMPLEPAKDAARAEQSLRDAAAKLGNTMFQAHDVALNLSQPWFVPASVINGLRREAVEKLEAARVAAWPRQPRKAAVEPPVRFPQTELSYLANVYNALAWDFYKKHGVEVIEPAYEAHQEEGEVSLMITKHCLRFSYNLCPKQAKGVKGVMGQVRADPMVLKSGSETYTLKFECRPCEMHVMGKMKKHILKTPPPSEIPASAPITFFKQRP

SEQ ID NO: 4649 - protein, 565 aa, Chromobacterium substugae
MFSQLTISQRLAIMVVALLIIPILVGLYGLRTQEGILGDFATTYNDRVVCLKQLKVVGDGYAVGIVDNAQKLRNRSQTPASFFNNLQKAQADVKRQWGDYRATYLTPEEKQLADQAETAMAAANQSVDKLSRIVRGGDAAALQAYVDQEMYSALDPVAQRIAALVDLQLRVAAEEFAQSQQRAAFSHAANIGLIVAGVAIGFLLAWVIVRGLLAELGGEPRDVVALAERIAEGDLGQKLQVRPGDQHSIVSSMSRMQSALIQLVRNMQSITLRLSNSATELAAAAEQVATSAEEQTRAASSMSASVEQLSVSICSVNDHTSDVAKDSVSSGQLAHSGEAIIGETLSTINHVAEQARASQQQADLMGSRSQEIANVIQVIRDVAEQTNLLALNAAIEAARAGEQGRGFAVVADEVRKLSERTAQSTTEISGSIRDMLDCSQHVVENIHNTVDQMEVGLSQATRAREAIAGISGNVERVKQSLSTISISLNEQQQAGTGIAANVEQVAQMSEETSAAAVQTAEAASQVEQMAGALQVAISHFKLPAGGQPYSADAPLPAISATALRA

SEQ ID NO: 4650 - protein, 463 aa, Chromobacterium substugae
MHKQRVLLLAVLAALSGLALAEEEPSVPPSSDGPALKGTKQAIPASDVYDLITKSETTFSALYYGRDRQEKQPNNSNGGDIRVNALNLGLNFKSGYAWNVLGFDAAAHSSIRLTKGIGFSEVLYHDYKDMSNPAEGGGGKDKSDAVLSQAAVKFRQSPDGQGFSARAGYTPISIGTMGTSGGLQSHSYRGFEGKYKLGDFEIGYGWADQFRNEWDNRFRDMTNSWEQGRSNGSAAKQVDYVNSLGLRYAPENAFIDFGVGEGKDYRRTAQIAGSYTWKLAGGDSLTGVAYYFQGKDEAQLGMKNSQTAWHTSASLAYTTGGLTVQGGLGKSHNPDGGEVNFRMTPYGNSDNRNFIQTWGQDDDFVWDGTQVVKLGVNYDFAKQGLPGFSLGASANYATGLKNPNGAPDSKAHEIDLSAGYTVQSGPLKGASIGVYPAWYRSGDFYGKRDRNDVKVIASYSKTF

SEQ ID NO: 4651 - protein, 418 aa, Chromobacterium substugae
MKLKTLSLSLLIAAGLSAPLAAHAADKPVLEVWTMSLSPKFDGYFKELVAKYNAQHPNVEVKWTDYPWDVIQAKFTAAVGAGKPPALVNLNVPWTYDYQQQNLIQPLDGLIDKGQYVTGALKDVTFNGKVYAFPHYNGANVIAYNAALFKKAGLDPNKPPKSFDEELAYAKQIKAKTGVAGFAPTLGPTKIEALLMQNGLDVVKDGKPAFNSPAHVAFVKKLADAYKAGALLKDNLFAQDNFQVAMAAYNGGRLAMLESTPTTLTRVRDEAPKLYRDTRVAPAPLGPTGIAAGGWMFNFAVARNVDKALLPEVGKFGNYLTNADNQLAFAKLAGTLPTARKAALDPHFQKVSGNAGAAELAVGIAAANLDKTRTLFLSVKNADTLSARLSAAVEKAVTGRQDAKQALDEAAAYWSGKL

SEQ ID NO: 4652 - protein, 289 aa, Chromobacterium substugae
MRKPHKTTLQTYLFLAPALVLLAAFSFWPVGFGSFLAFTRYNLIDAPQWVGWDNFRELFGDELFLSALKNSALYLLVVPAIQLLAILLAVLVNNSLPGIKLFRAAYYLPVVTSVSVIGIIWNFMYAEDGVLNAALRWLHLINDPVGWLNDDHIALFAVMFITVWRGIGWYMVLYLAGLQAMPADLHEAAQLDGASRWQRFWRITVPLLAPTILLCSIMSMLAAVKAFEEVQILTKGGPMQSTYTALFYAYEFGIKSLNFGRALAASLVMSAFCIVLAWLNFRYLQPRDR

SEQ ID NO: 4653 - protein, 290 aa, Chromobacterium substugae
MHSSTTLPAAAAAIRARPRLARLGNRAVHYLALAAIGLITVYPFWWTLVTALSGDGEVFAFPPPLLPTAPTLANFREAVSSIDILAFYRNSLAITALTVAGTLLVSALAAYPLARMQFPGRRLVFGAILATLILPSEVNFLVNFITVSKLHLTDSYGGVVLPTLAGAVGIFLMKQAFEAVPQDLIDAARVDGAGEWQIFWKIMLPLSRPALAALTILTTVSAWNQYIWPSIVMSSPEKFPLSVGVLYLAGAFSFKTRVVAAGAVLTVLPILIVFLFTQRYFLRGFDGAVK

SEQ ID NO: 4654 - protein, 505 aa, Chromobacterium substugae
MTLSDEQLDQLAGRCLMVDVAGPALGAEEAARLRKMRVRAICLFRRNVPDAASTRRLVAGLKAALGDDILVGLDQEGGGVMRTLFLPQAPAAMALAAVGDAALARQVGAAVARGLKSLGVNWNFAPVLDLNNNPANPVIGERSFGAEPARAAALARAWMEGHLAEGVACCVKHFPGHGDTHTDSHLDLPVVDKPQAELRDYELAPFKALSAHAPALMSAHIRFPALDPEWPATLSPAILTGLLRHELGFQGVAITDALNMKAIRERWGQAAGSVQTLKAGADLALVLQFPDEMEASFNALRAALRGGELAPERMQEAAARVDALTRRYPSLGDDDYAAEQRAADEALFADAWVRALTAHGEVPLLPAGQRLRLVVQDQAPSDGVSEAGLSADRLIAALSRRHALEVVRFKNRAMLDWATLPRDGAFTVLASTSRERYRRREQHSWKPDLHLALWNPYAAADIAAPALISYGFADAALDAISRCLAGEIDAAGRLPVPLGGPHQEQ

SEQ ID NO: 4655 - protein, 370 aa, Chromobacterium substugae
MSRLSLSNIRKVYDDGNAVIHDVSLDIRDGEFMVFVGPSGCGKSTMMRMIAGLEDISAGELRIDGQLANDIEPAKRGVAMVFQSYALYPHMTVRGNMAFSLKLAGKSKAEIDAAVNRAAQTLQIEHLLERKPKALSGGQRQRVAIGRAIVRKPGVFLFDEPLSNLDAALRVQMRIELARLHKELGSTMIYVTHDQVEAMTLGHRIAVFNAGRIEQVGTPLELYNRPANRFVAGFLGSPKMNFIAARPLDPRADGVELELPGGCRLTLPFAAAGGAATLGVRAEHLFFAESGLPATVQLVEHLGDQQIVYLRHEGEGEPIALRLPGHEAEPRPGERRFLAPDPRHCHLFGGDGAALPRREPASQPAAELIA

SEQ ID NO: 4656 - protein, 540 aa, Chromobacterium substugae
MNRQTSLAGQLAAIVGLVIAILLISSIFSLSQLWGSIRVFRDQVVADQRSVQQVLTMQVDFKKQVQEWKDTLLRGQDPAKLAKYWGNFQQREQQVRDEGNRLAASVSDPQAQQLLLQFVAAHQKMGDDYRKGLDAYKQAGADFKVGDKQVAGMDRPPTELLTQASDLLAKRAQANTAAAEDSANAALWRVGIAMAVGTVLGLAFFLYYVSRTVIQRARQLADDLARLAGGDFTRPFHAGRMDEIGRIAASSETVRTHLGSLIGELIHAAKQVGDTSQELGRSAQALARGAETQNDAIADNAASLEQMATSVDTIADQASRISDDSRNSAQKTNDGLDEVARLRRQAETIDTVMGQVDQASQAFRDSTQSISHLTGQIRDIAEQTNLLALNAAIEAARAGEMGRGFAVVADEVRKLAENSAKAASEIKGVTEQLSQNAQSVGSTVQSGLDAAQQSRDTMETVMANLREANDSVQEASGGVGQIRDAISEQKSVCASLAQRFETVSQMVADNTQAAGELHSAVLRLNGVAAHMQQMVGKFQL

SEQ ID NO: 4657 - protein, 217 aa, Chromobacterium substugae
MRVELSQDLLGRLPAMEVEGLLALDLQTSALPTAAPSLAEGADTEALLQRWKALYRELPGDKKARCSLEYLVKAVQKDKLRSILPLVDLYNQASLLSLVPFGGEDVDKLGGELLLDLAHGDEAFVPLGRAEAEWPQAGEVVWLNGGRETVCRCMNWLESDHFKLTEASRNVVFVSERPDAGFPSGAVGMDWLARRLAPHAGTLLRFRLDAANPVFSA

SEQ ID NO: 4658 - protein, 503 aa, Chromobacterium substugae
MDVYDLMVIGGGINGAGIARDAAGRGLSVALCEKDDLASHTSSASTKLIHGGLRYLEYYEFGLVRKALQEREVLLKAAPHIIWPLRFVMPHARDQRPEWMIRAGLFLYDHLAKREVLPGSETVSFAKHPAGAPLKDAFKRGFVYSDGWVQDARLVVLNAVDAAEHGAKIHTRTACVAARRDDGHWIVTLAREDGSRFEVRARALVNAAGPWVQSLIEDKLAMPSSKSIRLVKGSHIVVKKLFDHPFAYIFQNPDKRIIFAIPYEKDFTLIGTTDVEYRGDPARVAIDAQEIAYLCEMSNRYFHSQIAPADVLSTYSGVRPLLDDAADNAASVTRDYALEMDLAGAPLLSVFGGKITTFRKLAEEAVDKLAPLLGNRKATWTADAPLPGGDMPGADFGRFLQGLGQRCPWLPAALAERWARAYGTRVGKLIGQAASLAELGEEVLPGLYAAELEYLAEQEWATRSEDILWRRSKLKLHLPANAAEVVDAWLAARAQSRREALSA

SEQ ID NO: 4659 - protein, 237 aa, Chromobacterium substugae
MDPFYKALVGEFIGTALLVLLGNGVVANVLLKNTKGHNSGLIVVAFGWAMAVFVGVFSVAAISGAHLNPAVSVALAVAGKFPWDKVPGYVAAQMLGGMAGAGLMWVIYRKHYETTDCADTKLATFCTGPAIRSLPGNLVSEIVATFVLVFAILSMVGPKMSLGAIEALPVALLVLGIGVSLGGTTGYAMSPARDLAPRIMHAILPIPGKRDSDWGYAWVPVLGSLIGGTLAALASTL

SEQ ID NO: 4660 - protein, 500 aa, Chromobacterium substugae
MSDQYVLALDQGTTSSRAILFNRGGDIVSLAQKEFRQIYPQPGWVEHDPQEIWGGQVGVAAEAVAKAGIDGRSIAAIGITNQRETTIVWDRETGQPVYNAIVWQDRRTAGFCDELKARGLGELIRAKTGLLVDAYFSGSKIKWILDNVPGARERAQAGKLAFGTVDSWLIWNFSHGKVHVTDVSNASRTMLYNIHTLEWDAELLDIMGIPASMLPQVKSSSEVYGHTHAAHLGVEIPIAGVAGDQQAALFGQQCTQPGMVKNTYGTGCFMMLNTGDKPIESKNNLLTTIAWAVDGKVQYALEGSIFIGGAVVKWLRDGLGIIRHSADVGPLAQEVKDSDGVYLVPAFAGLGAPHWNASARGTIVGATLGTKAAHIARAALDSIAYQTRDVLKAMEADAGMGIAELRVDGGATVNELLMQFQSDILAVNVVRPKITETTALGAAYLAGLAVGYWKSVDDIQGQWQLDRRFQPAMPAGEVAANVKGWQRAVNAAKVWADDQA

SEQ ID NO: 4661 - protein, 468 aa, Chromobacterium substugae
MLRNTKILATLGPSSSTPEQILELARAGVNIFRLNMSHGSHDDHRARLAAIRAAEKALDRPIGALIDLQGPKLRIGKFPQPATVQTGDRYEFVLDEVDGDARRASLPHPEAFAALKPGHSILVNDGKLAFHVEHVEPRRIATRVTVGGELSSNKGFNLPHTVLPLSAITEKDRKDAEFALAEGADWVAMSFVQTARDVAELRKIVGTKAGIVAKIEKPSAVDDLEAIATLADGVMVARGDLGVELPPEDVPVAQRRIVHQCRHLGRPVIVATQMLESMITAPTPTRAEANDVATAVYEGADAVMLSAETAAGQYPLQAVQIMDRIIRRVESAPDYRKVMALDYSAADEPGRTDAIAACVRKVATLLPVTVSVAFTTSGSTCLYLARERPSTPILGISPSLDTARRLTLVWGVVAYHGPDAENLEDMVVKTTFCATKLGLAEQGKPMVIIAGVPFGTPGSTNLLRIVYP

SEQ ID NO: 4662 - protein, 250 aa, Chromobacterium substugae
MRQKLFPTMLALWLALAGVPGLAGEPPGLIVDFDASNPPLMYAGQQGAAGLYPALVAKVCERAGIAVTLRAASWRLALQELGGGSAAAGGIIKTASREKLFDFSQPLFYERVVMASPAKAPRYRKLEDLYGKRVGVMAGWSYGDAFDLARKQGRLTAFDGDSDEQNLRQLRLGRLDVVLGIREPLQLALRDGGYRDVALSQEALVTNPSYLAINKHAQQEALLTRFNLALEAMRRDGSYDSVLQRELSRR

SEQ ID NO: 4663 - protein, 123 aa, Chromobacterium substugae
MISHIDHIVLTVRDIEAAVAFYQRALKLEAVSFGNGRRALRFGNQKINLQTLGQETRNHAAIGSGDLCLITHLPLAEVAEHLKREGVAIVEGPITRSGAMGTITSVYFNDPDGNLIEVSTYSF

SEQ ID NO: 4664 - protein, 402 aa, Chromobacterium substugae
MTVHLPLQQARHLQLAAQGLLTAPRRKASKADALAAIRRMALLQIDTISVVARSPYLVLYSRIGQYDPAWLDQLLAEGALFEYWAHEACFVPTEDYRLLRHRMLNAEGMGWKFSPRWYAQHRADIEAIVERIRAHGPMRSADFERRDNKGNGWWDWKPEKRHLEALFTLGRLMVKERRAFQRVYDLAERVLPGWDDARDLLSPEAARLEQVRNSCRALGLVKPAWVADYYRLKRAPYTELLHGLADAGELLPVKVEGWSHDAFVHASLAAELELARNGMLNSGNTAILSPFDPLVWDRKRALELFDFDYKIECYTPAPKRKYGYFTLPILNRGKLAGRLDAKAHRAQGVFEVKSLHLEPGTRVSQRLADDLKTALARLADWHGAPRLAISQAPGDLAARILA

SEQ ID NO: 4665 - protein, 119 aa, Chromobacterium substugae
MIVVSVVYPHRPAARFDFDYYLQRHMPMVQQLLGHSLKGVRVDRGLSGAEAGSPPGFVAQALLLCDSVQAFQQAFGPVAARIMGDIANYTDIQPDIQFSEVALWDERQPGVSGWYANAQ

SEQ ID NO: 4666 - protein, 97 aa, Chromobacterium substugae
MRTPILLMSAALALAGCDQRQTAQLQQAASAAIGNVHQGVDAASAPLGQLKEQASAALGAAKQVGAAATLLNPELKEQVEKLKRQASDIQGAIQPKP

SEQ ID NO: 4667 - protein, 189 aa, Chromobacterium substugae
MESLPDLCRVSDILLDVDVDCKNQLFAYAARQLGQRHALNSQTVQSALQLREQTGSTALGHGLALPHARIPGLSEAHALFLRLKRDMEFDSPDGKPVRSLLLLLLPQEAHPQHLQLLAAIARMCSERPFREALARCAHPQQVHQLFQLWADPQPSNDPHFWLDSNRYFLDTEASLRPDYSIRRKVVARF

SEQ ID NO: 4668 - protein, 373 aa, Chromobacterium substugae
MSNFLLTMLSLTVASIGVITWQHSVRADLLRPRRRWLQASLLLATGMMLEGELLGLHPAALSLGSGMSNAGITLQLMIIARLCNLRLPDTLWLWVGAYSILDKWVPQPLLSAALSALEIPLLYLAAAWLYQRAEQQICHNRFSPTALLFLLGALLFIWRDAPDLLRLYHGQPHLSHEHTLAHQLALTVAAAAQVCGAVGFLNIVLQRQNSRLQDAANIDPLTAAGNRRALQYWLRTLEASTERVCVIMLDIDHFKSINDRFGHPAGDQVIQALASLLNNGVRENDLLIRYGGEEFCLVMPDTGIETGLAVADRLRQQFSQLALLPAQPEQRCSFSAGVHEWQCRQQDFASAQQKADQALYQAKQNGRNQVCRL

SEQ ID NO: 4669 - protein, 362 aa, Chromobacterium substugae
MKQTDQTLLEQLRITEFEIDQRKQLFDLQPRDELLLRAAGALIEPQLDDLVERFYEQQTSTPEIALLIGDADTLQRLRSAQRRYVIDLFSGVYDLEYVNNRLRIGLVHKRIGVEPKLYLAAIHFLRSLLSVQVARLIPDPDVCTQTLMSMDKLVMFDIALVFETYIRSLVAEIETSRNKSEQYALALEEKVAMRTRQLEELSRTDPLTGLLNRRHLDETLTRVLRSAQRRHERVALVYLDIDDFKAINDTEGHQRGDEILRVLGGIINRISRLEDGCFRYGGDEFCIVLPNCGRRHAENNFVQRLRAEMEIALSGVTVSMGCVETGPEDFASPEALVGMADQQMYAVKSRHREDGEDKPAGR

SEQ ID NO: 4670 - protein, 79 aa, Chromobacterium substugae
MDTSSHLLPGLFRQLGLADEPAAIKAFIASHPLPPRVSLADAPFWSPSQAAFLRQALECDAEWSEAADELAVLLQQAEG

SEQ ID NO: 4671 - protein, 632 aa, Chromobacterium substugae
MNAPVNKQMVVDAAAIQPLPNSRKIHVAGSRPDIRVPMREIRQADTPTQFGGEANPPIYVYDTSGPYSDPAVRIDIQSGLAPVRAGWIAERGDCEQLDGLSSEYGRAREADPKLAELRFNLQRKPRRALPGRNVSQMHYARRGVITPEMEFVAIRENLNRRAYVEALQATGNTRLLELMTRQHAGQSFGANLPEEITPEFVRQEVAAGRAIIPANINHPESEPMIIGRNFLVKINGNIGNSAVTSSISEEVDKMTWGIRWGADTIMDLSTGKNIHETREWILRNSPVPIGTVPIYQALEKVNGKAEDLTWEIFKDTLIEQAEQGVDYFTIHAGVRLQYVPLTAGRMTGIVSRGGSIMAKWCLAHHQENFLYTHFEEICEIMKAYDVAFSLGDGLRPGSAWDANDAAQLGELKTLGELTEIAWRHDVQVMIEGPGHVPMQLIKENMDKELEWCREAPFYTLGPLTTDIAPGYDHITSAIGAAQIGWYGTAMLCYVTQKEHLGLPNKNDVKEGIITYKLAAHAADLAKGHPGAQIRDNALSKARFEFRWEDQFNLGLDPDKARDFHDETLPKDSAKVAHFCSMCGPHFCSMKITQDVRDFAAKQGISAQDALNKGMQEKSIEFVKGGAKLYDKV

SEQ ID NO: 4672 - protein, 56 aa, Chromobacterium substugae
MAGCGGMAGLSSAGDASLRRDYPGQVPRVFLTRAAAFNPMSYTLVADQAKRQAQDP

SEQ ID NO: 4673 - protein, 219 aa, Chromobacterium substugae
MDFEKTRFNMVEQQIRPWDVLDTNVLDLLFHVKREDFVADNQRQMAFVDTELPLPNGSKMLQPKMEARLVQDASIQPTDKILEIGTGSGYLTALLAKMGKQVVSVEIDAAQKARAAENLKQAGIANATLVEGDGVLGLPAQAPYDVIVVGGSLPVVPQELKDQLAVGGRLILVAGDLPVMACKLIQRETETSFRETALFETCVERLQKFEAVEPARFSF

SEQ ID NO: 4674 - protein, 108 aa, Chromobacterium substugae
MLREITAPQLAALLADPQAARPVLLDVREGWEYQLAHIEGSVHIPMNLIPIRMSELPDDAAIVAICHHGMRSAQVAMFLQNAGFDDVINLQGGIDAWSAQVDPAVARY

SEQ ID NO: 4675 - protein, 240 aa, Chromobacterium substugae
MQALNYLSSALARVHPAWEAVLRQADIAARLADIDRQLSQQSEAGKTLFPPAAQIFNALSFASPADVKVVILGQDPYHGAGEAMGLSFSVPEGVRVPPSLRNIYKELAADLGLGIPANGDLSHWAQQGVLLLNSVFTVEQDQAGSHGKLGWQTVSDALIDAVNAQSPGCVFLLWGNWAQTKAERIDASRHLALKAAHPSPLSASRGFHGCRHFSQVNAWLIARGRQPVRWAAAAAQNSLF

SEQ ID NO: 4676 - protein, 436 aa, Chromobacterium substugae
MEILLLLGLILLNAVFAMAEIAIVSSRKVRLLQKAEDGHRGARAALALAAEPTRFLSTIQIGITSISILSGVYGEAALSEHLRAALLEVPLLAPYSKPLSVALMVVFITTLSLILGELVPKRLALLNPERVAMALARPMLLLSRASAPLVQVFSRVTDGLLRLLGAKKSDEPSITEDEIRTLMEQGADEGVFDRAEQELVENIFRLDNRKVAAVMTPRKDVVLLDLEDGPEHNRELLLRHNFSHFPVCRGDSDQVIGILNAKRLLDRLLTGQPADFAADLAPPLYVPATSSLMQLLEQFKQARSHSALVVDEYGELEGLVSINDVMEAIVGDMPAIGGEDDEIVQREDGSWLVDGMVSLDSFREFFELDSPLPGEAGGNIHTLGGVIMFKLGRIPSVTDRFEWNGFSFEVVDMDKTRVDKILVQRRHLPQPEFESI

SEQ ID NO: 4677 - protein, 154 aa, Chromobacterium substugae
MTPALPDRRVVQADARRLADWLRLRAALWPDCPADDHRADISRQLTQTGRYAAFLALDAGNAVALLEIALRNDYVNGARSGSPVAFIEGLYVAPRHRRAGLTTMMLAAAKAWALTRGCSEMASDTSLDNLAAQAAHRALGFEESERVVFYRMAL

SEQ ID NO: 4678 - protein, 475 aa, Chromobacterium substugae
MRRSGLPEQRGRGGPALRRGARLSRQRDLGGGKGRPAGRLGAWPWRPSAGSGVVCGNRRHRGGAGTQGIGDRQAVAGGLRGLGARTRLSAHPPALGTTAAGRARVLPPYRLPAEKHRHHVRAGSAAARLRLIHRRESRLEGNPQMQTRFPAPLQVGDAIAVTAFSSGVPAQLHNQLDDALAMLRARGYRVVEGECLREEKCDASAPAAARLAELKRFLFDPGIRAILPPWGGELAIELLAGLDFAALAKLPPKWLAGFSDVSTLLAPLTLLSGWATLHGPNLMDSPLKERQSGYEALLAALETGMPAAQEQYARYWRWDEPGQTFANQVRMLDGGAGKMAGRLIGGCLDVLASLQGTPYFDLAAFKRKPAILYLENCELAPCGVLRALAGLRLSGTFDGLSGLVLGRSTGPEAANAGALSYQAAVRAALDGLGCPVAMDADIGHSPPQWSLLNGAWAVLEVFGEGRARLSQRPAP

SEQ ID NO: 4679 - protein, 320 aa, Chromobacterium substugae
MMNVLIVRTSSMGDLIHTWPAITELKTHYPNIRLSWLTEESFADIARLHPQVAEVLTLRWRSWRKRLLQPAAWRELKALKRQLRDTHFDLVLDSQGLLKSAIPARWAAAPLAGLDWSSAREALASLFYDKKHSVSRRLSAIERNRRLFGLSFGYQPQGEPSFGVAAGERPSWMLSGRYAVLLHATSRASKEWPEANWVELGERLSNQHDMVMVLPWGNDAEKARAERLAGRMPAAVVAPKMSLVEAAGLLGHASAVVGVDTGLAHLANALNVPLAAIYTDTDPQQTGVVETPWATNLGNIGQCPQVDEVLRALRSRRDWT

SEQ ID NO: 4680 - protein, 421 aa, Chromobacterium substugae
MSWQRCLYGALWRTLTPLIRRYLRKRAKQAPAYLLHWDERFGRVLQPRAVGAIWIHAVSVGETRAAQPLVAALRRQWPDAPLLLTQMTPTGRATAEALYPDAEVRYLPYDYPQAAADFLAAYRPRCGVLMETELWPNLIHAAAAQRVPLVLANARLSDKSLKGYRRILGLIRPAMRDLAAVAAQTAADADRFRKIGAENITVCGNSKYDIEIPAEQMQLADGFRQRIGARQALLCASTREGEEALILDAWLAAGDAVGDALLVLAPRHPERLQAVAELAAERGLKLQRRSDGAAVAADTQVWLGDSMGEMFGYLGACDVAFIGGSLLPFGCHNLIEPAIAGVPALFGPSVFNFQQAAADAQAAGAARQVADAAEMVALALSLLADPERRAAMREGAAAFRQAHRGASQRMLEVIRATLDAS

SEQ ID NO: 4681 - protein, 240 aa, Chromobacterium substugae
MNHDGFRRPRAGFSPLWPLVLLLPAVLSAAARADGWPYPGWRDDADTRVKALALLQTVNATLLSNSSATRTLQQWCADHRLAAEPRIRALRDRDVRKPADADIRRQLQVGAAETIGYRRVQLACGDHVLSEADNWYVPSRLSPEMNRLLDTTDTPFGAAVRALDFTRRTEQARVLWSPLAPGWEMRPQAPAAAQRALDIPEQVIQHIAVLYRDGNVPFSLVVETYRRDLFAFALTPPAAP

SEQ ID NO: 4682 - protein, 200 aa, Chromobacterium substugae
MANDFQPLPTLTLPRTTDLVQLEQRPHPPIHAHSPALAVMTDLRLVNPVGISADAGLREAHQRMISHGIRLLFVHDGDGSLLGLVTAVDLLGERPIQCMKEHGKHHADVLVGDVMTPRDKLDALRLDDVAAANVGQLVATMKQLGRQHALVVEQNPASGHHEVCGLFSTSHMARLLGMPLSFIRVPQALSEIQYSLLYTG

SEQ ID NO: 4683 - protein, 158 aa, Chromobacterium substugae
MDWQIETLAPAFIQRARREGVDALGQPVRRLAARGGEPLRDALRRARPGEALILASYSPFRLDGPYREFGPVFLAAEPQAESLPSLDALLAGPGYFRDAPALRAYDAGQSMLEAALPAWDQLAERLRQWQARADIAFAMLRFPAHGCYALRLNRGELT

SEQ ID NO: 4684 - protein, 295 aa, Chromobacterium substugae
MSETLLAGAEAGRDYHRMADAIRYLVAHAGQQPRLADLAAALHLSESRLQRLFTQWAGVSPKRFIQQLTCEAAKARLAAGVPVLPLAHELGLSGGSRLHDLFVTLEAMTPGEYQRGGAGLDIGWSVEASRFGPLLLAQTARGVCALQFVADEAAAEAWLHGQWPQARLRYQPGAARALAERLFSPLSPRAGPPLALRVQGSNFQIQVWRALLAVPYGSLVSYGQLAAGMGRPQAARAVGGAVGANPVAWLIPCHRVIRAEGALGQYRWGETRKAELLGWESAQLAARPEPAAWLA

SEQ ID NO: 4685 - protein, 286 aa, Chromobacterium substugae
MVGLRREAAWLTLLAAIWGASFLFMRIAAPVFGPLALIALRVGLAACALLPLMAWRGQLAVWRAHWPDIALTGIFLTAFPFCLIAWAQLSLPAGMASVLNATTPLMTALWAWPLAGEKLTPPRLAGLALGLAGVLVLLRGRGAGFDAAGPWPVLAMLGATASYGWAGQMVRRRLPGLPPLATAGGGLASGALLMLPLAAWAWPAGPIPVRAWLALLALAWLCTALAYLIFYRLIARLGATRASGVTYLVPVFGVLWGVLFLGEALSPAMLLAAALILGGVLLLGRR

SEQ ID NO: 4686 - protein, 433 aa, Chromobacterium substugae
MLRKLFGSLFFRLALLMVAVVIATQLFTISLANHERHKLLERQLYIQVLDTLSYLEDSMTGMSNEERQAFLDNYNRPGLPSLLPFNADHGQNFADDLPKIGAMLAQRLSHDLNEPIQAHYARREDHSELWVHVHVLDQPYWLVIPFGRYRDRWINPMLQASLLAALFATVLASLFAWRITRPISRVVMASRELAGGSMPQAIPETGPREVQLLAHNFNGMAQALDNAARERRLMLAGLSHDLRTPLTRLKLTLEMQETSHDQHDMLLDIDELSRIVRQFIDFARAEETSRQEPLALADLAASVVARFRREDMDVKLEARSEPELQADALALERLLSNLLENARRYGQPPVVVRVEQGDGEVVLSVIDHGQGIPEALRETALAPFERLAEHRGTDGGSGLGLAIVSRIVKQHGGRLELADEDGGFKVAIHLPQA

SEQ ID NO: 4687 - protein, 241 aa, Chromobacterium substugae
MEHNKILVVDDDAKLRELLTRYLTQQGYSVETLPDPKDLDRKLARNRPDLIVLDVMMPGEDGLAVVRRLRAQGESLPVIMLTARGEDIDRILGLEMGADDYLPKPFNPRELTARIQSVLRRHHTTPALAAQHNADDVVEFGEFLLNLGQRELRRSGQAIALTSAEFAVLSVLVNHPRRPLTREQLMELALGKGNGESLDRSIDVHISRLRKALENGDSQLRYIQTVWGYGYVFVPDGSPRE

SEQ ID NO: 4688 - protein, 111 aa, Chromobacterium substugae
MKRYLIILLWGSLFAQQAALAQGFHPRGPARSAEGRPASCQADPQCPENRRLRNLRQREAAKNGDMAFDPIKHQSNRLLPPAADGHAQAVPAKPNFWQDKRRQEQQQNQSE

SEQ ID NO: 4689 - protein, 124 aa, Chromobacterium substugae
MSGWGRRVCAGVGLLLFCLQARAAADEDCGRAVAPQRCLLHQQGLRSCLDLAESRRRACLSYYTPPLSCQRQRDAKRCEALLAAQASCEGMTGASRRQCIDERLPAGDCPRSAQPCPKPLPLAD

SEQ ID NO: 4690 - protein, 324 aa, Chromobacterium substugae
MSHSIVFSATGGPDVLRLVETSIGAPAAGEVRLRHTAIGVNFIDTYQRSGLYPLPLPSGLGSEAAGVVEAVGAGVDWLAPGDRVAYAGGPLGAYAAERLIAAQHLLKLPDGVADETAACAMLQGMTVEYLVQRTYPVQAGQTVLWHAAAGGVGQIALQWLTAMGVNVIATVGSPAKAEIARRLGAAHVIDYRAEDVVARVRELTSGQGVPVAYDSVGKDTFQISLACLAPRGMLVSFGNASGPVPAVSPLELTKHGSLFLTRPKLGDYTATRAELEQSSQALFERLLDGRIRLAPSHRYPLAEAAQAHRDLEQRRTTGSIILLP

SEQ ID NO: 4691 - protein, 193 aa, Chromobacterium substugae
MHIVYLHGFNSSPQSLKAGETAAWLARHAPDITFHCPRLSPHPAEAIRQAGELLASLPADTLLIGSSLGGFYAGFLAEQQNRPAALINPAVRPDRDLARFAGEQTNPYTGEVYTLGDADLAALQAQRVEKPSPARYWLLLGSRDEVLDWREAAAHYRHSRQTVFNGDDHRLNNWPKVLPEIVAWARRQLSIPA

SEQ ID NO: 4692 - protein, 135 aa, Chromobacterium substugae
MTTLPAAAPTAAPHSLESLIVACGYLQHSALLFAQDLDSDLALIRSGFCPRHQVQWNAQGEMRACAEVHDEVDALLQGSHTLRFALHEMLMQFGPEVCNEALARIILQGVRSLPDWHQVCQSLADLGRGPVRVAA

SEQ ID NO: 4693 - protein, 163 aa, Chromobacterium substugae
MQINSALFIIEGMESKPTLPSDADALRLDQQLCFALYSASLAMNKAYRDSLKPLGLTYSQYLVLLVLWEQDQRSVSDIGARLYLDSATLTPLLKRMEAAGWLLRERLSSDERVVVVRLSEAGRDLRRQAEAIPRQMLCRSGLPLPEARQLRAALGALRDQLLP

SEQ ID NO: 4694 - protein, 142 aa, Chromobacterium substugae
MNTLQKVLYTAEATAFGGRDGRAESSDQALQVQLSTPRELGGLGGDGTNPEQLFAAGYSACFIGALKVAAMQAKVGLPAEVSVKGRVSIGPIEHGFGIAARLEVSLPGLERATAEALVQAAHRICPYSNATRGNIEVELALA

SEQ ID NO: 4695 - protein, 497 aa, Chromobacterium substugae
MWLILSSLAALSIASRSLLGAEQQFNSQSQQLSEQLKQRLLTNETVLDSYATFSALDHRNETRRKHPFVLQLLRRYPQIITLAHIERVPRSRVDSYNRWLQREYGAGYRLRPYAPDAAGQPLPLPLQDDYFPLMFAEPQSQANLRLAGMDIWQQPLLRQTLQDSLNSGRTTLSRQLRLPNGEAGYALLRSIDNHQSGALLELQPQHFALLFIRADSLLPSGAPLPPGMEISVQQRDDPLRPPGGQPLLLGSARAGALERLLFPRLETSQLLGGPGQPLRFTINWQQGWPQIGLLEWVVWLLLSLLLGTGLALAGYSFVRSSNSRRQRENHLFHLANHDRLTGLANRNLFYDRLQHAISRVDRSGKRLALLFLDLDRFKPVNDTYGHVAGDRVLQLIAARIQDVIRNEDTVARLGGDEFVILMEDIESNREADKVMARLKQAIQLPYQVDQHRIMVGVSIGIAYYPEDGLLIDELLAVADRKMYGNKQSPSHQSETVA

SEQ ID NO: 4696 - protein, 248 aa, Chromobacterium substugae
MGALSELRVVVVDDEALARERLRQLLADCGVSQVHCLADGQSALAWLAQHPADVLLLDVSMPGLDGMAVARQLRQRPLQPQLVFSTAHDHFAVEAFELNAADYLLKPVRRERLEQALQKALARCGGQAEAPSFTVRQRGRLLTVPFADARYLKAELKYVTLVTPDNEYLLDEALVTLEQRLGGLALRIHRNCLVMRHAVQELRRSGLDGDEQWVIRLRDVADPLPVSRRQIPAIKSALSAAPLLRTIT

SEQ ID NO: 4697 - protein, 578 aa, Chromobacterium substugae
MPQADESPMSESTPPPAAPNGPTHHVRAAPQRNAYDDPYAKRLFLIIDSLPQMQRALAMTLSSFGANSVEYAAKAGDALAKMAKYEFDVVLCDYDLGNGYDGLYLFEEVRARNLLKQSCVFMIVTGERRSQRVISAAEMAPDDYLLKPFTGEVLRERLERAMRKREAFRLVDENILRHEYLAAIEACGRKIEENGEFAFDFMRLKGSLALKIEDYDAARDAYMQVLRLKPATWAKMGLAKSLAGLKSLDEARLLFEAVLADNSQVMEAYDWLARLYRNHHDLERAQHTLQTAAEMSPAVFRRQQQLAEVAMLNHDLATAEAACQQTLDIAKYTWHRSPTHYAALARIQLARGDAANAGRTLASLRHDYRYNEEAEWLANVVDSQLQAKNGNADKAAALLADATERFKPLAAKLDQEAQLEYARACYQQGREPQGNEVMEYLVRNHHDDEQLLAHFGDMFEELGMGQAGRQLIAQNVKTVLELNNQAVREAQSGELDTAIARFAKALEEMPQNVQIMLNLVNAVLAHVSQNGWHESHMRRAYELLGKVRDIAPTNNKFQKILQSWRQLVDKMDKPQWAL

SEQ ID NO: 4698 - protein, 713 aa, Chromobacterium substugae
MSDLLAGLNPEQLRAVTWPAKSALVLAGAGSGKTRVLTTRIAWLLSTAQTSPAGILAVTFTNKAAREMQTRLSAQVPVNVRTMWIGTFHGLCNRLLRIHYRDAGLPQTFQILDSADQQAAIKRLLKSLELSDEKYPPRAVQSFINGNKEAGVRAEALPPALNPYEAKLVELYAAYDAQCRREGVVDFAELLLRSYELLSRNEALRAHYSSRFAHILVDEFQDTNRLQYAWLKLLAGEHGALFAVGDDDQSIYAFRGAEVGNMRALLADFHVAEPVRLEQNYRSMGTILNAANALIEKNDGRLGKNLWTDAGEGEKIRFFQAMSDGEEAEFIVDEVKALRRDGLPLSDVAVLYRSNAQSRLMEHVLVNAQIPYRIYGGLRFFERQEIKHALAYLRLVANPDDDNALLRVINTPARGIGARSVEGLQAVGREQGVSLWQAACQSGGGRTAAKVGEFVLLIERLREQSRDFSLAETISLVIDRSGLRDMYEQDKKDGEERLANLDELVNAAASFLPDDPSQALTEFLTAASLEAGEHQADAGSEALQLMTVHAAKGLEFDAVFVTGLEEGLFPHENSLQDGKGLQEERRLMYVAVTRARKRLYLSSAQSRMLHGQSRYPIPSRFIDEIPAELIHSLSATVKTPASPMPARAASRTPRLQAANAYGLNIGQSVSHAKFGVGVVIQAEGSGEDVRLQINFAEHGVKWLDLRYAKLTPA

SEQ ID NO: 4699 - protein, 291 aa, Chromobacterium substugae
MQLFCLKRYQGYGVFLIHLNIRIPRIRHPVIELRESIYMASLHKKWLLPCLLLLAPLPSLAAAELRIGVADTDAAPIAVLSEDGNTLTGGLARELGMLLAEEMGMKPQFVILARRRVESAVETGKVDIVCNANPDWYSNSSRLNWSREIYPLTERVLSLKNMPAIRQLDDLSGKRIGTQHGYHYPELEYLWSSNRSTRDTEARFDLMFKSLEKRLSDVAIVTEFIYVWWARSHAQEAAAFKLHPLVVSSQPTMCALSSQSPVKLAELNRAVDRLHKNGKLKTMLAHYQAQE

SEQ ID NO: 4700 - protein, 1236 aa, Chromobacterium substugae
MTKPLTHPVYQHLAQRILILDGGMGTMIQRHRLEEADYRGERFADWPCDVKGNNDLLALTRPDVIGGIHQAYLDVGADIIETNTFNATSIAMADYRMEGLVWEINQAAAKLVKDLCAAQTAKNPAKPRFCAGVLGPTNRTCSISPDVNDPGYRNVSFDELVASYTEAIDGLVAGGADLLLVETIFDTLNAKAAVFAIHQYFDERPDTPRLPIMISGTITDQSGRTLTGQTTEAFYNSLSHADAASFGLNCALGPDLLRPYVEEMARVSATYVSVHANAGLPNAFGGYDLEPEKMGEYVREWAESGLINIVGGCCGTTPEHIAAIARAVDGISPRALPRIEAKCRLSGLEPFNIGDEDLFVNVGERTNVTGSRAFAKLILNGDYATALDVARQQVENGAQVIDINMDEGMLDAHAAMVRFLNLIASEPDIARVPIMIDSSKWEVIEAGLKCIQGKGIVNSISMKEGKEKFVEQARLIRRYGAAVIVMAFDEHGQADTYARKIEICDHSYRILVDEVGFPPEDIIFDPNIFAVATGIEEHARYGLDFIEATGWIKQHLPHAKISGGVSNVSFSFRGNNKVREAIHAVFLYHAIQRGMTMGIVNAGALEVYDEVDASLRERIEDVVLMRHPKDGGDATERLIELAEKFKGEAVGEKKGEDLAWRAFPVEKRLEHALVKGITTFIVEDTEEVRLKCARPIHVIEGPLMDGMNVVGDLFGAGKMFLPQVVKSARVMKAAVAHLEPFIEEEKIRLGLADAPAKGVIIMATVKGDVHDIGKNIVGVVLRCNNYKVIDLGVMVPCQTILDAAREHQADIIGLSGLITPSLEEMSHVAKEMQRQGFDIPLLIGGATTSKVHTAVKIAPHYQHPVIYVPDASRAVGVCSNLLSDTLKDAFVAENLAEQERAREGHANKANRKVVSLEQARANKEKIDWADYVPPKPRWLGVRRFENYPLAEIAAYIDWTPFFQSWELAGRFPRILNDEIVGESARALYEDAQVMLKRIVDENWLAANAVIGLFPANSVNHDDIDIRSADGRPLMTWVGLRQQLPKTDGKANWALADYVAPQGSGVDDYIGAFAVTAGIGIEPHVKRFEDANDDYSAILLKALADRLAEAFAELMHARVRREFWGYAADEHIDNEGLIDELYRGIRPAPGYPACPDHTVKADLFKLLDAPSIGMTLTEGYAMLPTAAVSGFYFSHPASRYFGVGKVEKDQVTSYAERRGVSIEQAERDLAPNLGYDA

SEQ ID NO: 4701 - protein, 177 aa, Chromobacterium substugae
MTPKPRRLRVGFLLAALLAAGLSWRQSRLPADCFWLSRAACLARLGAGMDKQISEVWSSGQRHGSAQLLLARDGRYQIYSLRDDVDGGIDVAEAGRWQEVNAELTLRPLLGGAGAARCHRQCHQGRYYLAQFPHPTDMARQMRAWGEDRSGLPPAPPSAKPDATALWQGGQTSACPI

SEQ ID NO: 4702 - protein, 164 aa, Chromobacterium substugae
MSGPKGILPKAAVAALLFVVCCALCACRPNAQVRRDSVNREAEELSRKLPEEGSQIWLYYGLTVIQQRLTLAANGYYAWESASDDGGAPPPDRDYGRWREEKDQLVLVSQFDGGETRLQAGCRDGEFVWLYGYADEEPAWHGNGEHSCSEIQHPAKSDKPLAFR

SEQ ID NO: 4703 - protein, 141 aa, Chromobacterium substugae
MKQRIWLVWLLGLPWAAQAAVQSDTRCFVAANGGKPIHLQFTTVGDADADWTAAYVRYGKRGKAITLVWLRTEQEEMAEGRPYQFTDEWLEIVDGRINGRYTTIHQGANYYGFHYRGANGRDIDFDEDLGARAASQHACKY

SEQ ID NO: 4704 - protein, 136 aa, Chromobacterium substugae
MKKTLLSLLLGLLAVCHQAGAETIKTRYGVVSDEDRIELRLGKKTIYSDSDNSVYLQGGSSYALQDRDVVLVSSDCGGSVKKYDLGDFNPGTNATAKLENGQLRVTFSAEGRKQGAVLFDGDKVRKAAEKRVKPKP

SEQ ID NO: 4705 - protein, 264 aa, Chromobacterium substugae
MLRRISAVIAGWPFLIALCLLLANDWWLKSAHPGLSGKLSDFAGLALAGLLAQALWPRRFAATSAAIALAWLWWKSPLSGPAIAAVNAWLPFALSRTVDYGDLLALAVLPLCRLAFERRERLALSAPAARRWLTPPLALAALLACVATSAPQLNQKYGIRSRAESADLDRAKAIEAFNAAAQAFQLQCLRCDPAASDGEYIGGEPRTQLYYHFVSSREVRFDVFWTAPGLFSGDKREQLQALRDRIRREMALRIPHLDYLEPIS

SEQ ID NO: 4706 - protein, 265 aa, Chromobacterium substugae
MRKRLAAAVSGWPFLIALCLLLANDWWLKAAHPGWLSGKLSDFAGLALAGIVLLAAWPRRFGEICAGLAAAWLWWKSACSSSAIETFNALAPYRIGRTVDYSDLLALAVLPLCRLAVVRRKRLALSAPAARRWLAPPLALAAVLACAASAVPYSQQYGVRSRASAARMDRVKVVEALNAVAAQYQLRCESCDPALDKGVYEGGGKHSVLLRYQFSSNQEVRFDIWTVLPCVFNGGERERLEAMRDSIRYQMAQRIPGLDYLEPIN

SEQ ID NO: 4707 - protein, 89 aa, Chromobacterium substugae
MEWLNRESLLGLMEDVEAEDPIDYADLPFDERNLRELIVDSLLERELVFRAEEPDASRRMLVYLAATARLTLENMVLHARLLRAGRAED

SEQ ID NO: 4708 - protein, 161 aa, Chromobacterium substugae
MKKILALSACALALSGCSAMTTMSSSAPKGAVSIYQRQQVTTLDLPKTETYPTTSFGNYEFKATGEGKQPLYGLLPLKFNGGYVAADILFFAPALFFNLREVYPLYDFDLDKGVVRYRLKDTDNWTEYKPTQPEAERARSHIDFAASQPAAEAAPVKTGSN

SEQ ID NO: 4709 - protein, 205 aa, Chromobacterium substugae
MLRILGRTSSINVRKVLWTCHEIGIDYQREDWGRGFQPTSSPEFLALNPHGLIPVVVDGDTVLSESNTICRYLAAKHGRHDLLPQNPAARAQVERWMDWQAADLNPAWIYAFHALSRNSPDHQDPASIAASVAAWKKQMAVLESQLGDGWIWGDAFTLADISLGLSVQRWLLTPFDKPRLPAVEAYYQRLRQRPAYLTHGSDGVA

SEQ ID NO: 4710 - protein, 222 aa, Chromobacterium substugae
MSDKQWNEVDDYFSRSLVQQDAALEAALADSAAAGLPAINVAPNQGKFLHLLARIHGARRILEIGTLGGYSAIWLARALPADGRLVTLEYDPRHAEVAAANLARAGQAAKTEIRQGAALDSLAQLIAEGAAPFDLIFIDADKPNNPHYLEMALRLSRPGTVIVGDNVVRQGEVANAGSVDPAVQGTRRFIELLGANPRLSATALQTVGGKGYDGFALAIVEA

SEQ ID NO: 4711 - protein, 69 aa, Chromobacterium substugae
MIELAARGMGIACLPDFSIHRELASGALLRLDAPAVRRSGNLYLLWPATPRMPPKLRAFIDYMAANVLA

SEQ ID NO: 4712 - protein, 259 aa, Chromobacterium substugae
MQPTLGAQAGSMLYRDASGRYCASLAGYRLLSAFQPIFYKGGSLFGHEALLRVVDEGGEWHAPDRFLAAQAPEMALEADRLARLIHVRNFAQSSQSGCLCLNLMPATVQQDQSGRTHLPLLNNMLQSVELDSGGVIFELPEFEVEHHGQPLLNGMRHAAEMGFGLAVDDFGALPARRDKMGELSPDIIKIDRSLLLDHMAGETSRLPALLEFGWQIGSRMLIEGIETAEQLEAMRALGVELYQGYYLGRPGELAVARQL

SEQ ID NO: 4713 - protein, 254 aa, Chromobacterium substugae
MLILNQRQQELLDMVRRDSYVSVEKLAEHFAVTRQTIRRDIALLAEHQQLQRYHGGASVLSSVENVAYQARQVLCIEEKRRIAASLVRHIPDNASLFINLGTTTEEVAKALHRHRGLRVITNNLHVAEQMCDYPDCEVIVLGGSLRKRDRGLTGEATVQMIRQFRVDYGIIGVSSIESDGTLRDYDYREVRTTEAIIQQSRQVFLAADHSKFDRPALVELGRLNQIAALFTDKPVPPAIARLMQEAGTQLHIAE

SEQ ID NO: 4714 - protein, 363 aa, Chromobacterium substugae
MDRIDTVVVGAGVVGLAVAKALAENGREVVIVEAEQAIGQHASSRNSEVIHAGLYYPAGSLKAKLCLAGRDALYRYCAERAIPHQRLGKLIVASHAGQLAKLAALEKQARANGVADIQRLTADEARALEPALDCAAALLSPSTGIVDSHALMLALLGDAEAAGAQLALESPLESGEITPDGIVLRVAGMEILASRVVNAAGLFAPDVARALAGLPPEAIPQAHYARGVYFSLQGRAPFSRLIYPLPEAGGLGSHLTLDLSGQARFGPDVEWLDGVDYRVDPARAEAFYRAVRAWWPQLPDGALSPGYAGIRAKIAGPGQPDADFIIQGPAVHGAKGLVNLFGIESPGLTSCLAIADAARALID

SEQ ID NO: 4715 - protein, 172 aa, Chromobacterium substugae
MLIADLVIRPARSADFSRLAEIESLAARLFSPADLPLALRARTLPEAALRAAADAGLLWTAEQDGRAVGFAMAEIVDGQLHLAEMDVDPAHARRGIGAALLAQVAAHGEGAGFAAVTLTTFAHLPWNAPFYHRHGYAEHAPAAGSALAARLAAESAAGLRQRIAMRRALRPA

SEQ ID NO: 4716 - protein, 474 aa, Chromobacterium substugae
MPQYQDIARQLQTRLDAGEFPPGSRLPSVRQLAENHGVNSLTALAAYRWLEQRQRVVARPRAGFFAALPPASAAGKPDKALPSPATLVEVDSRMSQLVALSASNVAVQLHMAEAHHCLYPSAELARRLQNALQQRPELIGAYLPASQHDRLCEQLRQLAAGWQLAIPSDEILFCNGITEGISLALRHLARPGDTVAVETPVYFGLLQTLAALGLKALEIPCTPDAGLSLEALEFALQYGPPVRCLVTVTNYQNPTGALMPDDNKKRLLALARRHGVAIIEDDVFGELHFDEARPTPLKAWDRDGDVIYCASFTKSLAPSFRLGWLSGGRRHAALERLRASSSLVSPALLLGTLSDLLASGDYARISQRLRSQLARQMEQVADAVLAAFPRGTRLRRPQGGLLLWVEGPEGLDSGRLLEAALRESISFAPGMLFSAEPRFRHCLRLNFGQPWDAAQQQAIARLGQLAAEQLRSPC

SEQ ID NO: 4717 - protein, 109 aa, Chromobacterium substugae
MQLSGIPFGVTDWADIPAAEHPGEQGRAYWRSRQFGDIRVRMVEYTPGYLADHWCEKGHILLCLEGELHTELDDGRVFILKPGMSYQVADHAEAHRSRAPQGAKLFIVD

SEQ ID NO: 4718 - protein, 401 aa, Chromobacterium substugae
MWQTLRRDAAPSALLAAVLALLVGFSGPFLIIVHAAQSAGLSQAQLASWVWAVSIGSGVAGLWLSLRWKTPVIAAWSTPGAALLLAGLPGVPYPEAVGAFLAAAAIVTLVGASGLFDRLMALFPPALAAALLAGILFHFVGEVVAEAAGHLGLVLTMAGLFFIGRRWFPRWGLLAAIAAGAALSAGELHAPAASALSIVAVPLFTWPAWSWSAFINLALPLALLALTSQFLPGMAVLRAFGYQVPARSPVTALGLASVLTAPFGGHGVTLAAIIAAICTGPEAHPDRSRRYVAGVFCGLIYIVMGALGGALAALALALPKALLVTAAGLALFGTLASSLGAALADAEHRESALLTFVVAASGVSFAGLGAPLWAMLAGGLLCRLLTPGKSPAQKAETAAAR

SEQ ID NO: 4719 - protein, 462 aa, Chromobacterium substugae
MFAPSVYAQRRARLQASGLSGLLLFVGNVDSPMNYHDNTLPFVQDSSFRYFFGLNEPGLAGAIDADSGEATLFGNDPDVADIVWTGPLPSLAERAAKVALSRSRPYAELAQAVAEARAAGRPVRYLAPYRGETLIEMGRLLDTHPAQVKAGFCPELTRAVVALREIKGAEEIAEMEAALGVTHAMHIAAMQNAKPGVVEYQVVGIMEGIMRRHDWQLAYPSIFSKRGEVLHNHHHDHVLQQGDLVLNDTGCASGGGYASDITRTFPVGGKFSTRQRELYDIVLEMQEAAIAAVKPGVKYQDIHKLSAAVMVERMAALGFFQGDVDAIVESGAYAIAFPHGLGHQIGMDVHDMEALGEDLVGYGDGTERSKLFGLGYLRLGKTLKAGMALTVEPGVYFIPALIEAWEKEGRHSQFINYAKFREYADFGGIRIEDNVLVTETGSRVLGEPIPKTVDEVEAVMAV

SEQ ID NO: 4720 - protein, 284 aa, Chromobacterium substugae
MTPVYFAPAAMTHPPLPALHPPPPGLAALLGDMLDIALPGGPLLLPATLHPMLLFIAGGDIHLAKHGALAPAGLLGGSAGVRLLAASPGARILMAWLKPGQLPRLFGIAAGEIFDAYLPLDSLLPPAWLSPLGDAVGDDWLPPAQALLSRLAGRHGQRAPTLALPADWPRRSADQLAAHFGLSLRQFERRFRAGAGQSLRAFRPQARLNRLLLHARWTPSPDWADVAAAAGYADQAHLHRDFVRFAGRTPSAYVQGLGDDPALRLYRLPREAILRMCAEPGLRA

SEQ ID NO: 4721 - protein, 167 aa, Chromobacterium substugae
MSVHHDFSAIPPLTDAASRYPWQDCCSVPLPPDAPAADAADLLRAFSRAMPPWARALMRLRDRLVSPLGLKIDQTNHTGGAPVEPFHVGQQLGVFRVLYLGERDAVLGEDDRHLDFRLVLQWRPGRLHVSTLVRPHNGLGRTYLALVTPFHHLIVAASMKRMAEALG

SEQ ID NO: 4722 - protein, 208 aa, Chromobacterium substugae
MDALTVLRQGPVVPVIIVNDAAVAVDLARALVDGGIKVLEVTLRTKAALAAMRRMRDEVPEAIVGAGTLRNRAQLEAAVDAGAQFGISPGFSAELASAARASQLTLIPGIATPSEAMWAQDEGFNTLKLFPAEAVGGVKLLKSLASPFPDLRFCPTGGIDIKKAPEYLALPNVLAVGGSWLTPDDAIAARDWGRITQLAREATQLARG

SEQ ID NO: 4723 - protein, 610 aa, Chromobacterium substugae
MALHPTLSAVTDRIVQRSQARRSAYLARARAAAQQGRVERAHLSCTNLAHAFAAMPDNMKIHLKEEHRPNLAIVSSYNDMLSAHQPLQAFPAWLKEAALAAGATAQFAGGVPAMCDGVTQGQAGMELSLFSRDVIAMSTAVALSHQMFDAALYLGVCDKIVPGLMIGALTFGHLPALFVPAGPMTTGIANDDKAKVRQLYAEGKVGRDALLESECQSYHGPGTCTFYGTANSNQMLMEIMGLHLPGAAFVNPNTALREALTRAAAVQAAKIAAQGEQFTPVGEMIDEKSIVNAIVGLLATGGSTNHTMHIVAIARAAGIDINWDDFDELSAVIPLLVRAYPNGKADVNHFHAAGGMGFVIRELLAAGLLHEDVGTVMGRGLSHYTREPWLDNGELKWRDAPAVSGDDSVLRPASNPFSADGGLKLMAGNIGRAVIKVSAVKPEHRVVEAPAVVFHDQNDMLAAFKRGELEKDFVAVIRFQGPRANGMPELHKLTPALTILQERGFKVALVTDGRMSGASGKVPAAIHVSPEALSGGAIGKVRDGDLIRVDAHTGELAALVNAAEWAAREQVQADLSHNEYGMGRELFAGFRHTADEAEAGAMSFRHPAWN

SEQ ID NO: 4724 - protein, 492 aa, Chromobacterium substugae
METRSTPTPAFDMVLFGGAGDLVMRKLLPSLYQAHAAGLLNEQGRILALGRKDLSRDDYLASVEKQSRIHIKSHFDDAAWQSFCARIDYLKVDASQAADFPALAEKVGDDSGKVVVCYLATAPNLFAGICDNLAAVGLNRPNVRVVLEKPLGTDLESSNEINDDVARFFKEEQLYRIDHYLGKESVQNLMAIRFANALFEPLWRREWIHDVQITISEELGVGSRGDFYDGTGALRDMVQNHLLQLLCIVAMEPPANMEADAVRDEKLKVLKALRPFSEQDVAAKTVRGQYKAGAIGGQPVVGYQDENGIPAGSQTETFVALKAEIDNWRWAGVPFFLRTGKRMQERLAEIVINFRDVPHQLFTGPMGGSHTANRLVIRLQPEESIRLYFLAKEPGDTMRLQPAYLDLDFYKAFKVRRADAYERLLLDVIRGKLALFMRRDELIEAWRWVEPIMDTWSRSNNAPPKQYTAGSWGPAASSALLSRDGIGWHEEC

SEQ ID NO: 4725 - protein, 225 aa, Chromobacterium substugae
MNWLEFPDAAQQTDALANSVASRLSAAIASRGQAVLAVSGGKSPIPFFQLLSEMAIDWSRVTVTLVDERFVAPDHPDSNAGLVRQHLLRNRAAPARFLPLVRAAADIDAEVAADCHEFIAPDVAVLGMGEDGHTASLFPAAAELAAGLDPAGSRPLLAVTPPAAPHRRVSMSYAALLQAGCLILSIQGAKKREVLEAAARGRDDALPISHFLAQDKAPLDVYWSA

SEQ ID NO: 4726 - protein, 348 aa, Chromobacterium substugae
MSTGLPEAWPRLLADIGGSNARFALETGPGVIEDILVLANAQYPTLEDALKSYLAQVGARRVAHAAIAIANPLNGDWVAMTNCHWAFSIEATRQALGFATLLLLNDFTALALALPGLPRAELEQIGVGAARADAPLALIGPGTGLGMSALVPHAGGWRALSGEGGHASFAPADEREAGIWRYAAARFGHVSYERLLSGPGLELLYQALSARDGESAEPRGAAEISALGLSARCLRCREALEIFCGILGSAAGNLALTLGAHGGVYIGGGIVPRLSGFFEQSPFRRRFEDKGRMSAYLAAIPVYLITSAYPALPGVAAHLAAHLASRSDHAPVDASTPPRGGFAGDMHA

SEQ ID NO: 4727 - protein, 282 aa, Chromobacterium substugae
MLDRIRGQLETLSSAERKVAELVLEQPYTVIQAAVADIARNAGVSQPTVIRFCRTVGCSGLPDFKLKLAGSLVTGVPYVHSSVRPEDPTSEIVAKVFDNTVSALLKCRNDVNPQAIEAAVRLLTDANRIEFYGLGNSGIIAADAQHKFFRFGIPTVAYSDTHIQMMAASVLGPEDVLVAISSSGRTMELLEAVDVAIAAGAKVIALTTSGSPLARRATVSLIADTLEDNETYSPMISRIVHLVQIDILAVSVALRRGPGLIRQLEKTKHSLKNRRLDNRQPE

SEQ ID NO: 4728 - protein, 547 aa, Chromobacterium substugae
MSELTELPAWQALWDHFAEARHLHMRELFAADPERAERYSLEVGGLFLDYSKNRITDATLLGLMQLAREAGLPAKIKAMFKGEKINRTENRAVLHAALRNRTNSPILVDGEDVMPKVNSVLERMGRFSHAVRSGDWLGYTNQPITDIVNIGIGGSDLGPLMVCSALKPFGHPRLNMHFVSNVDGAQLKETLKKVHPETTLFVVESKTFTTQETLTNALTAREWFVARARDEKAVAKHFVAVSTNQKAVADFGIDPANMFEFWDWVGGRYSLWSAIGLPIMLYLGEENFTELLNGAHIMDQHFKNAPFEQNMPVLLAMIGVWYINYYGGGSHVIAPYDQYLHRLPAFIQQLDMESNGKKTMLDGQPVNFETAPIIWGETGINGQHAFFQLLHQGTHISPIDLIASLENRSSLPGHHEILLANVFAQAEAFMRGKTADEARAELAEQGLKGEALDELVPHKVFDGNRPTNTLLMSRLDPRNLGSLIALYEHKIFVQGVIWHINSFDQWGVELGKQLAKTIHGELTGKLPLAAHDSSTSRLIQLYRKANA

SEQ ID NO: 4729 - protein, 39 aa, Chromobacterium substugae
MFAWRHSRDFPDCRTGCRLLKWRAKSDKNNGLKKNHRDV

SEQ ID NO: 4730 - protein, 117 aa, Chromobacterium substugae
MLAGVLLAFSLAGHGAGQPVHPAGDAAAPIILSGTVVGPLHTGSKAEGTFFQAYHLKLARPLRFDDGAACGGQRLSSLALSQPGMARFKGRAVRIQARVFCQEDRGATYRLADISLL

SEQ ID NO: 4731 - protein, 190 aa, Chromobacterium substugae
MKIESKSAFTSRKKLNFGPLTLYRVRDARGAINLVVSGNPGYSVGQCVTLWRSVSGAQWEMYHDYSNAYPRLTRANGDCSALKIEPSGNERYYYTQYDWNWNQIETFIRDIQLGRTEAELLSELGAPDASYVNGKTTYLSYTRASTSVYGDVQNGSGGFSSRQNFCKRTFMVQAGIIVNYTLEGNDCRLK

SEQ ID NO: 4732 - protein, 208 aa, Chromobacterium substugae
MANRIEGLYAVTPDGCDSERLLELAAAALEGGARVLQYRDKSRDPARRLWQANLLASLCRGRGAAFIVNDDIELALATGADGIHLGRDDGDIAAARARLGPAAIIGASCYDQLELARRAAAAGASYVAFGAVFPSQTKPGAAAAPLSLFAEAAALRLPRVAIGGITAANAGQAIQAGADAIAVIGGLFDQLDPAAAARELAAMFPQPA

SEQ ID NO: 4733 - protein, 272 aa, Chromobacterium substugae
MVLTLAGSDPSGGAGIQADILTLASLGCHPLSVITAITVQDTVGVNDLMVLDADWVNDQARFLMEDMPVAAFKIGMLGSVENVAVVAQLLADYPDIPVVLDPVLASGGGHELADEDLIGAMRDILIPQVSILTPNSLEARRLASNDPDDDEELTLDQCAERILALGCPYLLITGTHENTKEVVNSLYSPDGVVRADHWERLPGSYHGSGCTLASAIAGMLATGLLLPEAVREAQEYTYQTLLNGFRPGMGQFLPDRMFWARGDDEDGDGKPD

SEQ ID NO: 4734 - protein, 65 aa, Chromobacterium substugae
MFILSEHEGEAMRTWMCLICGFIYDEEAGRPEDGIPPGTRWEDLPPNWTCPDCDARKDDFQMVEI

SEQ ID NO: 4735 - protein, 115 aa, Chromobacterium substugae
MVLSAAFLDDMLGYARGLPGAVFDVKWGGVRVVSIGGKMFLACGGDGLSYKVADDDFLTLSGLPGARPAPYLARARWIQVLSTEALSPDDIRAGIARSRELALSKLPKSQRLAWQ

SEQ ID NO: 4736 - protein, 138 aa, Chromobacterium substugae
MSYLYLKAFHIFFVVSWFAGLFYLPRIFVNLAMAQQPAEYDRLLQMARKLFRFMTPLAVLAVGTGLALWLDFGIGGGWLHAKMALVGVLAAYHGYCAKLGRDFLTHSNRKSHVWFRVFNELPVLVLLAVVILVVVKPF

SEQ ID NO: 4737 - protein, 151 aa, Chromobacterium substugae
MRRAWFAGPLLAGWLVQAAAAAALPPALLLSVERDGEVVRQLPLCLAADGGFGADQQRDGAALEVSGRLQALRNHPHPLLSFRLSWRDEAGAQQLDSQLALEGGRQLLGGLPLLVYPYGHAPGVEPQRSSLTFYLEPQAACPPAAPAKTKE

SEQ ID NO: 4738 - protein, 153 aa, Chromobacterium substugae
MGLEIERRFVVSGDAWRGLAPAVQYRQGYLSVEKERTVRVRVVGQQAWLTLKGNISDVSRHEFEYPIPLADAQTIMAAMCPMVVDKLRHRIEHGGFVWEVDEFFGDNAGLVLAEIELPSEDTPFAKPAWVGEEVTHDGRYTNAYLSKQPYTRW

SEQ ID NO: 4739 - protein, 121 aa, Chromobacterium substugae
MAKLARWGLFSLFGIYALISPLYFRQVFHLTDLGAMSVLMLARELFLYLLGSLSLLIAIWQSRSSHARGKFCYLAAALLLGVTAIMIGLSYYRAIYMLGGCSIAVMGFGLSLAHRPEHAPA

SEQ ID NO: 4740 - protein, 425 aa, Chromobacterium substugae
MSRNLELFERGKKVIPGGVNSPVRAFGQVGGTPRFVARAEGAYFWDADGKQYLDYVGSWGPAIVGHAHPEVVKAVQDAAVGGLSFGAPTEGEVVIAEEICKLLPSIEQVRLVSSGTEATMTAIRLARGFTGRDLIVKFEGCYHGHSDSLLVKAGSGLLTFGNPSSGGVPADFTQHTLVLQYNDVEQLSRTFAEIGDKIACVILEPIAGNMNLIQPSAEFVKTLRSLTERHGAVLIYDEVMTGFRVALGCAQSLHGVKPDLTTLGKVVGGGMPLAAFGGRADIMGKIAPLGTVYQAGTLSGNPLSVAAGLATLKLIQQPGFHDTLGRRSARLAQGLAEAARQAGVTLSSDSVGGMFGFYFSAAAPKSHAEATRCDIEAFKRFFHAMLDEGIYFAPSAYEAGFVSIAHSDEMIEQTIAAAGRAFARI

SEQ ID NO: 4741 - protein, 429 aa, Chromobacterium substugae
MWMERKTRLRLAAGACALAAATLAVGWLLRGGDQIKVERLALAAAPGRELAASLMNRAYGSEQHDARRDCWHYLREDGGDYCLRPLALDSAAIGRERRLYLFAGGGKDGARDEERGGMVGAFVADADTLAPIAGSRELDFLNQKAAGPEQVQLLQLSGDGYMGWFAAGRAGVEEFPQFYAPRGDEVVAIGGEVFGRDADAVAGLKFAYQLDSAQRGGRVYPLSLVVRDGKDKQLASFDFRFDRRRWEYVCADVDCRVRAGLPTRPERVANAQQAPAADANEALFGRGRKLSDADLRDVLGQLGMRYVAEDGAAGFVGQNGCDAPYPLDAHFERDGGQEQLWVRGGDGCTSGAAGASVWVFVRGDDGRLRANLGMPAADVRRTRDVSAGVHDLRVGSAGFCDRLWRWNGKAFVHLLNIPTQSGGCDGADL

SEQ ID NO: 4742 - protein, 441 aa, Chromobacterium substugae
MGNKKKLALLAGGALLLIAVGFGGWKYWKAHQAVQVERLALDGEPGKQLADDIMDKMYGRDARDGKQGCWNIDAGNGGEETVAYCMKPLALDRVQAEGEERLYLFAGGSFPDASHADSQALVGAFVINAKTQELIAGDRELPFANGFASAPSEVKLLPLSATGYMAWFAEGGDMHQGISASFPQLFAPKGKKVVEISGDLFGKSEGMSEELSFDYRPDASKADAKVYPLLLTVKQDKDKTAASFRFVFDHKAWHYVCADQACRKQQGIPAYQEPAADDDDGEQPAQPPADANAALFDDGNKLSDADLKDVLAALGASYVVKDQDNWGFVTEQCRQPFKLSASYPSDEKDSHNELWLEGGSACTSGTTGQSVWLFIRGEDGHLRANLGVPASKTVVTGDLNNGRYDLRLSGNGFCEAVWRWDGSQYAHLKNIATQPGGCGGE

SEQ ID NO: 4743 - protein, 446 aa, Chromobacterium substugae
MKFNKKHWIALAIVGVLLLGLIFAAYRVLHQSNGRAERLDLGSEQNRRLAAELMDKLYGHDAYDGKQHCWANNDSDADYCMKPVQLDRVDSAAGPRLYLLAGADGHTVQTETGGLDLWSALGAAIANGDSHELIASTRMVSFIDDARKAPSDVRLLQLNGKGDMGWLLEGMTSRRGEPLLLAARKDQIENIGGELFGKLPSDAEQRFDYRVEAGSGDGYYPLQLSVGGDKQRYRFVFDDKTGLYQCADDDCRQRWQSWSDAGNDTSAQNDDSGDESAAATQPPADANAALFDDGNKLSDADLKDVLAALGATYVVKDQDTWGFVTEQCRTPFRLSGSYGKTHDEDHNEIWIRGGDSCTSGATGQSIWTFDRDDDGHLRVSLGVPATKVVVVTDGPNSPDDNPRNDIRLSGNGFCESLWRWDGKQYQRLRNEATQPGGCDREPAAQQ

SEQ ID NO: 4744 - protein, 910 aa, Chromobacterium substugae
MTEAQSSTRLIWRLRLADSGVQLQPLLQSAGPDGWSRGRACALAGLLRDEAAAVRPHDLPLLKPLLALWQAHDGDAGLIDAAPLLPALVDHPLLFDADAPARRIRVEAGQPALQMERVGAELRLKLLPEGLAGCGGVLWRRPQPERLLVYQLTDELKALADLVGHGLTVPWQARQRVLEAIRDVAPGLPLVDASPQFDAALPSEAADATLYALLTRQPEGLRLQLKVKPHPAAAWSAPGRGAAGLVLDVDGEYRQFIRDLADEAARLRALREACPAIGRGQRDGDGWLFSDQHSALSLLAQLQAAGEERVACLWPHGDKIRLAAADGMPQLKLKVKRRGGWLQADGELELDDGRILTLRHLLAALANQKGKYLQLSDGDWLALSGSLGERLGELARMVDHAGPDGLAISPLAGPRLQALGEEAGQFDGDDGWQRQAARWREAAVFDPQVPATLNATLRPYQLQGFAWMARLAHWGMGACLADDMGLGKTVQTLSLLLTRAHLGPQLAVAPTSVALNWLAETARFAPSLRLRAYHQQRRLDDIGPGDLVVVSYGLLQREAEAFGDVHWASVVLDEAQAIKNPQSQRAQVAQSLRADFRLAASGTPVENHLGELWSLFRFIAPGLLGNLAQFEQRYAQPIADGDEAARAQLKALIQPYLLRRTKREVLTELPPKTETTRLIELSEPERHVYEAMRQEALARVAEADPAAGGQPMQALAELTRLRRFCCHPKLVQPDSALPASKLAAFADICEELLDNGHKALVFSQFVDHLALAAEHLRQQGVRFHYLDGSTPTKQRKASMDAFQAGDGDLFLISLKAGGTGLNLTAADYVIHLDPWWNPAVEDQASDRAYRMGQRRPVTVYRLVAAGTIEEKIVELHRDKRALADSLLAGADISARLDGEALLALLRGDAG

SEQ ID NO: 4745 - protein, 305 aa, Chromobacterium substugae
MPSSPSRQGYLAAAGAVAIWTGFNIVSRLAGKSALAGTDILALRVGTAALILLAYGGLPRGAVRDPRQWLLALLGGLGVSVFAYCGFKYAPAAHGGLLLPGLQPFLSAAFAWLLAGEAVQRHKLPGYALIALGLAISAAPMFGDAGGHTLPGDVLLLLSSLCWASFGVLARRWGFQPWPLTRAITILAALIYLPIYALLLPKHLAEASWGMLAFQALYQGAGAAIGAMLLYLRASAILGTVRVSALFALIPLLAGLLAVPILGEPLTGYLAAGLVCVSLGAWLATRQGGAPAPAANLPAPAGRAG

SEQ ID NO: 4746 - protein, 302 aa, Chromobacterium substugae
MELDELRIFQAVLQEGGITRAAQRLNRVQSNVTTRLRQLEDKLGVELFLREGKRLLPTDAAHRLGGYAERLLALAEEARQAMQDQTPRGQLRLGAMESTAAARLAPLLADYHHCHPEVRLELQAGESRALLHAVLDGKLDAALVSGPVDDDRLEQTAAFEEEIVLVAAAGLAQLSLHFLADSTLLTFGSGCAYRQRLEHWLRRQGVQPRRIVELTSYHAMLSCVASGMGLAMVPRSLLDCMPQVAGQVSVHALPADLSQARTVLIRRRQWRQPALDALQRMLQEKYQSPKPVEEFPFISNSL

SEQ ID NO: 4747 - protein, 274 aa, Chromobacterium substugae
MKKTIALLLAAGCAASSAEALAWGQEGHRVTGYIAQQLLSAPAKAAVDKLIPNADFAQLALYMDQHKQELKQTLPGSDQWHYNDEPVCAGVTEDECPDGNCAANQIERYRQVLADKSAAKADRAQALTFLIHMVGDIHQPLHAADNLDRGGNDFKVQLPGSKKVSNLHAVWDTALVQQQLNGANEKTWAAADLQRYQRNVAGWQSGGVMDWVHESNQYARADVYGPLSGFACGASPATPVYLDNTYLRAGGLLVEQQLAKAGARIAAVINQALN

SEQ ID NO: 4748 - protein, 213 aa, Chromobacterium substugae
MSLNLADVRLEYSKKELSPEDCLPDAMAQFEVWLNEALTAQVPEPTAMNVASVGADGRPASRIVLLKGVENGQLLFYTNYLSRKGQQLDHNPHVALAFFWPELERQVRIEGTVARVAAEVSDAYFASRPYTSRLGAWASEQSSEIASKAVLVTRAAMFGARHPINVPRPPHWGGYAVTPERIEFWQGRPSRLHDRVVYTLQDGGGWQRSRLAP

SEQ ID NO: 4749 - protein, 419 aa, Chromobacterium substugae
MLKLRQSALLVLLGLAGAAQAQPVWISVGDQGYQLLRKIDAGAKSQESRKLAADGRLAKGAAAGETVHLVQVDDALLPQLSDAIHENLRHCGGFIVHGSLKEARAALNGPAAPLAALAAPSYAIDNQATVNKLLPQLQDSNILGTIQSLSGYQNRFYTTSHGVNASNWIASQWKQLAGSRSDVTVEQFSHAGWPQKSVILTIKGTDNAAETLVLGGHLDSTVGNGTGENSRAPGADDDASGVASLTEVARVLLASNYQPRRTIKFMAYSAEEVGLRGSSDIAKRFKQQQVKVVGALQLDMTNYQGDAQDIFLFTDYTNAAQNTFLANLAKVYLPNLKVAYSQCGYACSDHASWNAQGYAASFPFESSFNNSNPYIHSGSDTLASSGNQARHALKFSQLALAYAVELGSDGPSAKAASLR

SEQ ID NO: 4750 - protein, 899 aa, Chromobacterium substugae
MTSEHDKDLPLRADLACLDRLLSEVVNEQEGPVVYGAVQAIAQRRGDERSHPLPQLAPEAAASLLRACGLYAQLFNIAEDLHHNRRRRAHQLAGSLPQQGSLARALHKLRQDGVSFHSLHQLLSHAQVGAILTAHPTEVQRQSVLDGHRAVRRFLCQLNAADLTPEEREALEAKLKRAILALWQTSEIRHFKMTVRDEITNGVAYHPLAFFEALPALYQRLEREIGQLWGEAPCLPSFVRVGSWIGGDRDGNPNVDAGLLRHAVTRQAQQAFEYYLQELKSLYRELSMSSRLVTASAAVLALAENSPDGAVSRSEEPYRRALATMQGRLRASARLRGIELNCRWDERAPYPDHRALASDLAALSDSLHAHGSALLAEGRLSRLIRSVDVFGFFLMPLDLRQHAAVHESAVAELFSAAGLEEYQALDETARVRALTRELATPRLLFSPYLRYGETTEKELAIFREAAAIQREFGVDAIGQCIISNCASVSDILALALLCKEAGLIRLENGAPRASVNLVPLFETIADLENSETVMRALFALPWYQQLLDSRARVQEVMLGYSDSNKDGGYLTSQWQLHQAETRLVKAFAEAGARLQLFHGRGGSVGRGGGPSYEAIVAQPAGSVAGRIRITEQGEVITAKYSDPAIAGRNLEALVAATLEASLGHVSGGETDIQAFDELSATAFAAYRALVETPGFMQYFLEATPVAAIAKLNIGSRPASRKSLAAIADLRAIPWVFSWSQSRLMLPGWFGVGSAVAAYVQKHGDAGLARLQSLYRHSPFFQVMLSNMEQVLAKADLGIARRFAGLVADPALAQRLFGMIEAEWQKTHDAFYAISGQTELLETNPTLRRSLETRLPYLDALGLLQIDLLARLRAEPEDEDTLHAIHLTINGTAAGLRNTG

SEQ ID NO: 4751 - protein, 314 aa, Chromobacterium substugae
MGPGFMDKIVIASRESRLAMWQAEHIQARLQALYPHLAVEILGMTTQGDQILDQTLSKIGGKGLFVKELEQALLDGRADLAVHSLKDVPMTLPEGFELAAVCEREDPRDAFVSNRFHSLSELPAGSVVGTSSLRREAQLRARFPQLTVKPLRGNVQTRLKKLDDGEFDAIILAAAGLKRLGLAERIRGELAPSESLPAAGQGALGIEIRAGRADLMALLAPLNHPATRACTAAERALAKELGGSCQVPLGAFATLNEGTLTLGGLVAHPDGSVVLTASASAPADYAEALGRAVAKKLVDDGAKPLIAAVLAEPR

SEQ ID NO: 4752 - protein, 176 aa, Chromobacterium substugae
MEHCIALIRGINVGKAKRIAMADLRQLAADLGGQDAVTLLNSGNLLCRYPSPARLAADLEAGIAGRFGFSARVIALGADLLPAIIAENPLRDIASNPSRLLVAFSSAPASLAACRDLTERQTGTERLALGNHAAYFWSADSILDSKLLQAFSQRTGDSVTTRNWATVLKLQQALAR

SEQ ID NO: 4753 - protein, 243 aa, Chromobacterium substugae
MTRVLVARPRSQAAGLLARLRAEGWQAGHLPLLELAPLAAGLAALPAQAAGADALFWVSPGAIDIGWPALAGQNLAGKRLACVGAASAERLRALSGLPVLHPRDGSDSEALLALPELAEVRGQRWLIVRGEGGRALLAQTLAARGAAVALAEIYRRLPGAPDWDDFDAAPPDAVVLTSGEMVEQLFRLAGPSRAGTLQCLLYCVPHPRIAERLAAFGATRIVTTRADDAALVAGLKEWFRRHP

SEQ ID NO: 4754 - protein, 345 aa, Chromobacterium substugae
MSESQINEAIQAPARPARKRPGLALWLAAAALGVAGWQFYSTQQQLDSMRQELARRLAEGSGAGKEQRAIAEQAMLAARATDGKLALVEARVNEAAGQYATLNGMYQELTKNRTDWLLSEIEHTLAIASQQLQLAGNVSAAVSALEMVDARLAKFDRPQLIGVKKAVATDLEKLKALPYLDSVGLTVKIDRLMLGVDSLPLVVDAHRLGGARGAHPAALPATAPWWERLSAEISASLGELIHIRRMDKPEALLLSPEQAFFLRENLKMRLLDARLALLQRDGKTYAADVAAARSYVQRYFDRDAAATVQWLATLGELEGAPLDISLPDMASSLKAVRDAQGASGE

SEQ ID NO: 4755 - protein, 398 aa, Chromobacterium substugae
MWITGLFALAVLVGLASTLNTGYAILFLPPYRMEVSFNLMIVLVIALIVATHLVLRLVALATDLPRQVQRFQRQKKLKAARHALREAGIAFFEGRFQKAEREAAKSLGDEYAPENRALALLIAARSASAAGAGDKRDDYLGQLDQLPERLQLARHMLDAELKLEDKDALGALAAIERARALSPNLTNALRLELKVRLLQKQPEAILSLTEKLLKADAVEPEQARRYRLAAYQQQLAGMLSEREVREWLRRIPEAERGNPQLLQQVVKHLIKLQQYDYAATLLAGALASDEMELPELSRELGQLASHLSVEKRLELLKDAENWLKLRPRDHWLLLALGRLAQAQQLWGKAQNYLEASVSIQPTLCAHAELGRLFEATGKEELSQQHYQKSLEMALNQGY

SEQ ID NO: 4756 - protein, 78 aa, Chromobacterium substugae
MIPSGHCRDAARLIGWRHFSWRIEAARQKKSDSAGSPFMPTWTGNNKSIRECGQTSCQTIRMPSGESCARINHYAWLA

SEQ ID NO: 4757 - protein, 306 aa, Chromobacterium substugae
MKLPPLNALRVFVVAAEHLSFTRAAAALSLTQGAISRHVQTLEEYYGATLFTRQARGLALTAEGEALLKPAREAFQLLNEASEALRLRQSDLRVRMPPTPAMRWVLPNLADFQARHPEYTLHLLTQLIHNKPFNRAEYDLAVVGLSSPEAAADLRLECICREKLIPVCSPSLLAGKHPLHTPQDLKHHTLLHPWRDQNTWKRWLKLAGVSGVNPESGVTFDALEYALHAAVTGMGVTLAQASMVTQDLDSGRLVIPFDTVLETEWAYYLVYPHELAELPKVRAFRDWLVGTVARSEEASWLTRQGY

SEQ ID NO: 4758 - protein, 539 aa, Chromobacterium substugae
MIDIATIALSIMNAPSPSPADIQALDFRQRLLAMLGLCCVLIMVALDQTVVGTAMPTVVADLRGFALYAWVGTAYLLTSVITVPIFGKLGDDHGRKPFVLTAIVLFTAASALCGLAQDMLQLVLARALQGVGGGMLVATTFASVPDLFPHTRERLRWQVMLSASFGLANAIGPSLGGFLTEYLGWRWVFFVNLPVGAVSLWFVWRYLPVIRHAAQAPSRLDWQGAVLIALFLGSLQLAVEWLPQHKSPWLLALLAALSLASLAALIWWEKRSPNPLLPPSMLAHPGLAPLFGLSLLMGFGMFAVMYYAPLMFQAGFGLSPNHAGILVTPLVVFITIGSMLNGRIVQRLRRPTRLLSVGLLMFALTAALLSQAGPATAHWLIIANMVMGGLGLGLLMPNLTIFVQQLAPRRQLGVSTAMLQSTRMVGGMLGTAVMGAVVSHQFQLGVAGMLAAGHAQAWLHWLGDPQTLLNADSLAQFRHAAAAADPERLLAATRQLLVDAIHVSQWLVAGGLLLGLWLVRKVPAITLSSAAAPREPQHD

SEQ ID NO: 4759 - protein, 145 aa, Chromobacterium substugae
MTETTPNLLQQLGRSSRAMYGAFESRVGHALPRWRILKSLEELEVASQRQLACHLQMDPGALTRQLKLLEADKLVRRDTDPSDNRQIRVTLDEAGRALLLAAAPQRQAFFAQALDGIDAERLATALEVLRQLEARFRAMSAAGAD

SEQ ID NO: 4760 - protein, 513 aa, Chromobacterium substugae
MRGILSAIPAFPNWLNCALVAALYFASAWLGDHWLMLELEMDSVVWPQPGLALAAVLLLGWRVWPGVLLGALLAEGWQWHGLVAGIGWLKPASGIAAGVLAQTLLGAWLVRRHIGRGNPLDSFSHCLLYFVIVAAMTLLGALIAVASLYLCGLLPQKLLVMECCLRWLSAGCGVLLFGSAFLILHQHGWPRVERETWYEMLAYFGMVTLLTASIFVWWHPTMDTTYPLDLLVLPLVAWAAFRFTPREVVLALLLIMALALWGTRHGGGPYLGYSAYSTLIIVQTYVGILTVVSLCVGALMSEQRRIKLELGRQQEQLEQQVRIRTLALEQSHAEVLALSRVDPVTGIANRRSFEESLDGEWRRARRLGTSLGMLMIDIDYFKLYNDHYGHVSGDYCLREVAQAIRSSVRRPQDLVARYGGEEIVCLLPDTTEEGVACVGEAVLEAVRDLQLPHVGSAISAIVTISIGGAAVLPRETPDSRQLVEAADRQLYRAKQQGRNRMVIADDEQDRSTG

SEQ ID NO: 4761 - protein, 341 aa, Chromobacterium substugae
MATLPENAEFPLPRKRAGAGRFSNSRHAVGLAACNLAVTMRAAGDRPDIAWRRRVHQENRPMNVRVVDYRAPDAAEQFTRSLHETGFGVLTNHPIPQDLVEKIYAEWLAFFNSEEKFDYAFSMEKQDGWFSPEVSETAKGATLKDIKEYFHIYPWGRVPAALKADADRYYAIANQLAQELLSWVQQYTPAAIAANYREPLSHMIADSQQTLLRVLRYPPLTGEEPAGSLRAAAHGDINLLTILPAANEPGLQVQDKNGDWIDVPCDFGTLVVNIGDMLQEASAGFYPSTQHRVVNPTGEGAKKSRVSLPLFLHPRPEVVLSDRHSAGSYLDERLRELGVKM

SEQ ID NO: 4762 - protein, 260 aa, Chromobacterium substugae
MSASLVDPLWSAIRDETLAAVNDEPLLASFLHMTVLRHATLEDVLAFHLSSKLASPVMDPRALLELFREAFQADPAVSAAMRADIRACYERDPACDSYSTPLLYFKGFHAIQSQRITHWLWQQDRRTLALFLQNRISEVTGADIHPAARVGQGVMLDHGTGLVVGETAVIGNNVSILHGVTLGGSGKERGDRHPKIGDGVMLGAGAAVLGNILVGECAKVGAGSVVLEDVPPHATVAGVPARVVAQACPGTPALDMDQRV

SEQ ID NO: 4763 - protein, 211 aa, Chromobacterium substugae
MTRFAAVLLAGWVSLGALATPPDVPGWREYQDGRLAAARIAFWQAAEGGDRVAAFNLAMMDWRGEAGKVDKPQALYWLRRAADGQLAQAQYALGLLYEKGDAVDKSLTEATRWFALAARQGYLAAQIDLGTQYFLGRGAPQDDRLAAYWYEEAAKQGDVGAQYLIASMYERGEGVQRDIPAAIRWYAKAAAQGDVGARAKALDLAKTLARH

SEQ ID NO: 4764 - protein, 286 aa, Chromobacterium substugae
MPAQIESFYDAATGTVSHVVYDRDGGHAAAVDPVLDFDPKSGRTSRRSADRLLECLRARRLTLQWILETHAHADHLSAAPYLQQQAGGRIAIGERITQVQDAFCRVFNLEPAFRSDGSQFDHLFGDGETFRIGALEATALWVPGHTPADIAYQVGDAVFVGDTLFMPDVGTARCDFPGGDAATLYRSIRRLLALPDDTRLLMCHDYPPAGRAPAWCATVAEQRRANLHARDGVEEADFVAMREARDATLAMPQLLLPAVQVNIRAGRLPPPEDNGVRYLKLPLDAL

SEQ ID NO: 4765 - protein, 264 aa, Chromobacterium substugae
MLLMLLLGALVGAVLGLTGAGGGILAVPALMAAQGWSLPQAAPVALLAVAAGAALGAYEGWRRQLVRYRAAAWMAASGVPFAAAGARVAHLLPAPLLSTLFALAMLIVAARSWRTAGGAATRDGRAAPCRLDPETGRLRWSPAAAAALAGVGAVTGFLTGLLGVGGGFVIVPALRRLSDLSMHAIVATSLLAIALVGCGGVLAALWHGTRVPALPSAVFVLAAIGGMLLGRRLIRRLSPPQVLRGFAALTVAVAAVVLWRAWGG

SEQ ID NO: 4766 - protein, 411 aa, Chromobacterium substugae
MHSPAIPLNIGNTGFMLLCASLVMLMTPGLAFFYGGLVGRKNVLTIMAQSFMSLGWTTVLWFAFGYSMCFGPSWHGIVGDPTHYAFLRGVTLQSMYAGNDAGIPLVVHIAYQMMFAIITPALITGAFANRVTVKAYFLFLTGWLVLVYFPFVHMVWSPDGLLAKWGVLDFAGGIVVHNTAGFAALASILYVGRRSLVENKPHNVPLIALGTGLLWFGWYGFNAGSELKVDAVTASAFLNTDVAASFAGTAWFLLEWAHAKQPKFVGLLTGAVAGLATITPAAGYVSLGSAAVIGLIAAAVCYFAVQLKNRLQWDDALDVWGVHGVGGLLGTILLGVFASKAWNAAGADGLLLGNPGFLWKQAAAALLSGVWAFAFTYGMLWLIDRVTPVKVDAAVQQAGLDATLHGEEAYI

SEQ ID NO: 4767 - protein, 105 aa, Chromobacterium substugae
MTESEFLQLSDAIFDQIEAAIDDHGLDADTLRQGNVLEIEFDSGEKVIVNRHAVNQELWIAAKSGGYHFSRQGAAWIASRDGSEFFATLAEAIRAGSGEAFGFGD

SEQ ID NO: 4768 - protein, 118 aa, Chromobacterium substugae
MWHGGSDSQGDDGHSRPTRVQTSDCLEISLARKEAFRLAGGRSRGGRGRLRGRSDGVGRRRLGQHQRSFVTAGRQGQGQACTSEQGTHTDSNPIWQNQHTSKTAPARVASGRPHRKPS

SEQ ID NO: 4769 - protein, 364 aa, Chromobacterium substugae
MPHYARHLEHHTIVNPFPGIAKLEAALGHKVVSRLGANESMSKPESPLLAQWGEALAELARLYPDPYALALRERAAQRHGVESSQVIFDCGADSLILLALRLRCNAGDAVVCSAGTYPAFRYFAEGVGARILEVPYQAQGIGLRPDLARLCEVVQAERAVALYLANPDNPTGHYWSAAEIQALRQQLPTQTMLILDEAYVDFCQDPQDAPPAGVLPNTLRLRTLSKAYGLAGLRVGFALAPADIIAKADQIRPQYALSGLAQHAAQLVLDDPDYARQLVQATVQLRDKLEAALRARDLAVLPSHTNFVSVLYPNASCSEAIQRKLLAEGVAVHRPPHPALRHLLRVTAQPQALSSKVLDALAGH

SEQ ID NO: 4770 - protein, 269 aa, Chromobacterium substugae
MKKSFYPLLGLLLSAAGGALAAPITNFDSDPVIDLAGQLRGQQHAGRAVAAQALDAAASAAILREAGDRRQLLDPMSIPKNDSRMVAAHPEFSRRQGQLLTVSTPAGQRLQFKSWKIAKGDGDSSTFLYQGPLAGNALQRVDLQFGHDAPGSLLIDNRSGKVFFTYSTENMVSASPDGSALLQLQNSPDWRLQLVSLPNTEQGSLFCSLSDASVETVFKSWRGNSLGLQLEKGGQKLALRFSRNGGDWQVAASQPAQLAKLGLRCSQSR

SEQ ID NO: 4771 - protein, 124 aa, Chromobacterium substugae
MKTNRSYLLTALCLLAASQLACAGKAIAVRDDGETPITLRGAVIGPISSGSKADGTFFKAYHLKLEREMTFDDGGDCGEQAKRSLALNQEGMGRYKGKTVSLKAKVFCQLSRTGTYHLSDIVVQ

SEQ ID NO: 4772 - protein, 96 aa, Chromobacterium substugae
MPWIHPELIPLIALLALYAASLLYALRLAWRTRGLRWLACASLLIAGFLAMLLARPATPDSGEMPPGFGLGALLALAGIGAAAGGAVWRALRRHRR

SEQ ID NO: 4773 - protein, 39 aa, Chromobacterium substugae
MAQIPAMPKALPAAAARVGRPSHPKEPQPWMTPCDGGQY

SEQ ID NO: 4774 - protein, 408 aa, Chromobacterium substugae
MDDALRRRAVLKGGLAAAGLLALSGRLRAAAWLYQGFDNGWRELVPYPQKMPLLRITTRPVHLETPFSQFDRGLITPNEAVFVRYHLAGHPLDIDAASHTLTVKGLVRQPLTLTLRDLQTRFETVSQTVVMQCAGNGRGLLQPRVQGAQLGNGSMACVEMTGVRLADVLKAAGVKDGAVQVAFRGTDQPALEETPSFIRSLYLEDALRPEVMIAWAMNGQPLPVLNGYPLRLVVPGFYASYWMKHLSQLEVLDHVFDGWFAATAYTVPDTPDYGIAPGAKPERTVRLTRMKVRSFITHPADGQTVAAPDGRLALRGIAFDGGSGIRRVEVSADGGRSWLPARLGEERGRFAFRPWTLTLDGVKPGALQLLARATANDGQTQPLVQPWNPGGYARNVAERVALVIGEAG

SEQ ID NO: 4775 - protein, 109 aa, Chromobacterium substugae
MKPALLVALLLLAGPAGAVSIQLPNETAMLPDSGHPGYPTALQRCLICHSADYIALQPDFSQARWQAIVDKMRAAFKAPIAPEEVAPIAAYLADAQRRRLLQPRPPAKP

SEQ ID NO: 4776 - protein, 273 aa, Chromobacterium substugae
MPLPPPLTLAAFALLALGLVAASLRHAAPGWIALVTSAMLALAAGVLQPLGVVATAAAAGLTCSLRRYPRPEWYLVWVALLLALAVHALPGFDNPLLWQGKASAASAPYRLFWSYDKGLAGLLLLLNLCNAPLPGRTLGWPAAAVGGLALLFVLGIAAGFGIIGLAPKWPAWLLPWLFANCFLVSLAEEAFFRAGVQRWLEIRTEPFAALMAASLLFGLAHLAGGWAWAGLATLAGIGYGLIYAARRQLWLAVLAHVAFNTVHLLLFTYPKPA

SEQ ID NO: 4777 - protein, 162 aa, Chromobacterium substugae
MIEVGIVMGSNSDWEVMQHAASMLKRFGIACETRVVSAHRTPDLLFQYAEEAAPRGLAAIIAGAGGAAHLPGMLAAKTHVPVLGVPVPSKYLRGEDSLLSIVQMPKGIPVATFAIGEAGAANAALFAVAMLATTRPELAEKLVAFRKAQEETVLAMTLPEAE

SEQ ID NO: 4778 - protein, 376 aa, Chromobacterium substugae
MAAILPPAMLGILGGGQLGRMFAVAAKTMGYRVTVLDPDESAPAAAFADRHIQAPYNDPAALAELAASCAAVTTEFENVNADAMRELAKRTRVSPSGDCVAIAQDRIAEKSWIRKAGLATAPYLAIESVEDIQVDLAPYLPGILKTARLGYDGKGQVRVNTQDEARAAYANLGGQACVLEKMLDLQLEVSAIVTRVSSAQSAVFPLAENIHKNGILDESIVPARVAPALARQAQEMARKLAEALDYVGVLAVEFFVLADHSLVVNEIAPRPHNSGHYTLTACLTDQFQQQVRAMCGLLPGRTDLLSPVVMVNLLGDVWREDGREPHWDVLAEAPNAQLHLYGKKTARPGRKMGHFNVMAATADEALEQARALKDTL

SEQ ID NO: 4779 - protein, 247 aa, Chromobacterium substugae
MNPSAFSKTLSQALRPAALLLALACAPALSAHAETPAAGQSQPLAPQASAKPMGDQAYQLMQAGQQVKAHELFMRAAEMGDRRSLSLLADSYGRNPNGYLKSPAVKKDYPKLIQLLERAARYPEPEGSGYRLKQDFARLLITAPAPYRDAPRGSRLLVAATGQDDDGTENYYLLGQMYERGEGVPADGKQAVYWYERAASALSGYTPPKVQRALARIYKTGAPNLPADPKKSREWSDKAKHNPGFQS

SEQ ID NO: 4780 - protein, 231 aa, Chromobacterium substugae
MENALVGLPELRRRLEAAADPAKRPAMRDYMRGQFDFLGLATPARRKAAGAWIRSQDAAGPDGWLAAAETLWRQPEREFQYVAVDLLARHAAELPAAALPRLLALVAAKSWWDTVDGLAAWIIGELVRARRELQTDMDRLSGDGDFWLRRVAILHQLYWKRDTDAARLFRYCAANAADPEFFIRKAIGWALREYAYTDPDAVRGFVAAAPLAPLSRREALKRIEPLPVKEA

SEQ ID NO: 4781 - protein, 292 aa, Chromobacterium substugae
MTGLTTTNLTSLKKIYSGKVRDLYQIDEQRMLMIATDRLSAFDVILDDPIPAKGQILTAISNFWFEKLKDVVPNHLTGEKPEDVVAAEDLPQVEGRAVVAKRLKAVPIEAVVRGYLAGSGWKEYQQSGAICGVALPAGLREADQLPEPIFTPSTKAAVGDHDENISFAQCEAIVGKELAAQVRDTAILLYKTAAAYAATRGIIICDTKFEFGLDENGVLTLMDEALTPDSSRFWPADSYQPGSNPPSFDKQFVRDWLEASGWNKQAPAPAVPLDVREKTAAKYREALERLTG

SEQ ID NO: 4782 - protein, 193 aa, Chromobacterium substugae
MTVVQPILDTPRLRLLPAHPDKAAAVLDYQLRNRAHLEPWNPTAGPLFYTESHWAMQLRQAARNWEEGASARFLLATQAEPERIIGTVSFSNIVRGVFQACHLGYGIDCAREGQGLMREALQSAIAFAFDELKLHRIQANYQPHNVRSAALLQRLGFAVEGQARDYLFLDGAWRDHVLTALTNPHFDSRPLLG

SEQ ID NO: 4783 - protein, 306 aa, Chromobacterium substugae
MHRTFLTAADGEAIPLCEWLPDGPPRAVVLISHGMSEYAARYDRFAQTLTAAGCAVYAHDHRGHGASPVPRGFFAAEDGWRKVVDDVETVRRHAAERHAGLPVILLGHSMGSFIARAYFLRYGGLLSGLMLSSTGYRQRPLARLLGAVARFLGRRKGWDRPSRLMAALVFGSFNLGFPPWRTKMDWLSRDPAEVDAYLADPDCGFDPTPGLWADLFAGIVEMENGEAAGQGIQRRCPVLLFAGSRDPVSLGRLALGQLEIRYRDAGVLDLQSQVYPGGRHEMLNESNRAEVESDILAWLARVAPAA

SEQ ID NO: 4784 - protein, 203 aa, Chromobacterium substugae
MIEVHHLNQSRSRRITWLLEELGQDYAVVRYERDPKTRLAPPALKAIHPLGKAPVLRDGDAVLIESGAIVDYLIRTYGNGRFAPDIASPDYNRYAQLMHYAEGSAMLPILLQLYVGTLGEAGAPLHPRIHSELDNHLGYLDGELAGRDYFVGDDLTGADVQLSFVAQIAVRGEGRQRYPNLARFVDRIEARPAYRRAAERHGE

SEQ ID NO: 4785 - protein, 188 aa, Chromobacterium substugae
MCQETHHAHTDCLTPLQQRPLGRRGFLRLAALGGGAALLGSFVPRTAWAAGGTDVLLLSCMDYRLVDETAAFMDSLGLRDNYDHIVLAGAALGAVTDKFPAWNATFWQHLGIALDLHHIKKVVLLDHRDCGAYKVILGEDFGQQPARETQVHAETLRRLSGMIVAKHPQLQVERYLMALDGKVEAIAA

SEQ ID NO: 4786 - protein, 673 aa, Chromobacterium substugae
MSVYPHLLAPLDLGFTTLKNRVLMGSMHTGLEESPNGFEKMAAFYAERARGGVGLIVTGGVGPNAEGCVAEGAAQLSDAHEVPKHKLVTDAVHAAGGKIALQILHSGRYSFQEKCVSASPLIAPINFYTPRELSDADVWQTIADFANCAKLAQEAGYDGVEVMGSEGYLINQFIARATNKRTDAWGGSFENRIRFAIETVKAVRAAVGPEFIIIYRLSMLDLVQDGSNWDEVAQLALEIEKAGATLINTGIGWHEARVPTIATMVPRGGFAWVTKKLMGKVKIPLITTNRINTPEVAEEILAGGCADMVSMARPFLADPDFVNKAAAGRADEINTCIGCNQACLDHIFQGKLTSCLVNPRACRETELNYDQAAAPKKLAVVGSGPAGLAFATVAAERGHAVTLFDAAAEIGGQFNVAKQIPGKEEFYETLRYFKRRIETTGVELKLNTRVAAADLAGFDEVILATGIAPRLPAIPGVDHPKVLSYLDVLKHKKPVGKKVAIIGAGGIGFDTAEYLCHEGQSTSLNAEAFMREWGVDMTGDTAGGLAPQGAQPHPSPREVYLLQRKTSKIGETLGKTTGWIHRESLKMKRVKMVSGVSYDRIDDAGLHITVKGEQQLLSVDTVVICAGQDPLRELQQPLLDAGKPVHLIGGADVAAELDAKRAIDQGSRLAAAI

SEQ ID NO: 4787 - protein, 242 aa, Chromobacterium substugae
MTQNIYDTPEFFHGYSQLNRSVHGLAGAPEWPSLRALLPALQGAAVADLGCGYGWFCRWAREAGASAALGLDVSEKMLAQAAAMTRDDAIEYRRQNLETLQLPPAAFDLVYSSLTLHYIADLAGLLAACHRALKPGGRLVFSIEHPIFMAARQPAWLQDAQGGRCWPVSGYQDEGPRVTHWLTDGVIKQHRTLGTLLNQVMAAGFALRHIEDWGPSAEQVAAMPELAEERERPMLLLVSAQR

SEQ ID NO: 4788 - protein, 419 aa, Chromobacterium substugae
MTVPTALRRAALAAALSLAALGSAHAAPSPLLDASHPVSWWFAFKFNAASFPGCGGAAQVNSCQFGGNPQSYTSGSSYSQQYVYASSSQPSLSQGGGCIGDTPADPVGATFNQIYNGTLNYVVWNDQFYDDPSIPSCSGNACNAPWGHSKGVLAWDAQGNGVVMQVSTPSWPASGSAQYPRSSDGNTLGCVQDNDVEVSQHFFSLKLSHADVLAVLQGLANASAVTDPGNPQIVKNGGPADIQAAVSQLGQQSDSVTPQVSKLSSGVTLIAKPSALQVAPWQLVSAELGGISLRAATWWEASKSYAIPTTTKAGAPACWDSSLPAPGPVAIATSGSWAGQTFSLKGGLGKNFNHAKIGVSTSGGTAYAIFGDMNQEGALSGNCASAQNGRGGLFFALPNAALAQSIGKLIGGSTAAAAR

SEQ ID NO: 4789 - protein, 291 aa, Chromobacterium substugae
MLDLCSSMAIFVQAVDKGSFTAAADACGLSATMVGKHVRALEARVGARLLNRTTRQQSLTEVGRIYYQHCRQLLADIAVADGCADALRAAPRGLLKIHAPVTFGSLRLAPALAVYLRRHPEVEVDLTLADRMVDLVEEGYEAAVRIGELADSSLVARPLQPYRMWLCAAPAYLAERGAPSEPAQLAGHDCLGFAYWRHKNRWRFGSGENVAVRGRFTANNGQALRTAALAGLGIVMQPEALLADDVAAGRLLRLLPDHPLPSRPMHLLYPADRRPTPKLASFIDFMLAAFA

SEQ ID NO: 4790 - protein, 127 aa, Chromobacterium substugae
MIRNDAQYQKGLELMAFLHGGHTGGARVAQIQDICPDFADMAIAWATGHILSRPGLDLATRELILVASCATQGFAQTQLVAHAEAALRAGASRRQIMETVLQLTFYAGGPAVSNALLALKDVLAEEA

SEQ ID NO: 4791 - protein, 361 aa, Chromobacterium substugae
MIFNALFAMFIFSGRYRHLAGGDGLSLRGAFMSIRHVILLAAALALPAWAAEPLPAFHGDARQSSVSGLSSGAFMAVQYQVAYSASVVGVGVVAGGPYYCALDSFAGTAACMSGPPPSAAQLLAAAGIFAAGGHIDPLPNLARSRVYLFSGSQDNTVKTPVVDSAAAFFRLAGVPDRQIQYERRLPAGHAQITPTYGNDCGTTASPYINHCSWQGQGYDQAGVLLRHIYGPLQPKAQALGGRVVRFDQRPYAAVGSSLADEGFVYVPKACEQGEACKVHIALHGCKQYAGAVGDDFYAHAGYNEWADSNRILVLYPQTTTSAANPQGCWDWFAYTGPAYAWKEGLQMQALKAMADRLVSAR

SEQ ID NO: 4792 - protein, 354 aa, Chromobacterium substugae
MQRQTDDVRIREIKELLPPIAHLYELPISEQASELIYNTRRDISALLRGEDDRLLVVIGPCSIHDTDAAIEYAQKLAPLRAALAGELVVVMRVYFEKPRTTVGWKGLINDPHLNESYDINAGLRIARRLLLTLNNQGMPAATEFLDMITPQYFADLISWGAIGARTTESQVHRELASGLSCPVGFKNGTDGNLKIAVDAIRSSSVPHHFLSVTKTGHSAIVSTGGNPDCHVILRGGKEPNYSPEHVRAAAAELTAVGLPHKLMVDFSHANSRKDYRRQMEVSADVAGQIAGGDRNIFGVMVESHLVEGRQDQKPGYELTYGQSITDGCLGWSDTEKLLTQLAEAVKARRAGAAE

SEQ ID NO: 4793 - protein, 136 aa, Chromobacterium substugae
MAKLTEQDILNWEGDDYMNADHLEFFKDRLLQMQQELLVNANATANHLQEQEATPDPADRATLEEEYALELRTRDRERKLLQKIQASIRQIDDGSYGFCEDTGEPIGLKRLMARPTATLSVEAQERRERMKRQYAD

SEQ ID NO: 4794 - protein, 101 aa, Chromobacterium substugae
MKKTLLAALLLGLAAAPAMASLQLAQKYSCTACHAVDKKIVGPAYKDVAKKYAGQKGAEAMLMAKVKNGGSGVWGPIPMTPHPNIPDADLKALVKWVLSQK

SEQ ID NO: 4795 - protein, 194 aa, Chromobacterium substugae
MFVDTLQFLIKTLSGLFVLVLLLRFYLQVARAPFKHPLCQFVMAATNFLVLPTRKLVPSVRNYDTATLLLAWLVCLLANILRLLLGSLPEVFAFPQVWVSLFLLSVLEVFKQSLTLLMGAVVVQAVLSWVNPYNPIAPVLDSLTRPFLRPFRRAVVGGVDLSPLVLLLIIQVIMMLPVQALEAGFLTQLKVVLQ

SEQ ID NO: 4796 - protein, 267 aa, Chromobacterium substugae
MRITFIGGGNMAGAIIGGLARQGGHRIHVVEHQQDKIDRLAADFGASGGQTLPERFDAGDVVVLAVKPQQLRELCLALAPALNGALVVSIAAGIRLDALSRWLGSGRIVRVMPNTPAMVGKGVSGLYADAAVPAADRAAAETIMRAAGLTVWLDDETGIDDITCVSGSGPAYVFYFIESMIEAGVKAGFSEAQARELALATFDGAVELARQSPLPVATLRQNVMSKGGTTERAIARFEAEGVKAAIVAGAMDCRERSIEMGQQLSQE

SEQ ID NO: 4797 - protein, 231 aa, Chromobacterium substugae
MTDTLSTRLRQVGARLADACRQAGRAPDAAALLAVSKTFPAADLREAYACGQRAFGENYVQELQQKCEALADLAIEWHFIGPLQSNKTRIVAELAHWAHSIERLKTAERLSAQRPDSLPPLNVCVQVNVSGEASKSGCAPEEAAALARAVAALPRLRLRGLMCIPEPTADAARLAAQFAALRALAEGLRAEGLPLDTLSMGMSADLELAVAEGATLVRVGSAIFGRRGQPQ

SEQ ID NO: 4798 - protein, 345 aa, Chromobacterium substugae
MEISELLAFTVKNKASDLHLSAGLPPMIRVNGDIRRINLPPLDHHDVHDMVYDIMNDYQRKIFEDVYECDFSFELPGIARFRVNAFVQNRGMASVFRVIPSKVLSLEQLAAPKIFQEIAGYPRGLVLVTGPTGSGKSTTLAAMIDYVNENDFSHILTVEDPIEFVHESKKSLINQRELGLQTQSFANALKSALREDPDVILVGELRDLETIRLALTAAETGHLVFGTLHTSSAAKTIDRIVDVFPAGEKEMVRSMLSESVRAVIAQTLLKSKDGQGRVAAHEIMIGTPAIRNLIRENKIAQINSMIQTGQQHGMQTLDQCLAELVRRNMVSPGEARAKASNKDSF

SEQ ID NO: 4799 - protein, 378 aa, Chromobacterium substugae
MEKDQASKFIHDLLKHAIGKNASDIFISAEFPPAMKIDGKITPVAPQPLSAQQSKELVRAIMNDRQTEEFEAKKEANFAINPPGIGRFRVSAFVQQGMVGMVLRKINTDIPNFDQLSLPEVLKDIALIKRGLVIFVGGTGSGKSTSLAALVDWRNTHNQDHIITVEDPIEYVHTHKKSIVTQREIGVDTENWEVALKNTLRQAPDVILMGEIRDRETMAYGLQFAETGHLCLATLHANNANQALDRILNFFPEERHQQVLMDLSLNMRSIISQRLVPHKSGRGRVAAVEILLNSPLVSDMVFKGEIAGLKEVMARSREAGMQTFDQSLFELFEAELITYEDALRNADSINDLRLRIKLYSESGRNRDPLEGIDHLDIV

SEQ ID NO: 4800 - protein, 520 aa, Chromobacterium substugae
MRQGLRTMLSMAGITRSEAVSNASEARNRLRGKPYDVVLCDYNLGEGMDGQELLEAMRKGGNLPLATIWIMITGERHYERVVAAAEMAPDDYILKPFASQLLLDRMNLAGQRKAFLAPAHKLLSAGKVEQAIQVLQQLARETSNPQYRLDAQRLAAELLVNEGRQGEALSIYQELLTQRVIPWAKMGVARIVAEQGESQESNALLREIIAEAPRYTDAYDLLAQNLIDDGQYQTAAVVLEKAVAISPRNFNRLKSCGTALLRCGDPTKAADYLQRAVEVGRNNNFFGPDVLVDLLQAYSESGQTQQLDRLQAEISSRMDELPGGQLTMAVCRALTALAQKRPSDALAQLQSVAEDLRARETDFPSAQRFLAAAVRLPAEVNSELPPQWAHSIALRFADGRHELGTLLEIAHKHEACHGAIETAYDTLQTESNKAVELASTGKLEEAAAMLYLLSQKTLNERISMNACALLLRTCESRSKAGKPYPEEDRQVLQLMHWLPQDNERVRGFIRRHHALDPECE

SEQ ID NO: 4801 - protein, 537 aa, Chromobacterium substugae
MAFKANTTVLIVDDALTMAQGIRAILAMAGVTQSETASHAGEASNRLRAKRFDIVLCDYNLGSGMNGQELLELMRKSGTLPLSTLWVMITGERNYTQVVTAAETAPDDYFLKPFSSQQLLDRLELALQRKAYLAPAHRLLEKGKTEQAIQTLQELAQQADSRQSRLDALRLRAELLVSEGLYEPALQVYQGLLAQEEIPWAKMGVARILAEQGDSSRSNVLLDEVIAIAPRYTDAYDLLAQNMVDDGAYQEAAAVLEKAVGISPRNFTRLHNYGKALLRSGEAARAADQLQRAVDIGRNNAFFGPEVLVDLMQARSESGQTQQLDRLQNDISTQLGKQPGGQLMLAVCRAMAALAQQRPEQALGQLEEGAEWLRAAETTFDGALRFLAATARLPAGQAAAQAPEWARVIALRFADGRHELGSLQEAARQHPACLAAIRTAYDELQGKSQAALELANQGQLEAAADMLRRDAMATLNQRLGMYGCAMLLRICENRQQAAQDYADPLQDLRQLLQWLPQDNERVRGFVRRRQALLRPRA

SEQ ID NO: 4802 - protein, 173 aa, Chromobacterium substugae
MRVFLACLPPPGCLPRLAQWQRAMQREAGGRCLPLPQLHLTLAFLGELGPLALQRAADCAERAAADLPASLTLDCLGSWEGGIGWCAPAAADAALQAWVMALRRDLRAQGLRLDAQPFRPHLTLLRKLRQPLPPQTVPPLRLALRELALIASSLSADGARYQRLDGWRGGAAR

SEQ ID NO: 4803 - protein, 160 aa, Chromobacterium substugae
MTINHIRVQAEAFDVGAEVRRWSANPACGAVVSFTGLVRDYGDRQDVVALELEHYPGMTEKALADIVCAARKRWSLKGVTLIHRVGRLALGDPIVLVVAASSHRSDAFEAASFLMDYLKQQAPFWKCEILADGSRHWVEARDSDAEAATRWDAGAADASA

SEQ ID NO: 4804 - protein, 83 aa, Chromobacterium substugae
MQLNMLYFARLRDTLGLDSETLDSEAATVAELLAELRQRGGEWARALAAGQTFRVAVNQDMASGDTPLADGDEVAVFPPVTGG

SEQ ID NO: 4805 - protein, 291 aa, Chromobacterium substugae
MWRWLLLLCLAPAVLAAEPMRVVYPVGDSADAFRYDDIRELLRAALDKTADAYGPYTLQPSGWPMDEERSLEELRRGHAVNVAWSSTSEARELSLLPVRVDLRKGLLGYRIALIDGKRQPEFDQVHSRADLGRFLIGQGKGWGDIKVYQAAALRVSTGRYDMLFGMLSQRRFDLLPRSVLEVFDEYRHFHGKYPNLEVEQRLLFYYPWPYYFSCNRDDPALTERLRLGLARMRADGSFDAIFWKYHRDALRQARMSERRLIPFANPLLPDSAPLNDKSMWYDPLRDRPPKP

SEQ ID NO: 4806 - protein, 354 aa, Chromobacterium substugae
MALVSMRQLLDHAAEYSYGLPAFNVNNLEQMRAIMEAADKVDAPVIVQASAGARKYAGAPFLRHMILAAVEEFPHIPVVMHQDHGTSPDVCQRSIQLGFSSVMMDGSLKSDGKTPADYGYNVDVTRTVVNFAHACGVSVEGEIGCLGSLETGMAGEEDGVGAEGVLDHSQLLTDPEEAARFVKDTGVDALAIAIGTSHGAYKFTKKPTGDVLRIDRIKEIHARIPNTHLVMHGSSSVPQEWLQIINEFGGDLGETYGVPVEEIVEGIKHGVRKVNIDTDLRLASTGAIRRFLAQNPKEFDPRKYLKVSTDAMRDICIARYEAFGACGQASKIKAINLDTMANLYLKGQLAQIVR

SEQ ID NO: 4807 - protein, 209 aa, Chromobacterium substugae
MPLHTWLMFITTMFFVSATPGPNMLLAMTHGIHYGVRRTLMTCFGLMSALGLLMLASVAGLGAVLATSEVLFSAIKYAGAVYLVYLGVKTWRSPPQPVAELREDAAGQHGPWALYRRGFLVAMSNPKALIFFAALFPQFMDTHQPQGPQLAILALSFFVIESSWQLTYASSGAKLAGWMNSARRLKLVNRFSGGAFVGAGVLLTSLSRQ

SEQ ID NO: 4808 - protein, 391 aa, Chromobacterium substugae
MKFNKLSEQNLAGKRVLIRVDMNVPLKNGVIGDDTRIRASLPSIELCLQAGAGVMLMTHLGRPTEGEPKPEDSLAPVVERLSSLLGKPVRLVADWQAGVPLAAGEVVMLENIRLNKGEKKNSAELGRAYAALCDVFVNDAFGTAHRAEASTHAVAQFAPLACAGVLLSAELDALSKALLAPARPLVAIVAGSKVSTKLTILEALADKVDQLIVGGGIANTFLLAEGKAIGKSLAEADLVEDAKRVIAKIRARGGDVPLPTDVVCATEFAETAAAATKNVAEVSADDMILDIGPDSAKELAGIIAQAGTVVWNGPVGVFEFDQFGNGTKTLAQAIAQSKAFSIAGGGDTLAAIAKYGITGDIGYISTGGGAFLEFLEGKQLPAVAILAERAQ

SEQ ID NO: 4809 - protein, 361 aa, Chromobacterium substugae
MQQGQALSRPEKMVRLASWLVALVFAALLAGLGELVIRDLFYLPAGGPPQQEAFRQRIGLDPLKRQQEQLQRQTEAQRAEQEKLAATRGQLERSYQTQRQGLDNWLASRAATADAGQSGEVVRRARALDALQAQILQWQQKEDQASSGLLALAQRQQTLQAQVDRLEQQAGEQYQQASDRFELKVFALRLVVILPLLLLGVWLFLRYRAHRYWFFVYGFGLFALFAFFVELLPYLPSFGGYVRFLVGIALTVFAGMRMIQAFQRYAEKKRAELQQSQGQRAGRIAYAKALLSYQKRSCPSCDHQYNIAGDDADYCIHCGLQLFRVCACGARNFAFFPFCKKCGGAVTRPAALPDHPASKPE

SEQ ID NO: 4810 - protein, 363 aa, Chromobacterium substugae
MTIRLAINGYGRIGRQVLRAIYENKLHDDFTVVAVNASGDLGINAHLTQFDTVHGRFPGSVEQDERHLILNGDKIPFFSTRNPAELPWKELDVDLVLECTGAFTSKEKCQAHIDAGAKKVLISAPGGDDVDATIVYGVNHDTLKPEMTVVSNASCTTNCLAPVAKALNDAIGIKKGLMTTIHAFTNDQVLTDVKHKDLRRARSATDNMIPTKTGAAKAVGLVLPELKGRLDGFSVRVPTINVSLVDLTFTASRDTSKDEVNDILKAASEGGMQGILGYNTLPLVSGDFNHTDEASTFDSTLTKVTGGNMVKVLAWYDNEWGFSCQMLRTARAMFRCVRNQARMATGRAAVMPFALLFCYIKRA

SEQ ID NO: 4811 - protein, 662 aa, Chromobacterium substugae
MVTRTELANAIRFLSMDAVEKAKSGHPGAPMGMADIAEVLWRDHLKHNPANPSWADRDRFVLSNGHGSMLIYSLLHLTGYDLSIDDLKNFRQLHSKTPGHPEYGYAPGVETTTGPLGQGITNAVGFALAEKMLAAQFNRDGHQIVDHHTYAFLGDGCLMEGISHEACSLAGTWGLNKLIAFWDDNGISIDGHVEGWFSDDTPARFEAYGWQVIRNVNGHDPVEVATAIATAKKSAGKPTLICCKTTIGFGAPTKQGSHDCHGAPLGAAEIAAAREGLKWPHAPFEIPAEIYAEWNARDQGAAAEAQWNQRFDAYRAAHPQLAAEFERRMAGELPAGWHETLNAALAKISDAAQTVATRKASQIALEALSPSLPEFVGGSADLTGSNLTNWSGSKWIDGEGNGNYISYGVREFGMAAIINGMTLHGGLRPYGGTFLMFSEYARNALRMASLMKINPIFVFTHDSIGLGEDGPTHQPVEQVATLRYIPNHHTWRPCDTSETAVAWAHAIEQKTTPSSLILSRQNLPFVARDERQLADIRKGGYVLRDAAGARAVLIATGSEVELALKAQEALAAEGVAVRVVSMPCTNVFDAQDKAWQHSVLPAGLPRVAIEAGHPDFWHKYVGLDGAVVGMATFGESAPAGQLFKEFGFTVENVVAKTRSVIR

SEQ ID NO: 4812 - protein, 43 aa, Chromobacterium substugae
MGNRYDGSSLRHHAAGDWGPPPQNRRIIADFGTFRQPAAARAN

SEQ ID NO: 4813 - protein, 248 aa, Chromobacterium substugae
MQSFDIPPLPRKVGAGRGWRWCVEAFHIVREQPLTWVLLTLVYLLIHFAINAVPMIGGLVGAIIGPVFAGGFVMAARKSERGEELELADLFAGFRLMPGPLLQVGALFFALMLAAMLALVAVGAASGVTSGLLGGHLQLQAHSDALFGVVLALVGLMTVVMFIVSLCYWFAPALVALGGVAPWQAIRSSFSAGLSNWAALLVAGLALSLLGLLALVPLGLGLLLWFPVVYVTAYTSWKDIFGQEDAAR

SEQ ID NO: 4814 - protein, 255 aa, Chromobacterium substugae
MSRSPRHDKILQLVRENGFMPIEELARLLDVTPQTIRRDINQLCEANLLRRYHGGAALGNSVENEDYFARKGKFQSEKAHIADMIARSIPDHASLFMSIGTTIEAVAQALTATHKGLRVITNNIHVASIMSTNPDFTAMITSGTVRASDGGITGVATLDFINQFKVDYAIIGVSGIESDGSLLDFDYREVRVAQAMMNNARHRYLAADHSKFGRNALVRMGHISEFHTVFTDAMPPEPVSKLLEEHSVRLVLSEA

SEQ ID NO: 4815 - protein, 336 aa, Chromobacterium substugae
MQSYRFSRFGHLDHLQRRDDAMPRPGRGEVLLRVRASALNYRDLALLNGRYPMSHQDGLIPLSDAAGEVVELGEDCRRFAVGDRVCNTFFPEWFGGPFPPPQAARQYGSNLDGWLCQYKAVSEEALVRAPDHLDWAEAATLPCAALTAWTALTGPQPVKAGDTVLTQGSGGVSLFAIQLAKLLGARVIATTSSADKAQRLRELGADEVIDYRASPDWGAAARELSGGRGVDRVVEVGGQGTLEQSLQATAIGGEIAVIGFLDEGAAPLDFMRFFLSGATLRRIAVGHREGFEAMLRAIEQHRLRPALDRVFAFDDARAAWEHFASRRNLGKVVIAH

SEQ ID NO: 4816 - protein, 303 aa, Chromobacterium substugae
MDLLEDIFTAMQVESALYAQLEAGAPWGIAFSPHASARFGIVSHGRCWLSGAGLAEPLALAAGDCFIVSGGSPFTLMDQPGRPAVPCETIFAGRTEGVIRFGGGGEETAIVSGRFLFDAAGGAPLMDLLPPVLHLHLDDEHARLLQATLQLIARENAGQALGARLAVQKLVDVLLIQALRIFCLGGQGGGWLAALGDRHLAPALQALHRDIAAPWTVAQLAGLAGLSRSAFARHFRQLVGDTPLNYLTGWRVYRAQTLLRQSRLPLAEVAQRVGYDSDGAFQRAFKRVCGVPPGEYRRASRTG

SEQ ID NO: 4817 - protein, 231 aa, Chromobacterium substugae
MHAKTIGIAGVTVPGAVDCLSKMHRLCAGRFAAHHHPRFALDQPDFGVVHQAQDDDRWDKVADSIVGSLERLAGAGAALAVIPANTVHLVVEDIRARSPIPLISMLDVVADACAARGLKRVAILGTRWTMARHLYQAPLAARGIEEVIPDEAQQAVIQRAIFEELVPSGRASEATLAALLQVVAAMKAQGCDGVALACTELPLALNDANCGVPAIDTTLALAEAAIARACA

SEQ ID NO: 4818 - protein, 517 aa, Chromobacterium substugae
MNPLHPRRQHRLSHQLLALLVCLTPLLTAAPALVWQEQQDLRQTAQQQTRHGVAMVDDILDEAARATRAILPLAGGACADAEYALRRQTAASPFVRSLSLARGDLMYCTSVSGQVAIAMPQRDFTDKRLNLTHGNKITPGVPLLYYRLQGAGGDAMATVDGRYLQLALQDASDSNPVFMQIGDEWIGPRLAGDGQAPLAWRFRATAHSSVYPYSVVTGYDMPPWHSLLWDDHAALTVTLALLGLLAGATLYWLLGRPASPTDELKRALANDEFEGFLQPVVKPGAPGWQGAEVLMRWRHPREGLIRPDLFIPRAEESGMIVPMTRRMMKQVARRLRQQPLPAGFHLGFNISRAHLHDPHFYADCQELQQLLAGSQAALTLELTEREIVEITPEVAELFQKLHDLGVKIALDDFGTGHSSLVYLQQLAVDGLKIDQGFVAGIGSDGLSAHIVDSVAELAAKLGLETVAEGVETQAQFDYLSQLGVGWLQGYHIARPMPLEEFIQRLRAGDTWQQGTSN

SEQ ID NO: 4819 - protein, 459 aa, Chromobacterium substugae
MQDQHAWSGRFSEPVSELVKHYTASIGFDYRLAEVDIEGSLAHAAMLNRSGVLSDADLAAIRQGMAEIRDQIRAGELAWSVDLEDVHMNIERRLTDRIGDAGKRLHTGRSRNDQVATDIRLWLRGEIDATVHLLAELQKSLLDLAEQHAATVMPGFTHLQVAQPVTFGHHLLAYVEMLARDAERMQDCRKRVNRLPLGAAALAGTTFPIDRRYTAQLLGFDDVCHNSLDAVSDRDFAIEFAAAASLVMIHLSRLSEELILWMSPRVGFIDIADRFCTGSSIMPQKKNPDVPELVRGKSGRVVGHLIALVTLMKAQPLAYNKDNQEDKEPLFDTVDTLQATLRIYADMMRGITVKPEAMRAAVLQGYATATDLADYLVKKGLPFRDSHEVVALAVRHAERQGVDLAELPLSALQGFSALIADDVYTVLTPEGSLAQRDHVGGTAPAQVAAQIARHRGRLG

SEQ ID NO: 4820 - protein, 269 aa, Chromobacterium substugae
MLKTFPSKAAVKTLLALLLSCLGLLAQPALASDNGPRPLVLAYNAFAPWKNYDGQGQPSGPYTEIVRELARRLRLPLRFLNCPLPRCLAAMQQGRADLMIGVQHSPQRARYLDYLEPPFASGNRLALYQRGNDPRVIRRYQDLLPLTVGVVEGVQYQEAFDQDGRLRRDTALTMESSFRKLAAGRIDVLIGNEQQTGLLAASHEFAGRVRRAGLTLDDLRPHRLALAQNSPFHAEKARVSQALQAMLDDGSVARILAGLPLRPAAAAPR

SEQ ID NO: 4821 - protein, 247 aa, Chromobacterium substugae
MSAMISLNQVSKWYGSFQVLTDCTTQVSKGEVVVVCGPSGSGKSTLIKCVNALEPFQQGEIVVDGISVGDPKTDLPKLRSRVGMVFQHFELFPHLSITENLAIAQVKVLGRGREEAMSKGLKLLDRVGLKAHAGKHPGQLSGGQQQRVAIARALAMDPIAMLFDEPTSALDPEMINEVLDVMTELAQEGMTMMCVTHEMGFARRVADRVIFMDQGRIVEDCKKDEFFGDLDARSERARQFLSKILQH

SEQ ID NO: 4822 - protein, 221 aa, Chromobacterium substugae
MDFSQILPALPGLSQGMAVTLKLLVGGVAGGVLLGILLALARLSGNKLLAGFATAYVYYFRSIPLLLVISWFYLAVPLLINWLTGSLEPVGAFTSCLTAFVMFEAAFFAEIVRAGIQSIPKGQAAAAYALGMRYHQVMALVVLPQALRKMMPLLLQQSIILFQDTSLVYAVGLMDFLNTARSKGDIVGLPHEFLIFAGLVYFVISFGASRLVKRLQQGLAV

SEQ ID NO: 4823 - protein, 246 aa, Chromobacterium substugae
MNYHWDWGVFFKPTGVGSEIYLNWFVSGLGWTLAVGLTGWVIALLVGVAAGVARTLPNRWVAGLATAYVDLFRNVPLLVQLFVWYFLVPDLLPQAAQTWFKQDLSPTTSQFLSVVVCLGLFTAARVAEQVRTGIEALPIGQRNAAMAMGFGLGQTYRHVLLPQAMRIIIPPLTSEFLNIIKNSSVASLIGLAELLAQTKQTAEFSANLFEAFTLATVIYFVINMALMLSMNALEKKLRVPGTMGGK

SEQ ID NO: 4824 - protein, 302 aa, Chromobacterium substugae
MRIRTSVIAGCTIAALAALAAQTASAAELTGTLKKIKDSGVIVLGNRDSSIPFSYYDNNQKPIGYSVDLANKVVDEVKKELKMPNLQVRYNLVTSQTRIPLVQNGTVDLECGSTTNNAERGRQVAFSVGIFEIGTRLLTAKTSGIKDFPDLKGKNVVTTAGTTSERLIKAMNASKNMGMNVISAKDHGESFLMLESGRAVAFMMDDALLYGEMAKAKNPANWTVTGKSQSYEIYGCMLRKDDPAFKKVVDTALANTFKSGEVNKIYAKWFTSPVPPKGLNLNFPMSDELKALLAKPTDKPAE

SEQ ID NO: 4825 - protein, 262 aa, Chromobacterium substugae
MSKHIPRKRFGQNFLQDAGVIASIVHAVNPQPDDIVVEIGPGLGAITKPLLSSLKHLHVVEIDRDIIERLRAEHPADKLTIHAGDALAFDFGSVSAAPLKIVGNLPYNISTPLLFHLATYGNRVLDMHFMLQKEVIERMVAEPSTADYGRLSVMLQYRFYMENILFVPPEAFWPPPKVDSAVVRMIPAPGRCGVARDEALLEKLVIQAFAQRRKTLRNNLKGLADVADLEALAIDPGLRPENLAVEDYVRLANHLSDKGVKA

SEQ ID NO: 4826 - protein, 432 aa, Chromobacterium substugae
MNDCKRPASLAQRLNDKGNNALTKYSNGKLGFGDGICYDERLFRRRPAMSPTSLAVRQANPATAAAILLILFNPLGIDLYLPALPAMRQFFQADAAASISVFVFSLGLGQLLFGPLADRVGRRPVALGGLLVYAASALLASRCDSLPLFLSLRLLQGLGASASTVSAFTIIRDCFSGNAAGQRYSLLNGALNIVPALAPACGGWLSVAYGWQACFVFLAAAALLAFAALYWLMPETRPERTDKPAGPGFAAVLRHPAMLRNGACGSTALGLIISYVTLAPGVLIGREGLSSQTFGLLFGANALLIMAASFIGLALIGRFGQRAVLRSGLVVMLAAGALLLILAGHAGAWHYMLPVAVLSVGFACTLGPAAGMAMAPFGEAAGRAAAILGCVQMLFAAVLSATLAALPVAGETALGGAVVALSLLCLFLQRKA

SEQ ID NO: 4827 - protein, 198 aa, Chromobacterium substugae
MSTNDTRIYLASGSPRRREILEQLGLHLERIHADIDESVLPGEDAVAYTERLAREKAEAGWKVVSSCGLPERPLLAADTTVTQDGEIFGKPADADDARRMLRAFSGRSHQAITSVAVMRGARLLVKTSVTDVFFKPLSDAEIERYLASGEPFDKAGAYGIQGKAGVFVEHIEGSYTGVMGLPVHETALLLAEFGFELP

SEQ ID NO: 4828 - protein, 498 aa, Chromobacterium substugae
MLHQSIALPRDLPRPQEQILVNITPQETRVAVLEEGIVQELHVERAASRGIVGNIYLGQVKRVLPGMQSAFIEIGLERAAFLHIADVLEQRQHPTEPQRIEKMLFEGQTVLVQVIKDPIGTKGARLSTQISLAGRFLVHLPQEEHIGVSQKIESDAERHSLKARLEKLLPDGSPRGYIIRTSAETARDDELAADVEYLSKLWTDIRLKSQTLPAQSLLYDDLPLAVRVLRDMVSGYTDKVLVDSNENYGRMVEFAEQYVQIAVDKIERYAGERPLFEMHGIEAEIDKALARRVNLKFGGYLIVDQTEAMTTIDVNTGGFVGNRNFDETIFKTNLEATQVIARQLRLRNLGGIVIVDFIDMDNDEHQAAVLAELAKAMARDRTRVTLNGFTSLGLVEITRKRTRESLAHVLCEPCPTCQGRGEIKTAQTVCYEVQREIVREARQYDAKGYRILAAQSVIDMFLDEESQSLAMLVDFIGKPVSLSVESSYTQEQFDVVLL

SEQ ID NO: 4829 - protein, 246 aa, Chromobacterium substugae
MNRIAISSALLLTLAGCASNSDLEATRRQLDLVNQQATNRIAAVETKLSNDKLLEMVSQVDSLKAEVAKLRGDIEVLNYNLQTTQKRQNDLYNDLDGRLSHLEGAGKQDASQPAAARQAAAGDSQASPDYDKALNLLRARDFPNAINALGLYIQQNPQAPQAVEASYWLGVAHTALRQYDAAIDIHRRFVEQNPGHHFAPDALRNIGNCQRELGQVDQAKNTFRRLIKLYPKSDAAQKAKQQLARM

SEQ ID NO: 4830 - protein, 173 aa, Chromobacterium substugae
MNWKQLVLGSAVATLLAACASTKPAEAPAAPAAQAPVTQAPADTSASNQGQVAMDPLNDPNSPLAKRSVYFAFDSSTVDGEGKNTVANHADYLKGHDKKVIIQGNTDARGSREYNLALGQRRAESVKHAMEVLGVKENQLEAVSFGKEKPKATGTSDADYAENRRADIVYQGQ

SEQ ID NO: 4831 - protein, 418 aa, Chromobacterium substugae
MLLLAMLAAGSARAELNIEIIGGGNSRHAISIVPFKDEAPTQGNLTPVIGNDLALSGAFRLVDPSAVANVPFEPADIRYPLWQAAGAQSIAIGKVEQAAGGQLKISFRLMDASQRKQLTGGEFTVTPDRSRQVAHAIADMIYEAITGQKGFFNTRLAYVLKSGRSYALQISDVDGQRSQTILRSSEPIISPSWSPDGRYIAYVSFASQKPVVWVQDLATGQRRAVANFKGSNSAPAWSPDGSKLAVVLTTSGNSQVYILNAAGGSPRRLMYNGGIDTEPAFSPDGSMVYFVSDRSGNPQIYRVPVNGGDAQRVTWEGKYNVSPKLSPDGKTLVYIRREAGNFRVMSQDLATNDTRLLSDGSYSERPSFAPNGRMVLYSSDIGGRSVLYAATADGSSKVKLAVLNGDVQDPAWGPFNNP

SEQ ID NO: 4832 - protein, 294 aa, Chromobacterium substugae
MSSQSPSSLRPWTLIASALFHAIVIGLLLWGGLQTTPPPSPAPLALELWTTAPPPPAATPVPVEPTPAPTPAPVVAAPPAEVNLGRKDAPKPKKEEKPKPAEEPKPEAKKHVAKPEEPKKPEPKPKPAEQAKPKPVEEKKPVKATPPPPAKHGHKPDKTYNNEADDLLASLDSTRVSGKPNARSDQAGSKHGVAGGAVNGSGVNAGWIDMVKAKVTPLVQIPPGIQGNPAVVLRITLLPTLEVKTVQLVKSSGQAAYDDAVQRAVWEAKTFPKLPAGANFNDGYRTFTLTFRPH

SEQ ID NO: 4833 - protein, 128 aa, Chromobacterium substugae
MNQMNVVPYIDVMLVLLVIFMVTAPMFTPGVIDVPSVSEAPAIDVRPIEVTVDATGKIELVDGEQKSRVDSLDDLASQLQALVGENPRPVAISADANLKYAEVVRIADRLHQAGVKRVALTVKQTPKQ

SEQ ID NO: 4834 - protein, 221 aa, Chromobacterium substugae
MTSRTVALDRALHDYLFNIGVAEHPVQRELREFTAGHRLAKMQIAPEQGQFMGWLARLIGARRYLEIGVFTGYSALTVALAMPEDGEVVACDVSDTFTAIAREYWAKAGVAGRIDLRLQPALNTLQTLLDDGRAGSFDLAFIDADKPSYRDYYEACLQLVRPGGVIAIDNIFLSGRVVAPKPEDPPGVHLVHAFNASLKADPRVHMCVLPVGDGLTLCTRR

SEQ ID NO: 4835 - protein, 59 aa, Chromobacterium substugae
MYQSEFTQFINGFLEKNPEVDSQRRELRLTLWDRQPNLEDQRRWKESQVPQKPYVYQPE

SEQ ID NO: 4836 - protein, 196 aa, Chromobacterium substugae
MEKNRLEAFSDGVIAIIITIMVLDLHIPHDTTFAALLQLWPIFLCYLLSFVYVGIYWNNHHHFYHATRRIDGRVLWANLHLLFWLSLIPFVTGWMGENHFQPLPVALYGAVLLMCSIAWWIMQQALLCLPGNRTRLAEALGGDIKGKISPVCYLLAICLAWRLPWLSGLLYLAVALAWLIPDRRIECLLYGDGQPD

SEQ ID NO: 4837 - protein, 329 aa, Chromobacterium substugae
MPSPIPTPLPDFRNLGVMLRILLLPLALLFIYGLLAPPTAEPLWRWLQLALLLLPGSLLSLALLALASPWLARRRLGPSWATALTGAGFALCQWRLQPEAPFAWRTPALAMLAMALLLHYLSLRQRALSPALAEARLAALQARIRPHFLFNSLNAAIALIRSQPQQAETVLENLAELFRAQLADPDRASTLAREIELAGMYLAIESERLGPRLKISWRVEAPLDAAMPPLILQPLAENAVYHGAEQSGGEVEIVIGARLYGGQLELTLDNPAPASPRPGGNRMALSNLRERLALFFDAEASLTGELRGDRYLTRIRLPYRRAGKPERNG

SEQ ID NO: 4838 - protein, 253 aa, Chromobacterium substugae
MLACARALLLGLWAGWAGAAELLVSTGEYAPWSGARLPGQGFVNRVVREAFAREGVAVRFQYLPWARALEALRNGSVEASSFWFDDPGKAREFLYSAPLSEHRELLFHRKDLAVPAWARLQDLHGLRFGATRGYSYTAEFRQLAKQGAIEVEEADDDKTNLLKLLAGRIELFPIDEFTGWQLLASDTFPRGAHDLVTTEPRPFSTQYGHLLMLRSARNEQLMGRFNAGLAKLRADGTLERFRLDLYRGSGLGP

SEQ ID NO: 4839 - protein, 485 aa, Chromobacterium substugae
MHIVIPAERLAGERRVAATPDTVKKLVGAGHAVTVERGAGIPAAIPDAAYAEAGAKLSDQRQALLAQADIALTVRMPAAADLEALKPGAALIGMLAPYGNPLLPELAARGISAFALELLPRTTRAQSMDVLSSQNNIAGYKAVLLAAEYYPRFMPMLMTAAGTVKPARLLVLGVGVAGLQAIATAKRLGAVVEAYDVRPATREQVESLGAKFVEVPMTDEEKAASGGVYAREMTAEFLARQNALLAKRAAAADIVITTALIPGKPAPRLLDAAAVAAMRPGSVIVDLAAEAGGNCELTRAGDAWQTDNGVHLVGLANLPALLAADASSLYARNLLAFLCLLLGAEGLRIDLADDLIAATLLTHQGEQRFGAAPTPAAPAPARQEPHHHGSFITSFTIFALAVFVGYHVVWNVTPALHTPLMAVTNAISGIIVVGAMLQVVDVGGQQITVTSVLGAVAIFLASINIFGGFLVTQRMLDMFKKKNRG

SEQ ID NO: 4840 - protein, 457 aa, Chromobacterium substugae
MQNISAVLYLVSAVLFILALKGLSSPASARRGNLYGIVGMAVAVLTTLLIIDKPVLALIAGAIAAGAAIGAWKARTVEMTGMPELVAAMHSLVGLSAVLIAVAAIFHGGVEHTPVQKVELFIGAFIGAITFTASVIAYGKLSGRFGAKAIHFAGQHPLNLLLALAMVGFGLAYFATDSQAAFLAMVAVALALGVTLIIPIGGADMPVVVSMLNSYSGWAAAGIGFTLDNPVLIIAGACVGSSGAILSYIMCKAMNRSIVSVLLGGFGSEAAAGPAAGDAAAKAYKAGSAEDAAFLMGNADQVVIVPGYGLAVSRAQHALQEFAELLHEQGVNVRYAIHPVAGRMPGHMNVLLAEAEVPYEQVLEMEEINADFSTTDVVLVIGANDVVNPAAQKDKQSPIYGMPILEAHKARNVIVVKRSMSAGYAGLDNELFYMDKTMMVFGDAKKVVEDLLKNAAH

SEQ ID NO: 4841 - protein, 221 aa, Chromobacterium substugae
MPILSSILISGSMMLPTQAEPKLQNTEWLLEAPAQAAPLPTLSIADSRISGFAGCNRFTLGIDDDGKHQVAATRKLCAPEVMRREQALLKLLSAPFRLLPAEDGKHLTLLAGKTGYRFVRQTAAVAAEPPVPAVAALRPVAGEQYWYVASQPCGAGAAACLRVRSSEDQPWRSYAGSIAGFVPEAGSRYYLKLQGVPSVDGQPALQLLKVVYRETVTPLAD

SEQ ID NO: 4842 - protein, 222 aa, Chromobacterium substugae
MLQRLSLLALSATLLSACAAPSAPAVSAAPPSLAELQGEWKQTNGGEQAILLRIDQQRLFAKAGCNGMFGPAALEDGKLRAERLASTLMMCPPEAMQRDAKLSRQLEAGMTASLDGGRLKLSDGKDALIFERQPQGEIKFIYVAPQRKACVGVAPMQCLQVRDDKSKPWELHYGEIEGFQPEPGVAYRLRIKEVKVDNPPADAPSIRWILDLVVEQEVVKKP

SEQ ID NO: 4843 - protein, 273 aa, Chromobacterium substugae
MSLIPEIKPQQSLELLKELHILTRDGKINQDTRRKLKQVYHLYQFIEPLMADVLASKGAMTLADHGAGKSYLGFILYDLFLKDKPGAHVYGVETRQELVDKSDELARRLGFAGMSFLNLSVEQSITSAALPAQVDIITALHACNTATDDAIRFALAKDAKYIVLVPCCQAEVAATLRQKKNETFGKTPLSELWRHPIHTREFGSQLTNVLRCLQLEARGYQLTVTELVGWEHSMKNELIIAKKTGKGKSSARERQLAILDELNLMDLRERFAY

SEQ ID NO: 4844 - protein, 246 aa, Chromobacterium substugae
MKTTLRNAAVLLAGLALCGAAAAKTLRFSGYDWEVRNQGSSGPGPNVWDDDNAWLDAQGRLHLKIAKRGGQWTAAELYLPQRLGFGRYQFKLIGRPDQFDPNIVLGLFNYPTPDVGPDGSNEIDIEFSRWGSSSNPMGNYTVYPAQAGLQSTSYSFDFALNGGYSTHRFDWNAGQVYYQSLHGFQDSDQYPIASWRFAPTDAARRVPQQPLPVHINLWLFQGKPPADGKEVEVVIQEFKFVPAAAR

SEQ ID NO: 4845 - protein, 542 aa, Chromobacterium substugae
MLHQLSVKQKLLAGYGLMILILAAIVLTAILKLNAIQAKEVEITENRYPKAALCNKIVLATMGVARAVRDAIIAQSPQEIEANISKAEELRAQNTASLEQLDKTLVSAKGREVFTRVQQARGALSALYAPLYALIRANKDAESVAFLKQRFVPANAAFAQTLDELTAYQNDKVQQALDDSKAAYNQAVTIMLISAAIALAIAVTVALFVANLVTTPLRKSAQLVRNIQQGDLSGADESLPDSRDEAVEIARIIQHMRQGLREVVSSIQDNANQVSDSAHELASMAQQVAGGAQRQSEATAEAAATIEQLTVSINHVADNSDQASRQAREAGDLAGRGGHAVQASVGKIQSVSSAVAATSEEMRTLTGEVQRIGNIVTVIRDVADQTNLLALNAAIEAARAGEMGRGFAVVADEVRKLAERTASSAQEITQMITAIQQGVEKVVGSMEQSLASVDAVSGSAREASDSMEEIAGSTHSIVGTIGNITSALGEQRTASLSLAQSMEQVSQMAEANSATVEELATTSSELNALSHNLQNVTARFRL

SEQ ID NO: 4846 - protein, 273 aa, Chromobacterium substugae
MQVAEIFEKASGKLPMVPKVVQELVASFHRNDVKIDEITDKVGHDQVLTARVLRLANSARFGSSRKVGSLDDAVVLLGFDNLRVLVIASGVTGATLGIHGFDMKAFWTRCFAMANTAKLLAKLAGLDAQLGYTCGLLANIGELVLYVAVPEQAQQIDKIVAGGAERISTERMLLGMDLTELGAELARRWNFPDAIQEAIYNQHDLLNEDASPYALLIGLSTFLVAGFRNEMGVADMLVSLPERVLERLGLGRERVEAAMEPLQQACTQVDDMF

SEQ ID NO: 4847 - protein, 82 aa, Chromobacterium substugae
MARHPGVREVACVGVPDTRSGEAVKIVVVRQDPALTVDERLRHCRDALTGYKVPRHVEFRDELPKSNVGKILRRELRGGQGA

SEQ ID NO: 4848 - protein, 121 aa, Chromobacterium substugae
MVATPLPLPLYHVFALAINCLLVNRLGGQCLLDDAGRPMADGEAGEVCVRGPQIMAGYWQRPEDSAKAFHPDGFFATGDIGVRTADAARRTWCWYRASMFTPTKWRTWWRTWWRGIRACAR

SEQ ID NO: 4849 - protein, 49 aa, Chromobacterium substugae
MPARASATTWAKFSSAMMELDCAAAGLRRFQRAMDAGHGDKDMAASFLV

SEQ ID NO: 4850 - protein, 624 aa, Chromobacterium substugae
MNVFYEESGSFKVGSIVSRSDASLQVDTQHGKRAKLKSANVFLEFSSPLADFLPAVDALAADIDLDFLWECSQDDEFSYQDLAADYFGHAPSAVEAAALICRLHGAPMYFYKKGKGRYKKAPQDALQAALAGVERKKREQEQIDGWVRELKTGALPEAIRSQLMTLLWRPDKNTLEYKAFDQASRETGLPPLRLADKVGGIPSVPDYLMAGFQMEYFPKGVGFGKYAPPAALPELPLASAQAFSIDDANTTEIDDALSVEELPNGNKRVGIHIAAPTLGVPVDSDIEKMVLSRLSTAYFPGDKITMLPDDVVQAFTLQEGRACPAFSLYAEVTPEFEPVAFENRIELVPIAANLRHAELEQVFNEQTLANDPGVDYPFKRELVWLWQFAEALEKRRGKYDPTRPVQHDYNIDVVDGKVSITIRKRGAPMDKLVSELMILANSEWGRMLAEADIPAMYRAQSMGKVRMTTRPEPHMGLGVAQYAWSTSPLRRASDFINQRQLSAMIRGEKPLFAQGDAMLFAILRDFDATYGAYLSFQDKMEHYWCLKYLLQENITEPTASVIKEDLVRIDGLPLRLRIPGLPELARGDRVQLSVVKVDLLTQEVELRYTGRLDHVEEAGEDEES

SEQ ID NO: 4851 - protein, 528 aa, Chromobacterium substugae
MKPAAPLSPGQRTQLAREIDRIGYMLVSRWERPLAAHLLSLAMRLEALAGSVGRVDIAAEARELADLLRQWLQQQAEPSEQERYGLLRHHLGVVSQLGLMERQAGSSSQDAAERSGNPLLYLWLPGGIDAAPLQRQLACFGYEALALAQAAKLAKALQEETPAAVVAFADFADGDPILQLAPAISGSCPLVLTSPRRDFPARLEAVRIGASGFLDWPLQVNQLVDLLSFGDIGERRDPLRVLIVEDMASLAGLYSRALAAHGVEAVSETDPERVPELIERLNPDLILLDMYMPQCNGIELAKVIRQQRLLDGIPIVFLSVEKRQAVQLDALMLGIDGFLTKPVAPEELVVTVVNRARRYRKLRSYIANDSLTGLLNHSHLHGQLDSAVERARRAGQPLSLAMLDLDYFKQVNDNYGHQVGDEVLLNLARFLKERLRRTDLVGRYGGEEFAIVLTGTPADKACKMLETLRQDFCRLEQQVGERTFRQTFSAGVSSLASAEDATSLVQQADEMLYLAKENGRNRVESRGG

SEQ ID NO: 4852 - protein, 257 aa, Chromobacterium substugae
MKTRKSLLALSLLAASALAHAGGEYSFANVSANWLDWSNRTTEQSGKRDFGYLEAEGGLGAKWGEVYGFFDLENPGKGNNGTGTKDRRYTTKVIGRYNLTDIGGVPVQLYAHIYDTRGNEFFTQNRVLGLGTDLSFGALSIKPFFGVHNEMDAHQVGSASGYNGFMTGYVMLYPFQAFGQNLMITQWHETEFNRQDKFISVYKSGDRPRVGQNGAIALWWTPTKAVTTGIQYRYADQKLGSTAYQNAVIYSIKYNIK

SEQ ID NO: 4853 - protein, 38 aa, Chromobacterium substugae
MQKSDRSVTNCLHKAISTSNLRALADSLSDGYYMKIVW

SEQ ID NO: 4854 - protein, 105 aa, Chromobacterium substugae
MPPEFARRVLALLADVPPGRVTTYGALAEQAGYPRHSRHVGRLLGNLPEGVTAPWHRVLGAGGRLSRPGSQHADWQRLLLEEEGVEFNASGKVCLRIFGWPDQMV

SEQ ID NO: 4855 - protein, 216 aa, Chromobacterium substugae
MALKHHVIPVTPFAQNCSVLWCSASRKAAVVDAGGDIGRIRAWIDSQGLTVEKLLLTHGHIDHAGGAAKLAEELGVEIEGPQRAESFWLDQLPTQGGMFGFPRSEPLTPDRWLEEGDTVTVGEETLQVIHCPGHTPGHVVFYSPAASLLVAGDVLFQGSIGRTDFPMGNHQQLIDAIQQKLFILPDDTTVIPGHGPFTTIGVEKRSNPYAADPRYR

SEQ ID NO: 4856 - protein, 636 aa, Chromobacterium substugae
MSASSLRVLSLIPPMTQLNTPYPSTAYLTGFLRSRGVTASQEDLALALVLQLFSRAGMQTLREHVQRIPMRQRTDCMMQFDISYERYAATIDAVIGFLQGRDATLSYRIAGRNYLPEGPRFAALDVYMDPDDPDGGDPLAWAFGALGSQDRARHLATLYLNDIADVLREAVDPRFEFVRYAESLALSQPTFEPLAKALAAAPNWVDDTLDALTREAMATHRPQLVLISVPFPGAVYAAFRIAQTIKRHWPEVKTCLGGGYPNTELRELAEPRVFDYFDYVTLDDGERPLLALMEHIEGKRGVSRLVRTFLRQDGAVRYVNMQEADVPFSEVGTPTWDGLPIDRYLSLLDMLNPMHRLWSDGRWNKLTIAHGCYWKKCSFCDVTLDYISRYETASAELLVDRIEAIIAETGQTGFHFVDEAAPPKMLKALAEELLRRKLSISWWGNIRFEKSFTPELAQLLAESGCIAISGGLEVASDRLLKLMKKGVSVEQVARVTHGFAEAGILVHAYLMYGFPTQTEQDTVDALEYVRQLFDNGCIQSGFFHRFACTVHSPVGQNPEEYGVKLVPLPKGDFAKNDVGFIDPTGTDHELMGRGLNKALYNFMHGIGLDGDVRGWFDVRVPKPKVPRQFIERALYA

SEQ ID NO: 4857 - protein, 118 aa, Chromobacterium substugae
MSSEIHYPELTHAISQHLATLRADVPDVMQAFNDLGRAASRDGALDRKTKELIALALGVAARCDGCLGFHAQALVKLGASKTEVEEALAMAVYMGGGPSLMYSANALEAFEQFSAKTA

SEQ ID NO: 4858 - protein, 102 aa, Chromobacterium substugae
MPSPTIAMMRAAAGQACGLLRALSNEDRLLLLCQLSQGEQSVGELEQAVGIRQPTLSQQLGVLRNEGLVATRRDGKRIFYAVADPNALSVLATLYQLYCPKE

SEQ ID NO: 4859 - protein, 143 aa, Chromobacterium substugae
MQLDWSHFTPWSALAGGMLIGLAAAWLILLNGRVAGISGIVGQLLSPGGDKGWRLAFVAGLVLSPWAYRLCAAPPAIALDHRPWLLIAAGLLVGFGSRLGSGCTSGHGVCGLARLSPRSLAATLAFMAAGFAVVWLMRDGGVL

SEQ ID NO: 4860 - protein, 139 aa, Chromobacterium substugae
MKSLASAGCAGLLFGLGLLLAGMANPAKVLAFLDIAGRWDPSLALVMAGAIATALPAFALARRRERALLGGPMQLPAVRRIDRPLILGSLIFGAGWGLAGICPGPALVLAGSGAGAGVLFAAAMLAGMALHGRWARRRS

SEQ ID NO: 4861 - protein, 186 aa, Chromobacterium substugae
MVLGWMWAAAALAAPRPAELCGSCHGADGNGASPQFPRLAGQQAVYMEQQLLLFRDGKRDDKAAHRAALAKLDDAGIRSAAAYFAARAPAANAAAGADPKLVAAGAKLFREGNLAVGTPPCFSCHGDRGEGNATAPRLAGQHAAYLQSQLRVFDVSQRPAAAEMQEIVKTMSEDDIKAVLAYLPGM

SEQ ID NO: 4862 - protein, 358 aa, Chromobacterium substugae
MKASIATRLAQLADRLEEVTHLLASETATQNMEAFKKLTREHAELTPVVEAFAAYRQCEGDIAAAEEMLADPEMKEFAQAEILEGKDKLAALEVELQKLLLPKDPNDDKNIFLEIRAGTGGDEAALFAADLLRMYTRYAERNRWQAEIVSASESDLGGYKEVIVRLVGQGAYSRLKFESGGHRVQRVPATETQGRIHTSACTVAVMAEADEIAEVVLNPADLRIDTFRASGAGGQHINKTDSAVRITHLPTGIVAECQDGRSQHANKASAMQVLAARIYDIQLREKNQKEAAERKSLIGSGDRSERIRTYNYPQGRLTDHRINLTLYKLDQMMDGDIAELTDALVAEQQAELLAALGD

SEQ ID NO: 4863 - protein, 417 aa, Chromobacterium substugae
MHLLAFGLNHHTAPLSIREKLAFPAETLPRALDSLVASQAAREAAIVSTCNRTEIYCCSPDPHAALSWLCQFHGLSLAEVEPYLYRMEASGAARHAFRVASGLDSMVLGETQILGQLKDAVRSAEHAGTLGTMLNGLFQRTFAVAKEVRSSTAVGASSVSMSAAAVKLAEQIFPSIAELNVLFVGAGEMIELVATHFAARNPSCITVANRTLERGQRLAEQFGGNAITLSELPEALARYDVVVTSTASQLPMIGKGMVERAIKARRHRPMFMLDLAVPRDIELEVAQLDDVFLYSVDDIAGIVEVGKEARQQAAAEAETIIQARVAEFSDWLKKRETVPLIRALRDEADRTRRHALEAAMKQLARGDAPDKVLEALSVQLTNKLMHPPTQALSSGSGAEHDAQVQAIARLYRLHPES

SEQ ID NO: 4864 - protein, 49 aa, Chromobacterium substugae
MHGRKVPQTKTGHFSLSGRRRPAELARTAWRRRARRRYSADAARGMLFC

SEQ ID NO: 4865 - protein, 886 aa, Chromobacterium substugae
MNKGKMMRIKILAQAIAAFGLMGGGFAHAADGSDSQLERVTITGSNIKRISKEGALPVEVLKREDIEKTGASTTVQLLDNLTSSGSVLSGTNSASFAAGAATAGLRGMSSKYVLVLINGRRLPNYAMFISGTDSFVDLNTIPLAMIDSVEILRDGASAIYGSDAVAGVINFKTKRNFQGVKATTRYGQTEDGDGMEQGAGLMGGIGDLSKDGQNFMWSFDAYHREPVFASKHEPTKTLDYRRFGGKDSRSGTLWGSWKDYSNGKFYNPLPGCPKSLVTLSNGNTICPSDNDELGTQLSPRTSRYGLNGNYTKRIGSDSELFVEASVNRSQTSLDGGYAWMSQVQIKNGNAAYPTNPATLAAMQALYPQFTPGDTLQVTRSLYELGKSMVDVTADTYRVVAGGTTTIGDWDFEGSVNLGESKVTMQTSNAILNAPFMNMLQNGAPAGQPMFDPFAQNNQAGSLTPYATNLTNSANSKLQMLELKTSKSELAQLPGGPLGFAAGVQWWHESIESSPDALIRSGSIMNYAAQQGLQSSRSVAAAYAELSLPVIKNLEAQLAVRADHYNDFGDTVNPKFAFSYRPWQQVMFRGSATSAFKAPSLPQLYASRQAYQSIYDYAQCADKGISTANCTSVKQQIRSGGNPNLKAETNKSYGLGVVLQPMKELSASIDWYKLDQKDTIQALPAQYVVDHPELFPGYVVRKPSGIAGIRGDIDYISTPYANAGKTITSGIDIDVQYDLSLGGYGKLSFREQQTRYLTYQDTVLPTDSLLENVDYGGMPRWKNLFTVDYRYDKYSAAITARSYAGYKNAASPRDTIAANVPQRVPSYTAFDLNFGVRPLKTLEINGGIRNVGNRVPPYAAGASLVTFSGPSTDLWGRTYYITADYKF

SEQ ID NO: 4866 - protein, 153 aa, Chromobacterium substugae
MANRIAWHCHGFDGFTPLALYQVLQLRDRVFVLEQQSLYGDVDGVDTHCLHLSGRDEAGRLLAYARLIAPGEKYPDAAAIGRVVVEPAARGQGLGKALLAQAVAQCQARYPGRAIMLSAQQDASAMYAAFDFEPVSEPYDDGGILHLDMRREG

SEQ ID NO: 4867 - protein, 783 aa, Chromobacterium substugae
MNSNDLFAPPGSAGDPPPPPAAPEAASGDWIPLDLYAERAYLEYAMSVVKGRALPEVADGQKPVQRRILYAMRDMGLAHGAKPVKSARVVGEILGKYHPHGDSSAYEALVRMAQDFTLRYPLIDGQGNFGSRDGDGAAAMRYTEARLTPIADLLLSEIDMGTVDFVPNYDGAFDEPSLLPARLPMVLLNGASGIAVGLATEIPPHNLTEVAGACVALLDDPTLDTAGLMRYVPGPDFPGGGQIITPAADILAAYENGRGSVRVRAKWEIDRLARGQWRIVVTELPPGSSAQKVLAEIEEATNPKVKSGKKALTQDQANLKSLMLSLLDRVRDESDSESPVRLVFEPKSSRQDPDEFMNILLAQTSLEGNASLNMVMIGLDGRPAQKGLKSILTEWIDFRRSTVTRRLAHRLSQVDKRIHILEGRMIAFIHIDEVIRVIRESDEPKPDLIKAFGLTEVQAEDILEIRLRQLARLEGFKLEKELSELREEREGLRHVLDTPDALTRLIRDEIQADAAKYGDKRRSEIKAAERAVLTQTTADEPVTLILSQKGWIRARVGHNVDLEALSFKDGDALAAAVETRTVWSAIVLDHNGRAYTIDPATVPTGRGDGVPVASLVDLQDGAKPAQLISGPDAARFIVAGSGGYGFIAKIGDMAGRVKAGKAFITLDAGEKVLAPVPAPQGAGLDALQLVAAADSGRLLAFPAGELKELSKGRGLMLMALDEGAAMTAIGLVAGAKALLSTTSVRGKAGDEKLALEEFIGKRGKKGKLMPKKWLVSAIRELPM

SEQ ID NO: 4868 - protein, 518 aa, Chromobacterium substugae
MTRTSQPQALTPRAALLFVNGFRALLLLVLFSMSLLPGSDGLSLIEGGRHFYLWSGVYLLLIAVWFLLREGKLGHTLQLTLAIAADIAMMVWLMAMNEGIRGGFGLLLLPYLAAAGLLSTGRYALFYAAIATLTLFGYAGVEHWLGLPHSADLSYSALLAAACFITSIATWQLGRMARASEALAASRGGEIANLNRLNELILQSQRDAVMVLDEDGCLRQFNLQAERYFSRLSRGQSMPELLPLVRRWQQSGYPALPTFIEHSARGRQLVGRLAPVPVREGELRGVVLFLRDMADMAEEAKRVKLAALGRLTANIAHEIRNPLSAISHAGDLLAEDEADPARRRLVRIVQDNTRRINGMVEDVLMLGRRDRVKPEAIALAPFVAELLEHFSMAQPDAAGAVACQLPADCQLRFDRGHLAQVLGNLLANAWRHSSRAAGAVQLHASVAEDYLILRVIDDGPGVAEAEQSRLFEPFFTTENAGSGLGLYIARELAEANDARLDYSPPGGVFRLICHLAYD

SEQ ID NO: 4869 - protein, 433 aa, Chromobacterium substugae
MRVLVVDDEPDIRELLELTLLKMGLLPVCAGSVAEAKGMLGAGPFDLALTDMRLPDGEGLEVVRHIGEQALDVPIAVITAYGSTDNAVRAMKAGAFDYLQKPVSLAQLRSLVKTALRVEGGKPAQQQRLVGDSSAIQEVLRLIEKLSRSQAAVYIRGESGTGKEQAARLIHEQGPRAERPFVAVNCGAIPDSLMESEFFGYKKGAFTGADADHDGFFQQALGGTLFLDEVADLPLAMQVKLLRAIQEKTVRKLGGSQEEAVDARIICATHQDLAARVEAGSFRQDLYYRLNVLPLRMPALRELREDIPLFAQQLLQRYAGDGAAPQLAADARQALQDYGYPGNFRELENILERAVALAAGPVLSRDDLQLTPPREYCPEPGSAEPLQDYLDRVEREAIAKALDATHYNRTQAAKRLGVTFRSLRYRMERLGVR

SEQ ID NO: 4870 - protein, 430 aa, Chromobacterium substugae
MNETIEKKDATAFSEAWWADFMDRSQNLSKPVVVKNAIPQEKFRHHQQNVLSIIADLAKLKTTQFGYRIYIEGRLLGPNEMDDIFEKSAPLENEELETWAARVFGDQRFGIILNSGEKFNQALSKEIAVALAPLFDEIGYPRGGVQFTIFIGNYDKTPLGIHQDQRGESVIHFHVGPGSKTMYVWDREQYKNLLETQNLTRKDFAKLRPYASEFHFESGDLYFMPEGTYHIGMQEGLSVGITVWRYSHTDDLLAKHLHQRIFKQIPVEKTEDFQHDENSLDDTSGLDKIIEKYSLTDECKNLNYSELLRKTYQDWRYSVHSNAGYRNSPFPREGLEKIALQDRIAIESPYKILARESENTDKIYIYVRGHKIEFNRFPCVLALIQRLNEGRTEAVADLLQILDKSWPAQVGLYILNELYHWRGIDKVARQ

SEQ ID NO: 4871 - protein, 50 aa, Chromobacterium substugae
MTKENQVAQLEKEQDIKDFLGIQVLTPAEEISVSGGGQHQEKQQEQQHVD

SEQ ID NO: 4872 - protein, 385 aa, Chromobacterium substugae
MDHHPSRNHHVDNLRGIAISCVLLLHFALAYGVKDSPLGTLLPPWLLKSLVWNGNYGVTMFFVVSGFLITSQSLRRWGSLAAINIRAFYVFRFARIMPMLLLALAIIVALGCLGLPYFINKDHGQAMPASFFLVAAGSVLTFWHNLLMQQVGYFNYSLNVYWSLSVEEVFYLALPLLCVCLRRVSLLTLCCALLIVVAPIYRGQHADNEIDYLYGYLACFDAIAIGCLAALIARRRPLLGRAARLLRWAGGLLLAFNYLRGFSGHEAFGFTWLALSAALFLLGAAADPTLRGGSERLSRPLRWLGRHSYEIYLFHIIVLALLRNLVPREAVGYWTRLPLFIGFLLLTVLVAGLIGRYLAEPLNRGIRNRYLNRRGPAAAASLPSR

SEQ ID NO: 4873 - protein, 333 aa, Chromobacterium substugae
MPERPPAKPARRPARLSVCMIVRDEQAVLARCLDSLQGIHDELCVVDTGSRDDTVAIAERYGARVQRYAGCNGPDGRIADFAAARNQALAMASGDWVLQIDADEVLRQGHAQIKRHVRSAHPGMIGVGLSSNGAHWVSARLFRRTPDAHYRSRIHEYLVQGGGLLPDKRIRIENLENKQGKESASERNIRLCLLALAERPDEARTLHYLANEYRESQRFDEAIACYRQALALGNFPIGRFHSAYYLAVCHLLKEEWDQAMDYALLAIRADPRYAEGPCLVADIYSSTGQREYAAHWYRMALVCKRPPADAVLGVQHWAYGDYPRQRLARLAAA

SEQ ID NO: 4874 - protein, 284 aa, Chromobacterium substugae
MLSIIISWRNRKELAQALPSLLAAAHGVGGDVNIVNYSGDAAQLAALCGAYLPQLNIINVDGQEFFNKAAAQNVGASQARHPALFFCDCDIILPDPALLRRLCAHLAEGAGRFVTLAGVQESEVNSRQARHVVSFGYELNIRTADGRRLRIVDNEEDGETGTRQAPGLLLARRDDFLAIGGYNSDLHGWGWEDQDMISRLTLGRGLERVNEGVAVHISHDDHARIAHYPQVASRWESRDRMFRQALANYDDANFSGSYPRDLARLEGRIAMVRGAAADSGAVHA

SEQ ID NO: 4875 - protein, 306 aa, Chromobacterium substugae
MSMKLADYLGHTLARRAADDERIFVLDGDLADSDGAMHFAEAHPQRFLMTGIAEQNMLSVAAGMASCKLRPFVFSFAAFLCYRAYDQVRIGLSQCRQAVTMVGSHAGGLAARNGKTHAAINDLALMLSLPNIEVWAPADFADVELAVRACLQSPSANYIRMPRRAFGYDEQLPGEAAPLRWLLPPRPLTLVSTGLGSHWAREAAERLQRQGMEVGLLHCPYLGDRDAIARELAGVSRLVAIEDHCVMGGLASLLAGLQLEAPIAACGWPADYAGKSGSDEALRARHGLSAEALAAKVAEFAALRPH

SEQ ID NO: 4876 - protein, 296 aa, Chromobacterium substugae
MTIDISAPLAARHPASAPILHAAAPDGLTLAAEAKALRLDIIRALHAVGGGHYGGSLSCIDLLLVLYRRCLRVAPAAPGHPERDRLILSKGHSAVALYAVLRRLGFFSEPLDNYADFDSILEGHPDMLSVPGVDFSSGSLGQGLSVGIGMALALRGSAQRTWVVLGDGECQEGQVWEAAMLAAACGLDHIHAIVDCNRFQEWGWAPTPDAPHPEPVPQMAAKWRAFGWHVIECDGHDHQALELAVQEAQRHKGQPSVILARTQKGKGVPLVEAAPWRFHCETVSDEEHDIMLRSLA

SEQ ID NO: 4877 - protein, 599 aa, Chromobacterium substugae
MLSAEPIYGLIAKTAVARADFAGHWRQRLPATFPAAGADWFVSAAGLALHAPQTSAGPHGGQSALCCRGRTYGAAALSLEALQRDGARAFERCAGEFALAFWDEARGQLLLARDQMGQRSLFIREDAHHYLLCSELEPLLADPDFDCQLDAESAVHYLMFGAPYPGRTLARRVSKLPAAHYLSWNGAGPLLSHRYYTPIGFDAPKVVGAAEREQLERTLDQAIHARLADGGQAILLSGGVDSSYIAATAAMRAGGERLDAYTIEFTAPYPHNESQYARIVTDAYGIRHHAVELGPEQATAALADVFAAAEPCSAWSSITHRHLLARIGADGHRSLLSGLGADEVFGGYWKFFQSYAKLRFFEESWPAADAVDSIDGLMWQPTPARSRLFSGIPRFHPDSALRAALPQPYKSWSHAPQLIEFYRQCRRYKPDAHLFELMVAHECQHRVPDLLFAGFEPPARSQGIHTAYPFLAPEVAEQACGLGAAERFWRKDNRWRNKKVLREIAAKRVPDAIMQRPLYSYNAPIAQWMQHPDFSAAIYAQLRDAPLWDSGFVQRGWLSEVEAQIRSYTPRAKAAHFTCFGQMWVLATLAAWHQRWVAR

SEQ ID NO: 4878 - protein, 355 aa, Chromobacterium substugae
MKQDKILILGLGDLGRRLALTLPLLNRDLSLLLASRDRGRGESFARLSSACSATPQRFIPLDGLDADSLAALLERERPDLIVQAASLMSPWALFQRDDPQAVALRQAGFALQLPAQLPVIRNLMQAVRDSGVSCPVVNCSYPDATHPILERLGLAPTIGIGNAGMILALARRCAADASRPLRVFAHHAHVGAVVRAEPQAARGLPPPLLYLGDERLDAGELYRGPAIPQDQDLNALSAAHALQLIDALLPGAPELLTAAPGPRGLPGGWPVRVGQGAVALDLPAGIQPADMLPYMREAAAGDGLADIAADGTAHFTDALRAALPAPLRELADPMHPDEALPRFQLLQRHLERPAC

SEQ ID NO: 4879 - protein, 54 aa, Chromobacterium substugae
MNQQDLKTLDATEISEVSGGAGEISAKYLKLRAENTKSGEIQAQYLKLVSESTK

SEQ ID NO: 4880 - protein, 445 aa, Chromobacterium substugae
MSTYWTIRIEKSASHVPNPPTPESAASGSRLFRKEALRQLDTHRYGSIVLKRPISLAWLTGLFSLIALAIVLFFCLFSYTRKAQVAGVLLPTQGLIRLLPSQSGTVAEVRVKEGQRVQAGEVLFVLANARASATKGDAEGAITRLLESRRDSLAGDQGMLRLQARQKQAALQRRVEDLDKEVQRIDEQIALQRRRVALAEETVARNRKLQEANFISAAGLQDKQAELIDQQARLADLQRSRAATLRDQDGSRADLRDIQTQAQRDEAAAQRSVDSIEQDLTENEARRKLLVRAPQAGMVSGLTAQPGQTVAANQPLANLSPAGSPLEAELYAPSRAAGFVRPGMPVLIRYQAYPYQKFGQFKGTVREVSRSALRPEELYFTSPGASPDSEALYRVKVTLERQSVTTYGQSQPLKAGMALDASVLLEKRKLYEWVLEPLYSISGKV

SEQ ID NO: 4881 - protein, 717 aa, Chromobacterium substugae
MSHQQPVLQFWGRKRLPLLLQTEAAECGLASLAMVAGYWGLRIDLANMRRRFSVSLKGTTLKSLIAMAQGLGLQPRPLKLDMQHLPQLQLPCVLHWDMNHFVVLKAVAGKHIVIHDPAVGERKLPLAEASKHFTGVALELTPGNTFRKAEARQQFSLLSLMGRVDGLGRGIGQLLLLGIALQVCALAAPFYLQWVVDEALVAADRNLVTVLGIGFLLLVLLQTAIGAVRSWAATVLATSLNFQWLGHAFAHLLRLPLPWFEKRHLGDIVSRFGSIQTIQRSLTTQFVEGVIDGLLVLATLGVMLLYSPSLAAVSLVAVALYALLRWSIFRALREATAEQIVHASRQSTHFMESARGVQSVRLFGRQEERRIGWMNALAEQFNADLRISRLSITFQTANTLLFSAERVVVVWLAALAVMDNRFSVGMLFAFLSYKDQFSQRIAALIDKLFELRMLRLHGERVADIVLTEPEPELNDVELDPAHVQPTLEVRNVAFRYADSEPYVLKDLNLTVPAGQCLAITGASGCGKTTLLKLMLGLMEPTEGEILVGGIQLKQLGLSNYRKLLGTVMQDDQLFAGSIADNICFFDPQPDQERIRHCAGLAAIHDEIMAMPMTYNTLVGDIGSGLSGGQKQRILLARSLYKQPRLLVLDEATSHLDVWNEKLVNAAIRNISMTRLLVAHRPETIAMAERVVVLEQGRIVQDTTVAAAPACASAGTAI

SEQ ID NO: 4882 - protein, 301 aa, Chromobacterium substugae
MDPHLRTLSGIIDFECAARHRSFRLAAAELNKTPAAISQQVKQLEQTLGISLFERHPRHICLTPQGQELSQLITRMLHDLRAKISMLRVPEGAQTLHVTATHSFAIKWLIPRLQRYTERFPGFDLRIDSSDALRTLQEGVCDIAIRHHKLQRDAMNSLLVSEDLIVAYSPNLVTETGPVTLQQLLRYPLLYEDSPEHWHTLLNVHGLDRHRYDLSHQYSHSGLLVQSAVAGLGVGLLPYCLAYEDIVEGRLIMLPHIALPSGYGYSVFCRDDQPKMRQFVEWLQEEVAAMRLMPRAPAAKP

SEQ ID NO: 4883 - protein, 100 aa, Chromobacterium substugae
MQTADVFHLIVAISARTPADIEPIADALARMRPTCLAEPGCLAWEAYHSADAAEKFYLVETWASRAAWEAHGELSAIQDIYVPEIMPRINREVHPCSRIG

SEQ ID NO: 4884 - protein, 234 aa, Chromobacterium substugae
MSAQKVALITAAGKGIGAAIARDLASNGYRVALMSRSNAAIELARELGGVGVSGSVTEFADMQRLVQAALDAYGRIDAVVNNTGHPPKGDLLSIPDEEWHRGLDLLLLNVSKLMRLVTPIMREQGGGAVVNVSSFAVEAPELGMPVSAVIRAGLSVWTRLYAERHAAENIRMNTVLSGFVDSAPFDEKRAASIPMGRYGDTAELAAAVRFLLSAESSYITGQNIRVDGGLVRAV

SEQ ID NO: 4885 - protein, 307 aa, Chromobacterium substugae
MTKQVLVIGGTRYFGKRLVAKLLAAGHRVTIASRGNAADDFGDRVERIRVNRSDRAAMTQAFADARYDLVYDQVCYNPVDAKLACDVFAGKVGRYVMASTIEVYYPLRRAVQRPFRELDFEMRGELLEMGTSWHEMATPDQNYVAGKRQAEACFHQDGRLPLVAVRIGHVLADGEEEFLGRVASYVERARRGERLRYAVASGRSSFIHAESIADFLLWTGEQAFLGPINAADDGGLTALEIHQRAAAALGVPAHAEADLDEEAATRLSVFDFPFEYEMDTGRARELGYRFADVEQWIGGVFAGHAQA

SEQ ID NO: 4886 - protein, 75 aa, Chromobacterium substugae
MAATDVKPFFNISHRMEDQMSNECLVCSEAVNISADVLVGEIIACGACGQEHELLMVDGQPKLALAPEVEEDWGE

SEQ ID NO: 4887 - protein, 306 aa, Chromobacterium substugae
MSQITVLLILTKMRPEEKAIVEALERRGVKVIVSVDGRDLGWLLQGESGVGHPQVAMLRCLSQSRNVELARLLRACGIPTINSVDAIDICCSKVAQAMLFRQYDIPAPQSVIAFQADEITRYGQRHGFHFVLKPASSSWGRGVTLIRDEEALEAWRSAWETHDALYKHFPVLIQAFVEKPGYDLRVVIVGERPIVAFRRATDHWKTNTHLGAQVVPCEVTDAIHDLTTQVVEAIGPGIYGLDIFEQVGSDELLVCEINQNPEFWRSSQIHQVDVAGAIADWVAADAATYNLSFQVNSATSLAMVAS

SEQ ID NO: 4888 - protein, 202 aa, Chromobacterium substugae
MNNFQQSLILSRVMTSGVVMSIEKNDRQLPGLESLIRSRTGLQHVALFNSITGAIHGALHGQGIGHGGRAVFPGISEREYKFLTWLGVTFEETRAEPRTYGLASVAWRDEQTDFAAAATRLADDKVQVYDFAALGFGPCAAIATNDEQVWKRAERLKIFGAFDLRTMWSQAESEPDIQPTIQFNYRLSPLVAACVRQAIQGD

SEQ ID NO: 4889 - protein, 450 aa, Chromobacterium substugae
MRSSGNPRGLIMQTDFPALPLPWPTDSVLRDELAHLGGPPVIGQGFRRTLFPVITKEDVLQMQISILRNHSTSVAQFTEDYRQYVGAPFAIATASGTSSLHLALIGAGVEPGDEVIVPCFTFIATAQAIVAAKAIPVFVDIDPQTYCVDVAAVEAAITPRTRVVMPVHVHGLPANMAALRDLCDRHQLALVEDASHAHSASIDGKVCGSLGDAAGQSLMADKNFPVGGEGGIAFFSDEEKYQRALKFLETSGIDYAMSGIVASFGISQLKRLGYYDAIRQRNADYLTAQLATTGLFSGPTVPAGYVHSYNMYRIKLHPAAAGLDDLPVHAVKAAVQELLLAEGVPAREWQNRPIPGHLPFQNRTGFGNGYPFSLSDRDFSEYQIERFPNTLDMLESTLTLCRELRSPVETERIQSYALAFRKIAARPDVIRELATKGEFPLPYQRDSRLG

SEQ ID NO: 4890 - protein, 284 aa, Chromobacterium substugae
MAMESMQPVDIVFSCLPGGALPGMLEQIRGKARRIINLAGDFRLRDPELVAKHYPQTAALGMPADARYLIPEFWQAEYADAPLLNLPGCMAIATFYSLYPLVARGLVESDIVAEAKTGSSGSGKESAEHPAERGHNYRPYKLSGHRHEPEIVEALAEHAGQRVDLRFSAGSLDSPRGISVSSFFTLREGVQELDVRKAFMSAYGNTRFIRYLGPAQGPWNMPMLKTVVGSNAVEIATDTVGRRCTVVSALDNLIKGAAGQAIQAMNLAEGFDEAEGLAYGGMWP

SEQ ID NO: 4891 - protein, 642 aa, Chromobacterium substugae
MTALFNPGSVPAQAPAPGAAIPKSRMPLYVIKVGSATLDAGSAVFGEIAALAETGCRVLVVVGGGSAIERQYAAEGLPLRYHTLANGDAVRTASREDIDLLVRTYRDQVIPSALKGFADAGLRAFAAPGHQLSLVTAQRNRPIKVQVDGKALVVREHLVGTPVDCQRALLGHLLEQYDVVCLTAPVAGADDAAAVLNTDADMLAAFLATALQADHIRFVTSTPGILRDIDDPESVVADIFPGVELDFVKGRMKQKMRAARHVIENGIADVAIVGPHSFAQAAGVTRVWPLPPPHPALASLTKAVSINSVSRDEAEIAKWLVAYCRQQGVDAHVDAAGNFVASKGNGPQHLLLLGHIDTVPGPWRPILNADGHLSARGVVDAKGSLVNFVETLLAASVPEHGRLTVVGAVEEEVSSSKGAFHIRDSLIADAVVIGEPSRADTLTLGYYGLLKIRIIASVRHAHSAGKGVVSAPDLMVETVATLRDCAARFDPEGISALISTKSWSDSNRQHAEGILNFRVSPSADLPALLAAVETCANEEVRCDIERATPGYGTTRTCELARCFGRAFASQGIAPRYVVKKGTSDMNTLATRWTGVDMVAYGPGDSALDHTDHEFVTAEEFGRAREVLDAAVAQWFAVRGGRQ

SEQ ID NO: 4892 - protein, 273 aa, Chromobacterium substugae
MSEIIETGAQSAAWDKVGLDELQRRVRRTIVDLAATPTGCHIGGSLSVADILIAAFASVDRAAGDEVILSKGHAAAGLYAVMHHLGIMPEDPVASYGAAGSILTGHPNHKIPGVRFATGSLGHGVAYGVGWALARRIKGDRRRAIAVAGDGELQEGLCWEAFQLASGKGLGNFIVIVDRNGGQNDGAVDEISPMPDLLRRFEAFGFDCAQADGHDPAALGAIIDAHDARGDRPLAIVADTVKGKGVGAIENNPACHYAVLKPAVAKKWKETIA

SEQ ID NO: 4893 - protein, 314 aa, Chromobacterium substugae
MSLAGRIAYREELTRLAVDDAAIVCLEGDLGGAKHPFQSAHPDRFFNLGIAEAAAIDCATALAFNGLTPFFSTFAPFAVLRAAESMKLSMGYMAANIKVVAPYAGVAGGWFGTTHHCLEDLAIVQSFPGIRILAPYGEEETRQAVRLMAETPGPFYMRLGRNGAYASLDGERDRHGIVWQAASGSAAPTLAVVSAGEMATAAVLAAREQGAEFAHAHLWRLDSEALAQAAAGLAGFDAVLVAEEHRAQGGIGSALALLLPEVRVHSFNCGEGWPGVGGSHEEVLASLGFTSESLRQRIEQLLPAAARRAGDLSH

SEQ ID NO: 4894 - protein, 417 aa, Chromobacterium substugae
MHILMIECNPNGIAGIANALELGHDVTLVSADPDFYLNVSPLAKAAFEHPRCRVIKSDDAFVIDALLALAKRLHAEKPVHGVATYSEYHTVHTATVAQALGLPGMSVEGALNARHKHRTRTKLAGSGVRQPRFAHVSDPQQVEAAVREIGFPCVVKPSDGTASLHVLHLTNEKDLEQYLAELAKITDYGRGVVRIPDILVEEFVEGELVSVEACVQQGGKVVNLGITDRALSGFPYFIEMGATYFKGHPLQDELFAMNEKVLTHLGVDFGFIHTEYLLSQDGPVLCEVNGRLIGGVVPSLMQLSSGVDPYLEVIRQALGETPEHPVPGDVVASVRWFGSPVDGTLSKIDFSQLKTLPGYHDALSYRAPGRPVSRLSKSNFDWLGHMVFTGDSREQVNQRCEAALDSIHLELAVGVAK

SEQ ID NO: 4895 - protein, 452 aa, Chromobacterium substugae
MSAAVAESRPATAAGDGARRALRRVAIPVLDSSQLFDVEVEDGHFASIRAVGETAAGAKPAASLWPGYTECHAHIALPANFDDSIDEPELVALQYLYHGVTQVVDMFGFPLVRQRWQDAAAASWLPYPEVAHCGYAITAMCGYDGKGAHGTEFPSPVFMLGCESDLDTILEANAKLGASFLKVMFTDGVEQPGSPVKFNRLSAPLLEALAKAVAARGIPCVLDCNTREEVLLAYRFGFRYFAHAVRDVELSDADWANLPGASFVSTLSGLRPMVMSREEFLDEYGHAGFVQTQDAANLDFVAGIEQPFGVARNCFETRTGALRAMRQNSRAALARGALRVGTDAGNAGGFHGYSLLAELRLLAERRGRADVALQTNACLDGRRFFELLAGRAATEPFAVGAAATFNLFRDADAATGALPDETVVRGIAVDRARIAQFIHSRRASATKGKVSL

SEQ ID NO: 4896 - protein, 389 aa, Chromobacterium substugae
MYGINIGIALAGIGNFIYFPHLVATLGSSYSGFWAGFVMFMTYVGRLSATFSYEGFSARVGKRHGIVIGILVEAVALGLMAFAHDVVAYSALAFFVGFGSGTSFPGLKNVLGEFPEAARAKAFSSFQLASQSGIILGALAGGLFSNAQMPLVFLVVFLLFIGYCIAAYFVIPGETHPPKRDVPLFNAGILKGLELGEGTFYFLLSSLFWLLSLNFVVSMPLHMQAYVKELPLTVPFWITGVAMLLLQMPIFRFFNGRFPPGYVMAIAFIGMSAAYLMFGMGVSAYWVVAGCLIVILGDILFTPSFDMWVSAKIPADRLSRAMGAMHFFRSLGNMLGSFLAGLLFDLSRHMGRPGLNWLIVAGLALLCAVVSFASVKKRVPLAEQLSGAK

SEQ ID NO: 4897 - protein, 424 aa, Chromobacterium substugae
MTELKSINQQRPTVLVISTGFHLYREYLLRQIVEEANVWLFTDAAPTWQIPYLNGYTLVNTLDAEAMAREALALAATRKIDGLICWDEIRMVPTSRVAAALGLPGGETDAYARCRDKHETRQALAAAAVPQPESVLVADIGQAVATAARIGYPVIVKPRGLGGSYGVTLVNDEAELTAAMQHVDQHCELLAGSGYTRYESSVLIEEYMTGEEVSVDVAWVDGRMHPLFVARKETGFFPHFEEIGHVIHGHDPLLEDAEFLAVLGGAHRAVGFRNGITHTELMLTAKGPKIIEINSRLGGDMIPYIGGISSGIRAGAVAVAVACGRAPDVARTRQRTAAVRFLYPDGDCVVQALAVDRDALPENVDDVCLLVEPGHTLYFPRVSGRYAFLTAYGDSEAACKAALDQAAAAVRFEAEPLAEAAEAV

SEQ ID NO: 4898 - protein, 73 aa, Chromobacterium substugae
MARPPHGAPRPSKVTQPATRHKGRITAGYQRARLNRLSWLTRNSRAGRWLPPGTGRWPAASGRLSTPAWTARR

SEQ ID NO: 4899 - protein, 660 aa, Chromobacterium substugae
MITTIKGKILAGSGLLILIGFIVLAGANIYNSYRNAENAVLDHARLLADSEAGRVQRMLGKTYDSAQAMAEAATGVRAALPANGRSLLSEVVKRQLPNNPDAVGYWVDWEPNAFDGRDAELAGKPENDHTGRYGVYWFRKAGKVDVVWGSDGVDESAYYTEPRKTGKPMLTEPYVDPDVKILMGTLSFPLILNGKVLGVAGCDIALGHLQEMAAKVKPYQNGFMSLYSNGGVQLAGREPALNGKAAPDLPAEAKAAIKEGRPAEYESADGYRHFIMPITVGDAGAPWAVRISIPLDEAFAPVRAASWQSAFISLGILALILLLLGATLSQLLRPLGRLQGAMTELASGSGDLTRELAIASRDEIGQAAGAFNTFTGSLRHMMLDVRRHAGDVLGSVRQLSGEVDQIRGSSARQAEAANATAASVEQLSVSVSHIAESARVAELRAREADALSGQAAANVDATAAEIGRIASTVRQLADVLGGMQQRSDQISGIVSVIRDIADQTNLLALNAAIEAARAGEQGRGFAVVADEVRKLAERTAQATLEISGVIQTMQRDTAQASDSMGGALQQVDQGVRLAGESSQSIQQISGHALQVVQSVGDIAASTAEQSSASQEIARHIENIHTMLLQTDGSIEQAQQATVALARLGEELESLIGRFKL

SEQ ID NO: 4900 - protein, 301 aa, Chromobacterium substugae
MELRHLRYFAAVAEHASIRAASETLHISQPAITRQIQDLEGELGFALFARSPRGLRLTPAGDSYLRDVHAILTTLDAAGQRARRVAGGAAGQLRLGYVENTGWDGPVPQALQRFQAEAPEVAVELSALNSPEQLAAIARHALDGGFIYQLEPLPDGFASLPLRQQDVVLALPRAWRIEHDETQPFDLRALAGRPFIAFPRAVYPEYHDRLFSACLQAGVRLNVVQEQPTEAAILALVCAGVGAAIVNAANLARPPAQARFYRLRNLSVPLPLCFVWRREAGNPALARFVDSLRQTIDSARP

SEQ ID NO: 4901 - protein, 288 aa, Chromobacterium substugae
MNAHTYTIGNARVTRVTDTLLTGITPAYLYADWRDAALDEQPQLRELFDASGEHIILSVHTWVVELGGKVYLIDTGLGNDKERPFNALFHRLRTPFLQRLAALGIQPEDVDHVLLTHLHADHVGWNTRLAEGRWVPTFPNARYAMPQGELDFFATPEADKRRVVFDDSVAPVLASGQAVGIAAAGADYADAFHFHPTPGHCAGHMSITLHSAGATAIFSGDAMHSPAQVYHPEWNSAFCREQDGARTSRRWLLDYACEHQATVFTAHFGASSAGRVGRSANGYGWQFL

SEQ ID NO: 4902 - protein, 195 aa, Chromobacterium substugae
MSVRGRPRSFDREQALRSAMRVFWAKGYDATQLAELTKVMNIKPPSFYAAFRSKEAIFREAVELYLHSEGSASMRALASAATTAEAIHGMLLASVDTVLASPGANGCLLILGLVNCEPDNVALQDYLRQIRQHTIQLIQSRLEDGVGKGELPADADCKQLANFYFTVIQGISLQARDGADRASLIDTVKLAMKCN

SEQ ID NO: 4903 - protein, 373 aa, Chromobacterium substugae
MLINTDNLALRPWRVKEVHELYAAIQDSRFQQSMLQADPFHQANAAMAALKSAIAHPRALPVAEFAITRVRDNTIAGSALVKLTDARTAAVEIDYALYPAFAGQGYEAEVLGALAGWILECGAARVELVCGLGDIHRAKTALACGFRYEGVQRCAIATLHGLESGGMFARLPEDAGTPLRQVFPDLPPEGLSDGVVTLRVAAVADVEALLAEQTNVEARRWSLIEPLSRCDIASRVEKAALEWLVGPNAFFSIVDCESGEVAGRIVLRAVVPPQVADVGYGVLPSFRGRRFASRALQLLSQWAFEQAGYVRLELGVKPGNVASRAVAEAGGFRFDGMRKSRLRNSDGSFSDELHFVRVNPAYLEPDVPLVIAS

SEQ ID NO: 4904 - protein, 476 aa, Chromobacterium substugae
MLTAGGQPFKTWLAGLVAQVAGDDNVGMYRPRSRKGVIRPNSVEQVRDVLRLASQSEESVALHALSTGRNWGLGSREAAQDASLALDLSGLKQVRALDLDAGWAVVEPGVTQGQLAALLAGSPRMINVTASSAHSSVLGNGVDRGVGLRRQRVEDLVGLEVVLPDGEVMRVGWWPDAERPSPVYPYGLGPSPLQLFFQSNLGVVTAAVVRLMPRPEALRVVRLSFARERLAEAIDVLQRWSAQGMVRGVLKVYDATAGALYGGGIGEYLTHVCVDGTAAVVEAMTTVILDEANRSGLFLHVSHSDQRDPRLSGNVVAEMVASAYAGDPSRNDTLLQATLGQDAENIDAAGRGWLFFLPLIPFHGEAIDRAQRLLAQVYDETGVHCGATINALNSDVIDYVVAIKFERNADEARRAHQALDRLYQLFSAAGFIPYRLDVDHQDWIDGLSPDQAARDFVRGIKGMLDPRAVIAPGRYA

SEQ ID NO: 4905 - protein, 398 aa, Chromobacterium substugae
MAYLEKENMGQAAADEWTAERILSRARELAPVLRQRAAEIEQNRHLPADVVELLRGTGVFRMAMPKSWGGPELDSMQQTEVIEALAIGDASAGWCGMIGADSGIYSGYLREETAREMFPRLDMITAGWIHPEGRAERVAGGYRVTGNWRFGSGSTHCDWLAAGCAVYQDGEPVLAENGKPEWRIMYARPDEYQIRDTWHTTGLAGSGSRDYAAVDLFVPEERSFSFREPRREGPLHIAPDAILRKMSGVPLGVARAAIDHVRELAASRFDRVTQLPWPQSYRIQTALAQSEMELHAARSGVFASLERQWEKLSAGQPLSTGERVSAALARHHAFGTARAIVARLFDTVGGAAIYRASSPLDRWLRDTNTMCQHAVAQDMILQTCGELMLGGQPDNPFL

SEQ ID NO: 4906 - protein, 172 aa, Chromobacterium substugae
MQDNTDNDLSARRADGPGHAYLPAGSGQRVWMSGDEYRILLDAAHSAGTMTLLDALVPPAGGPPEHAHADVDELFVVLDGELEIMADGAKYQVGPGGRVFVRRGTPHAFHNRSADPVRMLIFYTPAGVEEFFLAAGVPAQDGLPPPPADEESTARAIEAGLRFQVSQAAQPA

SEQ ID NO: 4907 - protein, 391 aa, Chromobacterium substugae
MPLAIYVLGLSIFAMTTSEFMVAGMMPSLAAQFGVSLTAIGYLVSAFAASIVVGGPILTVMLLKASKKNTLLTLVALFFVSQLIGATAHSYEVMLASRVLSGVAESAFFGVSLAVCVDIVGPQRIGRASSIVLGGLMVASVVGLPAATLIDQHLGWRASFWIVAGMMLFCGLVIAVQVPKSPKAAEISLKQEFAAFRNADLWAAYGTSGLIIGATFAAFTYFAPIFTEVSGFSTATVPALFACYGLATIVGTMITGRLADKHTMGVLAVGLVILISLLALFALKAESQAVTIVAVALLGLVGLPMNPAMAIRVMRVANNGPLVNTVHTAVINVGIVVGSWAGGSVMSAGHGLRAPLWVGVALAIAGLVSVLPFLRRHSAEGVRARLAGATR

SEQ ID NO: 4908 - protein, 252 aa, Chromobacterium substugae
MDTKFAGKVALVTGAGSGLGRELALELARQGAAVVLAGRNEDKLKAVQNEIEAAGAQALSHSTDISLPHEVDGLFEAIRRRYGRLDIAVNNAAIWETGLVAEQDEAAWRRIIDTNLNGTWRCMRAEIGLMQERGEGVIVNLSSIVGGHFAMPGTAAYGASKAGIEALTRTAAKECIQQGIRINTVSPAALDTPMSLLEGETEEERGKRLGGIIPIGRVGRLSEVVQTILWICSGDASFFVGHDFVVDGGVTA

SEQ ID NO: 4909 - protein, 162 aa, Chromobacterium substugae
MEVLKKHHIECDGQHWQQEYKSTLGRFPTGVCLAVLEEGDDKIAITINSFSSVSLVPPIIQFSLKNHSRFLGKVRDARQFSVYFLARPQAEEALMFAKQPASPVSPQVLGDSAAAIHCRLEDTYQKGDHTMVFGEVKAVEHGRGDALAYYRSHFTSVEGYAS

SEQ ID NO: 4910 - protein, 378 aa, Chromobacterium substugae
MQSPNGPAPRLPSLTGMRFVAAALVFLFHASLLAAVKFNPYQDSGAAQLFQSIFSKAGWLGVSFFFVLSGFVMTWSARADDSAGGFIRRRLLKIYPNHFFTWLLMMVCMGNVFVDPRVWLSNLLLLQSWVPRPEVFMGVNSPSWSLCCELLFYLAFPWLNQRIARIPAGRLWPCAAAAVLALFAVQLAVDSWVPATPKGPGLPISLQQWWLSYFFPPLRMFEFVLGMLMARILRAGKWPDLGLLPAAGLLLGGYLLAREVPFLYGLSTATVIPVALLITAAAAADAQRRPTGFNGRRMVWLGEVSFAFYMVHMLVLDLASAWLDGRRFEPAAATLVVLAAFLASLLAGWLLYALVERPVMRYWSRPRAAAVRLQSADA

SEQ ID NO: 4911 - protein, 389 aa, Chromobacterium substugae
MKGRVAASLLPLAAALALAGCGKDLGAAQAAAQAPAPAVPVSVQQVAPGNVDVAYEYVGQSAGSREVEVRARVGGILQKRMFTEGQPVRQGDPLFQIDPAPFQIALEQAVAALRDRQAELTRAQQNYDRVQPLFRENALSRKDFDEAAANREAARAQVMAAQAKVKEAQINLGYTRVSAPISGLTSREVRSEGSLVGGSADASMLTKISQNDPIYVNFNVPEADLDALRGQQSSGALKFHGGGFKVSLRLSDGSRFERSGSLNFTDHLVDASTGTVRLRASLANPDGRILPGQFVTVLLQGAYRAQAIAIPQRAVLTSQQGKAVWVVGADNRVQLRPVEAGQEQGLNVLINKGLKAGDRVALDNLVKLRPGALVQISPEPAATGASSRS

SEQ ID NO: 4912 - protein, 228 aa, Chromobacterium substugae
MFSSFLIRRPIFACVLSLIIMLAGVAAMGVLPVEQYPQIVPPQVQVVASYPGASAEVIANTVAAPLEQAINGVDDMLYVQSISASNGQLTLNATFKIGTSPDQATINVNNRVQSALAQLPEEVRRQGVSVRKQSAAFLQVIALYAEKGRYDTLYMSNYALLNVVDELKRIPGVGDVINFAGRDYSMRIWLKPDRLAQLKLTPSDVVAAIREQNAQFAAGKLGAEDRRR

SEQ ID NO: 4913 - protein, 291 aa, Chromobacterium substugae
MQASRELLKTLYTMAMLVEARDAYTGGHLWRVSRYSHLLAEDLHLPQPEVERIALGGFLHDLGKIGVPDAVLNKPDRLSDEEYEVIKTHPRVGADLLRDHPLAELVMDAVLCHHETPDGNGYPQRLAGKAIPLVARIVGITDAFDAMTSTRPYRQGMPLPKALAILEENLGRQFDQELGSRFIQLGRSGRLDGVLGHSEPGIPMQSCLACGPIIAVPGSAADGDEIFCPSCAGGYRLRRGNGQLSLAPSGNRDPVKARQPRADSGLIDSLLQGSGPLRARSKPGLLDLLFG

SEQ ID NO: 4914 - protein, 450 aa, Chromobacterium substugae
MKSWLLLGLTLSSLAVAGNEPVQPDARYGRILSPSGPLSRAELLKQGLPKAKPAAARLSAAAVPGPATYTYLRCYYRTGAGNTQPTTDYVWALDPSSGDYYRLNGHWWSSSILDWKNMFYSDATQDALRSVCQGTLAKKGINQAPAMVFAADNAMSFNYTVWSNDQAGQGSRINKIIAFGDSLSDNQNVYNASQWTLPNRNSWFIGHFSNGPVWVEYLASRLQLPLYNWAIGGAGVTTQKLVIPGVVQQVQSWQQYMQQAPNYNPATTLFTMWIGGNDLVNYGSTPDKVIAGQQQALTNLIGSGARNILLLKLPDVSRAPVFQLKSGGATVAAQVLDYNQKLDALAVSLRQQYGVNIQVFDSYALFGDLLTNPAKYQVSNTTQSCLNINTDSSLNYMQSQSPRANCGNADTFVFWDTLHPTTHTHLLLGNAVADFLNASGSAFPALKTLR

SEQ ID NO: 4915 - protein, 337 aa, Chromobacterium substugae
MSTLTELLSRAAAARAELIERLAAEDTNCYRLFHGSVEGASGLTVDRYGEQILVQSFHQPLSEEELAEIRAYYRQTLPELALVYNDRSESHSRIRNALPLAEQAVAEQDVAIRENGVAFHYQARHKGQDPWLFLDLRAARRRVMQLAEGKSVLNLFSYTCGVGVAAAKAGASFVLNVDFAESSLSVGRANAKLNLLATRPRCLHSDVFAALRQLSGLGQAERVRGKKMPPFPKLEARQFDLVFLDPPRYSKSPFGVVDLVNDYQALFKPALLATAAGGALICCNNVAEVNGETWLEALKRSAAKAGREVRAAEWIAPDADFPSADGKPPLKIVLLHV

SEQ ID NO: 4916 - protein, 444 aa, Chromobacterium substugae
MKTSIILSLLLGALASGQALAQAEQPPSDELDGVVSAGKPLSGSEARAAAGQAKPQPGSATYTYLRCYYRKSPVANQPQTDYVWATDPSSGDYYRVNGYWWSGSFVALKNMFYSDTSQDTLRSVCQQTLAKQGVNRPLALFAAANNVMSYNHTIWTLDSASQGNAINRMVVFGDSLSDTQNMYGASQWRLPVASSWYVGRFSNGRVWVEHLADQLKLPFYNWAIGGSAADSHLVVPGLLQQVDSWAQYMQKAPGYRPENTLFTMLIGGNDLLNYGRAVDQVIADQGKALDKIIAAGGRNIVVLTLPDLSRTPSGSAGGKAAQLAQQVKDYNAKLATLVANLKQKHGTALKLSLFDAYGMFNDLLTNPAKYQVSNTTQPCLNVAANASLPYISSQTPRPECANADAYVFWDNLHPTTHTHVLLGQMVADFLRQQNLNLSAQARKR

SEQ ID NO: 4917 - protein, 419 aa, Chromobacterium substugae
MRAGAYHMTTTILAIFLTVYLGMILGGLPFLQLDRTGVALLGAIALIGVNALSLEQAVAAMHLPTLILLFAFMVISAQMRLGGFYDWVTRKLATLSLGPAGLLAALTVVSAALSAVFSNDIVCLAVAPVLIDACRRRRLDPVPFLLALACASNIGSAATLIGNPQNMLIGQTLRLDFGGYVLAAAIPVGFGLLACWGLIIRQTGGRWLDAGPAEAAAEPPREDTPFDGWQTAKGLAIAATLLAAFLAAPWPKEHMALIGAGILLMSRQLHSRKMLGLVDWELLVLFMSLFVVNHALQRTGIPADAVAGLAALGVRLEQPGPLFAATFLLSNIVSNVPAVMLLLPVAHHETSGLLLALVSTLSGNLLIVGSIANIIVVDAAARRGIAIDWKRHARVGVPITLASLAVSAAYLALRFQLGL

SEQ ID NO: 4918 - protein, 322 aa, Chromobacterium substugae
MTHHSIGQGQLLADLKIGIEIKPWHRILKVAVDTGILLGLLHSANRFCAATTQTSRRNRMQVLEQVMRLVREVAAREVMPRFLHVGKSRKEDGTLFTEADLACQAALQRGLPEILPHPVLGEEMDREEQDALWDGNQDGLWVVDPIDGTTNFVNGLPYFAISVGLMVNGKSELGVIYNPVSDEMFYARRGQGAWMNGRSLPLKTIHNCIGDAIASVEVKYLRSGKLAARLGSLAPCGSQRNMGSSTLDWCFLAAGRYDLYLHGGQRLWDYAAGAVILEEAGGRIASLNSDDYWSDVIWKRSVIAAITPELFGQWHRWVRANQ

SEQ ID NO: 4919 - protein, 213 aa, Chromobacterium substugae
MRLNAGDAITLFNGRGGEYQACLSAVQKRDAQCVVERFDEVSRETPLWLGLAQGISSGDKMEFTLQKGVEMGVSVFQPIAAGRSVVKLSGERADKRVARWQEIVVSACEQSGRNLIPQVLPILTLNEWLQARQEADIRLILSPRGDKSLAELSARPARSWLMVGPEGGFSAPEEDAALAAGWTPLKLGPRILRTETAALAAVAAMQAVWGDYS

SEQ ID NO: 4920 - protein, 426 aa, Chromobacterium substugae
MVPPLPALGPIHPAQPAFPKYAMIKCIDVNDLRVGMYIHDLNCDWMSHPFLVNRFKVAHESEIQKIAEAGIHEVYIDTRKGIDLPSAPSAVEVRKQLESELRAIASRESTVVRKVESGEEFGRAQVIHHEANQIVRDILQDVRLGKQVELEQVEPQVERLTESILRNNGALLSLCRIKDKDNYTFQHSVSVGALMVSFCNALNMGKDVIHHAGIGGMLHDIGKMRVPDEILNKPGKLTEQEFQVMKCHVVESQKILHATQGISETAVLVAGQHHERHDGSGYPAGLKGDEISQLGQMAAIVDVYDALTSNRCYHQGMPPTDALRKIYEWSKFHFNPELVQAFMRVIGIYPVGTLVRLESGRLGVVVEQNDSSLISPKVKVFFSIKSNAHIPPEVVDLSRRMGHGGGDRIVKHESPEKWKIDPLRFL

SEQ ID NO: 4921 - protein, 73 aa, Chromobacterium substugae
MGGMDRAQGRKRWNHAGVLQASAGMAGFSRPDRRQGQIGRAAIGTDISPPSIAAGLPTRGGSGYIPAVLFGTR

SEQ ID NO: 4922 - protein, 306 aa, Chromobacterium substugae
MANPLYRKHIISIPDFSREELELVVDTAARLKQNPRGDLLQDKLVASCFFEPSTRTRLSFETAVQRLGGNIIGFADGGNTSAKKGETLADSIKIISSYTDAVVMRHPKEGAARLASEFSAVPVINGGDGSNQHPTQTLLDLFTIRETQGRLEGLSVAFAGDLKYGRTVHSLAQALSLFGARFYFVAPEALAMPDYICEELDERGIEYTVVDSLEAVIPEVDILYMTRVQRERFDEAEFKKISGKFALRADMLKNARPGMKVLHPLPRVDEIAVDVDATPHAYYFEQAKNGVFARQALLSLVLNETV

SEQ ID NO: 4923 - protein, 152 aa, Chromobacterium substugae
MQYTRTVEALKQGTVIDHIPAGQGVKILRLFKLTETGERVTVGLNLVSRHMGSKDIIKVENVALTEEQANELALFAPKATVNVIDNFEVVKKHKLTLPDAVEGIFSCPNSNCISHNEPVTSFFYVKTLAHDTKMKCKYCEKVFSRDIVAEVR

SEQ ID NO: 4924 - protein, 426 aa, Chromobacterium substugae
MPSSLLKRHPAVLNLLLAACCGVLGALLVLCFQGVLHAIENLLSGQSGSLVGIARQLPPWQRALAPVLGGLLAGVVLEQGRHLLRGSASGDYLEAVRVGDGRLGLRRTLVNSLSSLCTVASGGSIGREGAMVALSAQGGSLLSRLVPMTLPSRRLLAACGIAAGWAAAYHAPLSAVVFVAEVVWRRLDWRALPALLLAALTASLTVDHLFGLAPLYRTAPLPAPDHLALFGYCLLALPLGAGSPLFLKSMELGRAAFARLPLRLPLRMALGGAVVGALAWFWPQMWGNGYSTVSWLLQAESAWQLVLVLLLCKLCATAATSGSGAVGGIFTPMLFAGAAGGALAGQLLNLVLPGWLPAGGAVLVGMAAFLAATAQAPLLAVLMMMELTAAWHMLLPVTLAALVAARLGRRLGGRALYQDEGGLRRR

SEQ ID NO: 4925 - protein, 175 aa, Chromobacterium substugae
MQIREANLEDLAAILDIYNEVIATTTAVYNDDPLTPGEFAVWFQDRAAAGYPVLLAEDDAGRALGFSSFGDFRARPGYRFTVEHSVHLTADARGKGIGTALVQALLPRARALGKHTILGAVDADNEGSIRFHEKLGFVQVGRLPQVGFKFGRWLDLVYLQRFIDDDASSGPASGA

SEQ ID NO: 4926 - protein, 290 aa, Chromobacterium substugae
MENRKLAVLIDADNAQSALIAELLAEVAKYGTAVVKRAYGDWTTTQLKGWKEVLHQYAISPIQQFAYTKGKNSTDSALIIDAMDLLYTGNFDGFCLVSSDSDFTRLATRLREAGLMVIGLGEQSKTPRPFIAACDKFVFTEILRPPAPAKAKPEAPADKPKTRASRSRAKPAPAKERHPLQDMFTSAIEAVSRDSGWAELSAVGSYLAKNDPSFDPRNWGHSRLSQMVKKLDFLSVQENRNGSKLHSEIRLRHDSEPALQEAPPAEAAVEESAAPARKKRSPRKKPAVSG

SEQ ID NO: 4927 - protein, 272 aa, Chromobacterium substugae
MRLPHACHLLLLLCPAWAAADVQTVTILTDNGYPPYSYEAAGQAQGIYNDILRAASSQLRGFQIELKPVPWKRGLAELENGKALALSPPYYRPRERPYMQPYSVPMLSEQVVAYCRAAVAQPPRKRWPDDYRGLRFGNNAGFRPGGDAFWGMVGQGQIALEEAADVRTNLLKVIRGHLDCYLNDKLAIQLELARLQQQGLYAPGALLLTANVSEEQGYVGFTDRDQGRFPYKQEFLRQLNQALSDMKRSGQIDRIISRALDAARAQSAPPSF

SEQ ID NO: 4928 - protein, 73 aa, Chromobacterium substugae
MQPQATASGKTGEMVMFNYRRPVRARQVELQGGSRLWLVEMLDRQSQVWVWQDEWPGADAALERARRLSLMLD

SEQ ID NO: 4929 - protein, 180 aa, Chromobacterium substugae
MFASRSLKASLAALLLTLPLLAHADAAQDAGAKELAATLNINNMLPDLAQRTTASALPLLQEYLVKNKIQLTEAQQKKAQAGLKGYGDNIHKLATDYFGSAAVKAQFEQTVAKNFSAQFSADELKQINAFYKTPAGQKMLKQQPQVINSIAGDTLKSAEKALLPKMQAAAEAYGKTLTKK

SEQ ID NO: 4930 - protein, 315 aa, Chromobacterium substugae
MPAARSTLLCGLLLLCGPSCQAAALARIGISVGALDNPFYQALARGAVQAAHGLNAAVRVTSMSANFTLEQQQRQMRLLIQQKVDLILLGAVDSQAIAPQVRQARAAGITVVAVDVDAPGVDGTVKSDNRQAGEITCRYLAQRLQGKGTLLIQGGPPVTSVSDRIAGCHAALAAYPGIAVDNDRANAMGSSLGGQRAMQRDLQRLPRIDAVFTINDRQALGAEKALRAAGRQQVLIGSVDGSPDIERALRLPGQIVASASQSPYLIGREAVLLGLRLRQGDAGKRLVTVPVGLVTRANLAGYQGWQSRRMPPAPR

SEQ ID NO: 4931 - protein, 198 aa, Chromobacterium substugae
MLATLQPFDLIIQPGWNNSGPRHWQSHWQRRLGARRVDNADWAQPQLEDWLDGLDAALSRCRRPPLVIAHSLGCVTVAHYAQRHPGRIAGALLVAPADVERPFVPAELMNFAPLPRRPLPFPARIVASSNDPFCKTARAARLAGYWQAPITWLQHAGHINVDSGHQQWEEGWPLLRQLAERALSRLESDTAAPEAAMV

SEQ ID NO: 4932 - protein, 165 aa, Chromobacterium substugae
MPALKYLLNYPPALVQQAQALLDSGQLGAWLQRKYPDANEVQTDKALYQFVAAIKQRYLKNAPLPAKVLYDNRQHPLKGTLGTNTLVSRVQGGKLKSKSEIRIAALFRELPLPFLQMIAVHELAHLKERDHDRAFYQLCCHMLPDYHQLEFDLRLWLNWREREAG

SEQ ID NO: 4933 - protein, 178 aa, Chromobacterium substugae
MALTATIYKASLTLSDMDRGYYASHQLTLAQHPSETLERMMLRVAAFALNASETLSFTRGLSADDEPELWQKNYSDEIELWVELGEPDEKRLKKACSRADKVVLYTYGGRASEVWWSQIENKLSRLDKLEVFRIDFDALQTLAGLAQRSMQLNVTIQDGQMWLADEQHTVLLEPQRLK

SEQ ID NO: 4934 - protein, 230 aa, Chromobacterium substugae
MPIASHRLIGLLLLLPALALAGKNDRPHAAGSGHAAADAVKPAEENSDAPPPVATDFHCDKPANMVESMVCQDDGLTRLDNRLEKVYAQAMGQAEQSRNGAQAKLVGEQKRWVKSLKDCLKNEDPHMCLGDTYILRISQLQAAWGLAPSLTPLRYLCRGQPSSTILATFYRTHPATAKLERGNTLVIVHQGLSGSGARYVGQGVEFWIKGRDASVNWRSESLECTSQPTP

SEQ ID NO: 4935 - protein, 468 aa, Chromobacterium substugae
MSDLTFADLGLADPLLRAVADTGYTTPTPIQAQAIPQVLQGGDLLAAAQTGTGKTAGFTLPLLQLLMRSPSHHAGRPRALVLTPTRELAAQVEESVRTYSKYLPLKSLVMFGGVNINPQIKALRSPVDILVATPGRLLDHVGQKTVDLSGVEILVLDEADRMLDMGFIHDIKKVLAKLPAKRQNLLFSATFSDEIKALADKLLDNPKLVEVARRNTTNELVTQKVHLVDRDKKTELLIHLIREHNWFQVLVFTRTKHGANRLAEKLDKIGITAAAIHGNKSQNARTRALADFKSGELQVLVATDIAARGLDIDQLPHVVNFELPNVPEDYVHRIGRTGRAGTPGEALSLVCVDEFSFLRDIEKLIKMSIERFTVPGFEADLNVKPEPIPMGGGARGRGQGQGQGRGGQGRSQQPRNPASKPRHQTESKPAGHGHRGGGQGQSQARQDGARSPKSSAPRAALFSPPKSR

SEQ ID NO: 4936 - protein, 263 aa, Chromobacterium substugae
MRYHGYLLGILSWAVLLAAPVEAAPRLKITLSNQEWPPYMGQELPYDGILSRLVKEAFARGGVDVTYRYYPNNRTLQSARNGQVDGSFGWAPTPDRKRDLLYTQPVLSARMVFFQRKERRLEWNRWADLRGVRVGVTVGNFYSDDFDAQAKSGLLTVDSAPDDLINLRKLLAGRIDLFPIDLEVGKYLIAHHFPPQQGALLEAQAKSFWSAPLHVVIWRKHARGKELVERFNRGLKALQDSGEFERLVTETREACLLPRTVSP

SEQ ID NO: 4937 - protein, 187 aa, Chromobacterium substugae
MRYPGSHKLQTRRRIIAIASLRFRAEGLAHVGIANLMADLGLTHGGFYAHFSGKDALIAAACCEAQEQMNRHWRQQLAEAADGACLAALAEQYLSPAHRDFPDSGCVAAALAGELARQGPAVRRRFTDGLLPMLETLEEARRRDGAGPPPLASLALMVGALLLARAVSDDELSQRMLDEARAALAGG

SEQ ID NO: 4938 - protein, 634 aa, Chromobacterium substugae
MPPSNASMRNLGDAALRQGGAALAYAVFALALARLLPPGPPAAWLQPGLPLALALLSRLGNRVWPALALAGLWLAWDGAGRMADVLLQAASGLGAALLGAGLLRRRPPHLQLADVPAGLPAAAALACLLAALGQVFALLPEYGRRLPELALTGVQIWLGDMALVLTLTPILLLLGRPGPACGAARWRESAAVALATLALAALVCCLLDGGGGRYAMLPYLFIMPLLWLAFRGRPLLAHLLALGVASAALLGVRLGHGALASDGGGYPLLNAALLALAQSATLLVFGALLEERRQVERRLLLANQSLEAKVRERTSQLAESEARLRLMADAAPFPLAMNRLSGGQLIYANTRAEELFGARLLPERSLRVQDFYADPAERERVSRDLRAAGQVLDREVKLKDADGREFWALISCSAVKSDKIWYVINGVNDISERKRLEQSLHDANAALRRHVGEIEVLQQGLREQALRDPLTGLFNRRHLDEILPRVLAHMLALHRDVAVLMVDADHFKRINDSYGHRCGDMVLTALAAYLSDHFRCGDIVCRYGGEEFFVLLPGASLEAAHAKAQGLCDAVRAMPIRAQEHVLSITLSVGLALSPMHGEDAESVVHAADAALYQAKQMGRDRVCVAATLQPLPS

SEQ ID NO: 4939 - protein, 327 aa, Chromobacterium substugae
MSYPKYALHSLGWVRYQRRRILRAALFSALLFAPAAGLTLAGHGGGVFLFALAANYSALCMMMARRLQPLSLLAIPGLYLAGRLCAGQPAAMLALLAAGLALQALSARRGLHKGVQFWLFALLLGNMTPTAALPPWQEAAWMLAGAGYGGALARLGLRDWFRVLPAASSADCRRYGWHLLPWGILAWLAGGWMRSAHAWWLPIAAVAIPDPSPDQMLWLARERAIGTLAGALLSGLLYWSLRALDAAPLWHVLALALLQMAMLIAMRHSFRVFVALLTALVLSLLPPEQLASGALERVEDTLLAALLFAALAWFLRQRRRDAQDGKG

SEQ ID NO: 4940 - protein, 228 aa, Chromobacterium substugae
MQQQGFGGRKECRQLIDYGLVEVNGEVVDNYRAQFELADISSLTVDDEPWPVVRGPLYLLLHKPANYETSHKPNCHPSIYRLLPDQFSNLDISAVGRLDVDTTGLILLSNDGQFIHALSSPKKLVPKVYRVTLKHEATPELIAQLQSGVYLNDEAREFAADSVAQIDAHTILLTITEGKYHQVKRMVAAASNRVEALHRESLGAIVLGDLPAGEWRHLTAEELAAFGF

SEQ ID NO: 4941 - protein, 268 aa, Chromobacterium substugae
MRRTILLVYAQPEPRSLTRGFAAAAVETLTAQGHQALQSDLYAMRWKAVLDADDFPARADPGRLSFIDESGHAYANGAQTPDVAEEQRKLLAADAVIFIFPLWWYGVPAILKGWFERVYAYGFGYGYQNQANRLRYGDGALKGKRALLAAMVGGGERDYGPRGINGPLQELLFPVTHGCLFYPGMDVLPTHAVYGVNHLSAADLRQQLDAWRTRLAGLFDEAPIPFRRQNGGDYPDGHQLADHIAPDKEGICAHVAAPGPAMTGAAAQ

SEQ ID NO: 4942 - protein, 303 aa, Chromobacterium substugae
MDTKRLDLNLLHTLEALLEERNVTRAATRLHLSQPAVSAQLARLRELFGDPLLLPTQRGMRPTAKAEQLLAPLQASLQQLRENLLAHQAFDPAAASMTLQLACTDYAQAVAAIPLIQRLRLRAPGIRVALRHLEASRLQRQAESGEVDLALISPDGAPPGLHAKPLFEDRYVLIGRPGHPAWRQGLSLESYLQHQHVVVSLGSGDFSTAVDAALAEQALARRVALSAASFLLVPEIVFQTDYLALLPARLVAVSRVPLQTEACPFPLSGFGVAMVWHPRNHSHPGQRWIRQQFAELMAESAAA

SEQ ID NO: 4943 - protein, 620 aa, Chromobacterium substugae
MNAVRSLPLDEIRRRFFTGQPLPGQALPPPILHSWQRCRSLGLPAGGGGGDKLSPMELNERQQANQDWLAPAAPALAGLYEQVASQQLALVVADSHGLILDQSGHIDFLNKAERLALTPGMDWSEAARGTNAIGTALAAMDSVLVRGGEHYLERNRVLACAAAPLLGPQGQLLGALDISGASRKLGPPQILALHAARGQIEARLLEDAARHGWLLCLHADPRLLDAPSACKLVFDGDGRLLAANRPGLALCGLEAGGWQARHFAALFGQSLEHWLQRHGQAIGALRIGAQRFSARLKPPAPAQSAASASRSPRSAPLAKAAPAAAIAPLDGAPPELFAAARKLLEADIPVLILGETGTGKDRLARALHGAGSRRGQPFVAVNCAAIPEGLIEAELFGYLPGAYTGANRQGSKGRLREADGGVLFLDEIGDMPLALQARLLRVLQEREVTPLGGGPAQQLDIRLICATHRDLRAKVDEGAFRADLYYRLCHYPLSLPPLRERGDVAAIAQRMLDEMGAARRGIALAPELARAFRGYRWPGNLRELANLLATLLALADDGAQLEIRHLPALLRADMASQGHAVPDSAIADLLRRCGGNASAAARALGISRATLYRRLGKTAK

SEQ ID NO: 4944 - protein, 501 aa, Chromobacterium substugae
MASLQPGFQLKTRYANFIGGQWVPPVNGRYFENVTPITGKTLCEIPRSDEQDVELALDAAHAARFKWGHTPVTERAIVLNKIADRMEANLNLLAEVETWDNGKPIRETRAADIPLAIDHFRYFAACVRAQEGSLGEIDANTVSYHFHEPLGVVGQIIPWNFPILMAAWKLAPALAAGNCVVLKPAEQTPLSILVLMELVGDLLPPGVLNVVNGFGVEAGKPLASSKRIAKIAFTGETGTGRLIMQYASQNLIPVTLELGGKSPNIFFDDVAAQDDAFFDKAIEGFVMFALNQGEVCTCPSRALIHESIYDRFMEKALKRVAAIQQGNPLDPATMIGAQASQEQMDKIQSYLAIGRDEGAKVLAGGARAQLAGELAGGFYIQPTVFAGNNKMRIFQEEIFGPVVSVTTFKDRDEALAIANDTLYGLGAGVWSRNINTAFFMGRHIEAGRVWTNCYHAYPAHAAFGGYKQSGIGRETHKMMLDHYQQTKNLLVSYGEDKLGFF

SEQ ID NO: 4945 - protein, 217 aa, Chromobacterium substugae
MQSDREMSIHGAEEGDAAYEQPERALELVWLRRYLPQQFAGRQVLEWACGSGYWTQYLAPRARRYLALDEAAAALALARQRPGVERVEFRLAQDCALPAGAGGFDAAFAAQCFSRLPKQRRDDWLAGLHGGLQAGAEVLWLDDSEAQCREYPLVEYDAAGNGYQMRPGPDGGELRLLKNFPSETELRILLGRHGVSDMALLRREHFWLLQYRLPKRH

SEQ ID NO: 4946 - protein, 473 aa, Chromobacterium substugae
MSSPRKASPFLRSHLAWVLAGFNALVVLSIVDDYLLPAGAQAAVSVLLLIATIALSCWLWQKGSRIFLLLNALTRQLGLACSGELHHRSTGTREMGEVGQVAWQLNDFLDLVETYFKEINTCFQEISQGNFSRRPLNQGLPGILASSLENVNKTIQTMADNDGFVRRNRLSSQLAALNNPNLRHDLSGSQHDLTAISQAMDAVAGITRDNAAGARESLDSAAELSSHLDTIAGSVNSMDQASQLLAQEWQGIESSLADISAIADQTNLLALNAAIEAARAGETGRGFAVVADEVRKLAERSKSTANQVQNVLESLSTRIADMQAQASDAGGVAGNVQTSVESFRQRFASLAEQSDRVLKQVSEVQQKSQTSLQKVAHVIYKQSAYHAIEEAEAQAPAVELEHWIDGGGASLFGASATQALRQPLAQLQQQVGAALAAASQSGQLDEAGIVARMQAMEQASQKLQQGLDQLSAA

SEQ ID NO: 4947 - protein, 193 aa, Chromobacterium substugae
MVKEKQTMEKTAIGRGAGREVQLAPHELIVTKTDPSGHITYANRVFMRVAGYAEHQLLGKPHNLIRHPDMPRGAYRLMWQTLQAGHEFFALVKNATADGNYYWVLANVTPDYDPQGRLQGYYSVRRPPSRAAIAAIEPIYAEMRKIEASQGKAAAPDASRDWLLALLAEKGCSYQDFILGLNADVLKAKGVTG

SEQ ID NO: 4948 - protein, 639 aa, Chromobacterium substugae
MARLLPHLSTHPARRGAPAKNGFPMRFPVSLLSTTLVLAGPAALAARQPAEEAPLALKASISCRHNADNSLDCTTRNQFTILKPAGKEFLSRIDFTYPDTDKLEVLGGEVRQQDGKVVKLEKSQVETRAAPNPYAGVSRDKQTWLAFPELAVGSVVSYQVRHHIAAPPLSRELLYRLDFDPEPVRYDSYHFELDSPRPLLWRAEAMEGFQTAASADGKRITVDQRGSRYLNLTNEWSNSALRRWPRLSIATSDSPQQHFGVYAERYNAILAAPLPPGAAAVVSQQRGKPAAQQVAAFMQHINSHYRYLNDQRLAERGLVPFTLAEIEQHGYGDCKDLATLLTAMLRRAGIAAEPALVFRGNFAQQPLLPGLGTVNHMIVRAQVDGKTEWLDATNPFFAAGRIMPDLQERATYLMGDDGKVRQDFIPLQAATLSSSVKRVETLKRDSSARIVSQSLLASWPLIEMTMQDRYQGSSGTDQNICRGLGNQTQNCKVARAATGFLIPERYPIQISGDDTRALEKISGLYLYDPRLESRWNDFDNYRANGNQADVYLGDPEIMERSLELKGAKAIQPPFSCQARSPWFDLDLKQTADASGVRYQYRLSSKVRWLSHDDIVSPEFAALSRQARACATQVRQILKL

SEQ ID NO: 4949 - protein, 136 aa, Chromobacterium substugae
MAFGSFNQGPAAPMAEPNTTPLVDVMLVLLVVFIITTPLLTNAVKVDLPRAQAAQHQDKPEQIRLAVDAAGKLFWNDKAVAEADLPARFAAAAAANPEVELHLSADKAVRYETVAKTLAAAQSNGVGKIGFVTAAP

SEQ ID NO: 4950 - protein, 222 aa, Chromobacterium substugae
MTVFHQGDAVLISVFLILILMSALTWYLIIVRGVQTLQARRANRSAESALWSAAGWTQAEHQLAHSRGQVANLTRAGLAALKQYQSQAGRALGQACGVDEFLTRAIRKALAQENARQEAGLTVLASIGSTAPFIGLFGTVWGIYHALVNIGQAGQMSIAAVAGPIGEALIATAAGLAAAIPAVLAYNALTRAQRVMSQELDYFAHDLHAQLLTQSGEQDGVR

SEQ ID NO: 4951 - protein, 125 aa, Chromobacterium substugae
MSAAAYRQAGAALAAAMLMLTNAAAEPSPAGHDQARRKQTSSLSEEAMEAIAAGQAGLAKVRVLISAEGLPQEIALISSSGVPQLDAAALKTVKNWHFTPAKRDGQAIPVIVIVPIEFSLKPGKP

SEQ ID NO: 4952 - protein, 245 aa, Chromobacterium substugae
MRIICIIIDFMKPLPTLQLSAIGAVLGLHALALCLLNGQPGRELPVTPPRLLTSMTMLAPAAAPKAAAPSPAAPQKPQVQAKAAPSKAIPQTRPLPAVKPQKTDTPPPAPAKAIQVAAAAPAASAAPAAEPAKAPGGGKPDGDSRQQQITEPLSTGGYLNNPQPAYPTVSKEEGEEGTVRLRVHVSVQGLPQEVSVQSSSGFPRLDRAALASVKRWRFIPAKRGAEPIAYTYIVPVEFSLKSSRS

SEQ ID NO: 4953 - protein, 438 aa, Chromobacterium substugae
MQTSLRQRLNGLPPGFHLLMLSDVLSGLAMGAGYVSISWWVVSMGGARDMAWFSTLTALVMLVALPLTAPLGDRFPKNRVIAGGILLAMLSGLALAAMAWFHFYRLAWVVASESMAMFAWAIVIPSMLSIAAELVPANRLSDALSMQKSSQSVGNLIGPVIGGSLMAVAPAWMALGSYTLLLAIAAVGALRIRLPARSLADVRAESFIEQIRSGLRVRWRIPLERRWALWGLLVMTAYFPMVVTLLPIKLHQLGLPAFWLGACEAAVSGGLLVGSLWLTHRLLLHCSRPRARAFAMWALGAVFLVVALTDHPLVMLAMFGIEGALLSITMLIGQTHRTLAVPEPYRARVSAINVLVAKLGGMLGPALAGILLARWSLDEVYLFFALFHLLTVPPMLLLPGVNRFLNLSHDEVKDWYLKQHPEAFEPMAPAGGKLEQSA

SEQ ID NO: 4954 - protein, 230 aa, Chromobacterium substugae
MSVRGRPRSFDREQALRSAMRVFWAKGYDATQLAELTKVMNIKPPSFYAAFRSKEAIFREAVELYLHSEGSASMRALASAATTAEAIHGMLLASVDTVLASPGANGCLLILGLVNCEPDNVALQDYLRQIRQHTIQLIQSRLEDGVGKGELPADADCKQLANFYFTVIQGISLQARDGADRASLIKVGHRQTPHTEPQLDELGFLRFGRRPWGGAVSALPSPPRSPAACH

SEQ ID NO: 4955 - protein, 373 aa, Chromobacterium substugae; identical to SEQ ID NO: 4903

SEQ ID NO: 4956 - protein, 476 aa, Chromobacterium substugae; identical to SEQ ID NO: 4904

SEQ ID NO: 4957 - protein, 398 aa, Chromobacterium substugae; identical to SEQ ID NO: 4905

SEQ ID NO: 4958 - protein, 172 aa, Chromobacterium substugae; identical to SEQ ID NO: 4906

SEQ ID NO: 4959 - protein, 391 aa, Chromobacterium substugae; identical to SEQ ID NO: 4907

SEQ ID NO: 4960 - protein, 252 aa, Chromobacterium substugae; identical to SEQ ID NO: 4908

SEQ ID NO: 4961 - protein, 162 aa, Chromobacterium substugae; identical to SEQ ID NO: 4909

SEQ ID NO: 4962 - protein, 378 aa, Chromobacterium substugae; identical to SEQ ID NO: 4910

SEQ ID NO: 4963 - protein, 389 aa, Chromobacterium substugae; identical to SEQ ID NO: 4911

SEQ ID NO: 4964 - protein, 1047 aa, Chromobacterium substugae
MFSSFLIRRPIFACVLSLIIMLAGVAAMGVLPVEQYPQIVPPQVQVVASYPGASAEVIANTVAAPLEQAINGVDDMLYVQSISASNGQLTLNATFKIGTSPDQATINVNNRVQSALAQLPEEVRRQGVSVRKQSAAFLQVIALYAEKGRYDTLYMSNYALLNVVDELKRIPGVGDVINFAGRDYSMRIWLKPDRLAQLKLTPSDVVAAIREQNAQFAAGKLGAEPSNQALDFTYTVTTRGRMSTPEEFSNIIVRANPDGSAVLLKEVAKVELGALNYDFNGKINGDPMAPIGIFLAPGANQLETAKAVKDTMARLSGRFPDGLKYRIPFDSTKFVEVSIEEVYKTLAEAMALVFLVVFLFLQNWRATLIPCLAVPVSIVGTFAGMYAFGFSINLLTLFGMVLAIGIVVDDAIVVLENVERIMSEAKVSATEATLQAMKEVSGPVVAIVLVLCSVFVPVAFLGGIAGQMYKQFAITIAISVSISGLVALTLTPALCALILRPGHQSRNRFFDWFNRNFDAVGGRYVRGVAFLSRRSALGLALFGLLLLVSAWLFRAIPTSLAPDEDQGYVIAAAFLPDGASLQRTAKVMDKLDHLVSRNPAVKDMLSMSGFDIVTGGKKTNAGVSFIQLQPWEERRGAAQSAQAVVGDIFAKTGAGIRDGFIFAVNPPPISGMSNTGGFEGYLQNRNGASPAELEGVSRQFLAAAAKRPELAGVQTTYSASVPQVYIELNRAKAKALGVPINTVFDTLQSTLGELYVNDFNKFGRTFRVQLQSEASYRSHSDNLAKVFVRSTSGAMVPVTALLDIQRSTGPEVLERYNLYPSAKLIGGPAPGYSSGEALAAMEQVAKETLPDGYALAWTGSALQEKAAGGSSAKVFLFGIVVVFLILAAQYERWTLPLAVLLAVPFAVFGALVANWTRGLANDIYFQVALVTLIGLSAKNAILIVEFAMLKLDEGMELVQATMQAARMRFRPIVMTSLAFVLGCVPLAVSSGAGSASRHSIGTGVIGGMLAATFIATFFIPLFFILIMKAFHKKAPAAAAAEEEVLNV

SEQ ID NO: 4965 - protein, 462 aa, Chromobacterium substugae
MFKPLFLAAALSAALAACAAGPDYQRPQLALPDGQAQAAADVAGWWRQFQEPELDRLIAVALARNQDLSEADARLAQAEALAGIARSQLLPRLDAAADSQRQRVSATLPATAPGGLYDSRDFNLRASWELDLWGRLRREREAAVSLAAASQASRDGLRLAVAAQVAQTYFQLRAYDAQLEVSRRTLANRRAAATLNEKRFRQGDASELDWRQAEAEVAVAEASAAQFERSVAQTETALGVLLGREPRQLLGEGIARGQALDALSLPPALPSGLPSDLLARRPDIAASEAGLVAANARIGVAKAAYFPSISLTGALGSASPDLRQLFSGPAYVWSFAGNLAAPVFNFGQTAGAVDVASAGQQQALAQYRKAVQLAFKDAADALSAMAAARRVNDAETARVKALQRAVRLATLRYDSGHSAYLEVLDAERGAFQSELSAVDARLDLFNSAVALYKALGGGWRAS

SEQ ID NO: 4966 - protein, 384 aa, Chromobacterium substugae
MQTRHSLLLCALVAGVAACNKPAGQTSSNDKAAEDKIVVKIGTANPLTGPFAHWGRDADDGVKLAVQEANAEKLVLDGKPASFEVVSEDDQADPKVATQVAQRMVDAKVAGIVGHLTSGAAIPASRIYSDAGIPMISGSVTSPSFTQQGYRNTFRLIANDQQQGEALAKYAVGKLGAKRVAVIDDRTTYGQGLADDFAKAVEQAGGKVVKREFTTNSATDFMAVLTSIKGEKPDLLFYGGMDAQAGPMVKQMGKLGIKAAFMGADGVNTPEFAKLGGGSAEGAYASSAGLPKEKLPGYADFNQKFKQQFQTEIQAYAPYNYDAAKVLIAAMKRAGSADPAKYLPEVAKTDYQGVTGPVKFDAKGDIQQATVSLYQLKQGKWVGL

SEQ ID NO: 4967 - protein, 467 aa, Chromobacterium substugae
MLKRALIPVAVALAVSACAVGPDYSRPKVELPAAQAGAQAPALDADWWQRFDDPALNQLIEEAVKSNLDLQAAAARVEQAAAQAGIARAALLPSLGANAGYQSGRTSALTTSPGTPLVNDVRAANLTAAWELDLWGKLRRSNEAARAGYIASRYDRDAAQLALTAQVAQTYFQLRALDAQLDIAKRTLQSREESLKLQTKRFHGGLISELDQRQAEAEAAAARASVPQIARSLEQTETALGVLLGHSPKQLASGDLTRGKDINSLASPPDVPADLPASLLERRPDVASSEQQLIAANARIGVAKAAYFPSINLTGALGSQSLSLDGLFTGPARTWGFAANLAAPIFNFGATGYGVDAASAGQKQALAQYQKSVQSAFKDALDSLAANSAARDIVQAQTTQLAALNRTLKLAGLRYDNGYSSYLDVLDAQRNSFQAELNLVSAKLDRLNTTIGVYKALGGGWQAPKPQ

SEQ ID NO: 4968 - protein, 1046 aa, Chromobacterium substugae
MFSAFFIRRPIFASVISIVIMLAGLAAIKALPIQQYPEIVPPVVNVTASYPGASAEVIANTVAAPLEQAINGVDDMLYVQSNSASNGTLSLTVSFKIGTNPDQATINVNNRVQSVLSQLPEEVRRQGVNVRKKSATILQVVSLFSPDNSHDTLFISNYALLNVVDELKRVQGVGDVVNFAGQDYSMRIWLKPDKLAQLKLTPSDVAAAIREQNSQFAAGKLGAEPTPQKLDFTYTVTTKGRLSEPEEFENIIVRANPDGSAVKLKDVARVELGALSYDFHGKHNGKATIPIGIFLAPGANQLATAQAVETEMLRLSKSFPTGLSYGIPYDTTKFVEVSIEEVYKTLAEAMVLVFLVVFLFLQNWRATLIPCLAVPVSIVGAFAGMYAFGFTINTLTLFGLVLAIGIVVDDAIVVLENVERLMTQEGLSPREASLKAMQEVSGALVAIVLVLCSVFIPVAFLGGIAGQMYKQFAMTIAVSVVISGIVALTLTPALCALILKAEHQHPNRFFTWFNNWFDRLTSRYTNGVAFINKRAMLAVLLFGGLIAASAGLFRIIPSSLAPDEDQGYILAAAFLPDGASLTRTAASMDKLDAMMAKNPAVQDRMTFAGFDILSGGNKTNAGVSFIVLKPWDQRKDPQLSAQAVVKDVFGKGMMGISDGIVLAFNPPPISGMSNTGGFEAYVQDRAGGTPTALGEVTKKMVAAAAKRPELKGVQTTFSASVPQVFVQLDRDKAKALGVPINSVFDTMQSTFGALYVNDFNKFGRTFRVQLQSEAPFRTKVDDLRNVYVRSQTGQMIPLTALVNIQQTTGPETLERFNVFPAAKLVGGPAPGYSSGQALTALEEVAKETLPAGYSLAWTGSAFQEKSTSGSSALVFGFGMIMVFLILAAQYERWSLPISVLMAVPFAVFGALMANWLRGLANDVYFQVALVTLIGLSAKNAILIVEFAVQKMEEGMEAMEAALEAARLRFRPIVMTSLAFVLGCVPLAISSGAGSASRHSIGTGVIGGMLAATFIATFFIPLFFILIMKFGKKKPQPAVEAGENSDA

SEQ ID NO: 4969 - protein, 393 aa, Chromobacterium substugae
MQGTATLPRAARGLLLGALAASLAACGQKPDAKAGAMPPVPVAVIKVEPADVPVSYEFVGQAAGSREVEVRARVGGILQKRAYAEGKPVKAGDLLFQIDPEPFKAALDQAKGNLQVQQAQLLRTKQDYDRVMPLFKENAVSQKDRDDAVAAFNAAKAQVASAQAQLEQAQINLGYTRVTAPISGITSQEARSEGSLVATSADASLLTKISQLDPIYVNFSMSDGDMLALRKMQHAGKLKLANGGGFEVQLKLPDGSVYGKTGHLNFTDSLVDTNTGTIRSRASFANPQGGILPGQFVRVQLNGAVRTAAITVPQRAVLTTQQGKMVWVVGPEGKAQPRPITVSQEVGLSVLVEQGLKAGDQVVVDNIIKLRPGADVKPHPFQADASAPAAAAQ

SEQ ID NO: 4970 - protein, 213 aa, Chromobacterium substugae
MARKTREEAEQTRQLLLDAAERLFSEQGVSRTSLAEIATAAGLTRGAVYWHFQNKLDLYRAMLDRVSPSFDDMREQLLRTADTDPARALWEHSHRLLALIEHNPQVRRILLILFLRSEHVGELEPIHEECVAHMHEARGLLSHVVQVAKDRGQAYACVEPEEAATVVQALHDGLMHKLVIEQPGPDAMLAASRLLQYLYRGIFTPEIMEQLTT

SEQ ID NO: 4971 - protein, 300 aa, Chromobacterium substugae
MSHAIEIEAVSKRYGQLQALDKVSFTVEPGEFFALLGPNGAGKTTLISALAGLARPDSGRIRVMGHDVVRDFKQARRALGVVPQELVFDPFLSVRETLRFQSGYFGLSRNDAWIDELLFKLGLADKADSNMRALSGGMKRRVMVAQALVHRPPVIVLDEPTAGVDVELRQSLWVFVQELNRAGHAIVLTTHYLEEAETLCSRIAMLKKGKLLALESKDKLLAHSARREVAVKLSGALPDSLLPRKLRDEDGRVVLQLAELAELETVLATLRQAGVDVRELNVVEADLESVFVKMMNGSAA

SEQ ID NO: 4972 - protein, 251 aa, Chromobacterium substugae
MIGFLTLFKKELVRFWKVSFQTVAAPVLTALMYQLIFAHVLSKHVEAYPGVGYTAFLIPGLAMMSMAQNAFANSSSSLIQSKITGNIVFLMLPPLTAPEFFLAYLLASVVRGLAVGAGVLLVTAWFGLPLPAQPLWAVLFAVLGCGVLGTLGVIAGIWAEKFDQLAAFQNFLIMPLTFLSGVFYSINSLPSFWYAVSHANPVFYMIDGFRYGFFGQADVSPWLSAGVVGGSFAALVSLALWLIHSGYKLRH

SEQ ID NO: 4973 - protein, 81 aa, Chromobacterium substugae
MTEQQVKQYIEAGLECTYLKVEGDGHHFYATVVSAAFEGKRLIDRHRMVKEVIAARLASNEIHALSIVKAATPDEWAKLQA

SEQ ID NO: 4974 - protein, 417 aa, Chromobacterium substugae
MDKLKIIGNGPLNGEIRVSGAKNAALPILCASLLTGDTMRFTNVPMLRDIATTQKLLQGMGVRVMTDNVHEMEITAGQLDSLVAPYDLVKTMRASILVLGPTLARFGEATVSLPGGCAIGSRPVDQHIKGLVAMGAEVSIEHGYVKARAKRLRGARVVMDMVTVGGTENLLMAATLAEGTTVLENAAREPEVTDLAHCLVAMGAKISGIGTDRLVIEGVERLHGADYSVMPDRIEAGTFLVAGAMTRGHVVLKNAAPKSMEAVLDKLQETGALIECGDDWISLDMKQRPKAVNFRTLPYPAFPTDMQAQLMTLNCVAEGAGVVTETIFENRFMHVPELNRMGANIEVEGNTAIVKGVDKLSGATVMATDLRASASLVIAGLVAEGETIVDRIYHLDRGYEHIEKKLGAVGALIERIS

SEQ ID NO: 4975 - protein, 112 aa, Chromobacterium substugae
MSQLPACPQCGSEYTYQDGAMFVCPECAHEWNEQSAAPAEEQRVVRDAVGNTLQDGDSVTVIKDLKVKGSSLVVKVGTKVKNIRLVDGDHDIDCKIDGIGAMGLKSEFVKKA

SEQ ID NO: 4976 - protein, 269 aa, Chromobacterium substugae
MRRILPLVAILLLAGCASAPATPYDPYEPYNRTMFKVNDTADQWVLRPLAQGYQKVVPSPVRTGVGNFFDNLKDVYSFAFNVLRAEPEKAANDFMRVAINSSFGLFGLIDIADQAGLKNNKTTLGDTLATWGWKSSNYFVLPFFGPSTVRDSAGLGASLAGPGPERLVYHNSREAIAFYGVYGVSTRAKYLGVDGLLDTAAVDRYSYTRDVYMQLRAKQLGQPDPTQPADNLNLDELMDSPGPGGKSDSSAPAAHAVESSAPAAASAAQ

SEQ ID NO: 4977 - protein, 95 aa, Chromobacterium substugae
MLKTTAPGEASLSGRIDMAASAGLARALAELAARGPLRLDLSGIEAADSSALALLLQARRAAAAAGHALTFAGMPAGLATLAGLYDLGPLLSAGE

SEQ ID NO: 4978 - protein, 211 aa, Chromobacterium substugae
MKKLFTLFCLIVGLSSTQAIAAADSPVEIIKDGSRQVLDILKQDNGKNTKQVRQQAEAAAVPLFDFPRMTALAVGLGWRQATPEQRTQLTQQFQTLLVRTYSTTMTRFKAAQVDVKANPALSANGRDTTVKTSVTLPGNANPVSVDYVMYKGDKGWKIYNVSVEGASLVTVYRNSFNEEIQKTGVNGLIKLLQDKNATPAAAAAAAGKGKP

SEQ ID NO: 4979 - protein, 155 aa, Chromobacterium substugae
MKRSTIDLWVGIFVALGIAAVAFLSLKVANLTPQSASQTYVVYADFDNVGGLKVKAPVKEAGVLVGRVADIRLDPKTYRARVALNIDKTYQLSDDVSASILTSGLLGEQYIGLQQGGSETTLAAGGTITITSSAMVLEQLIGKFMTGFSGKDASK

SEQ ID NO: 4980 - protein, 261 aa, Chromobacterium substugae
MLDFLTSPLRRLGHATINAVWRLGFAARFLAAILLNSGQSLLRLQLTIREIYFAGVMSLIIIVVSGLFVGMVLGLQGYTTLAKFGSADALGAMVALALLRELGPVLAALLFASRAGSAMTAEIGLMKTTEQLDAMSVMAVNPMARVIAPRFWAGVISMPILAALFNVVGVFGGYLVGVVMIGLDAGTFWSQMQGNVDLHYDVINGLIKSLCFGVAITLIAVFEGYDATPTAAGVSAATTRTVVTSALVILALDFVLTAFMF

SEQ ID NO: 4981 - protein, 272 aa, Chromobacterium substugae
MSSDHFIEFRNVSFAYGDRPILKDLTLGVPRGKLVAIMGGSGSGKTTLLRLISGQIRPQAGEVLIDGRDIARMSQAELYQHRRRMGMLFQFGALFTDLSVADNVAFPLREHTKLPENMIRDLVTMKLEAVGLRGTQKLMPAELSGGMARRVALARAIALDPQLMLYDEPFTGLDPISLGVIALLIKKLNDALGTTAVMVTHDVHQSLAIVDHVLFVANGQIIAQGSPDEVRNSDSPWVTQFINGEADGPVHYNYPAASSLAADLGLQGGAHA

SEQ ID NO: 4982 - protein, 286 aa, Chromobacterium substugae
MTTSIHIAKGLNQMHPIQSLIEQAFENRAEITPATVSAELKAAIDQVIAELDSGRLRVAEKQGADWVVNQWVKKAVLLSFRIRDNAVQDDGVSRYFDKVDTKFCDWNQARFQEAGFRVVPGAVARKGSFIAKNTVLMPSYVNIGAYVDEGAMVDTWATVGSCAQIGKNVHLSGGVGIGGVLEPLQANPTIIEDNCFIGARSEIVEGVIVGEGSVISMGVYIGQSTKIYDRETGEVMYGRVPPGSVVVSGNLPSKDGSHSLYCAVIVKKVDAQTRSKTSINELLRGV

SEQ ID NO: 4983 - protein, 401 aa, Chromobacterium substugae
MNPRLAQLHPYPFQRLAALLADCRPPAELPHVSLAMGEPKHPAPQLVKDALCANLSGLSGYPATQGSPALRQACADWAGRRYGVALDPVRQVLPVNGSREALFSLTQCLIDADGGAKPVVVSPNPFYQIYEGAALLAGAEPHYLNCEARNRFQPDWDSVPDEIWRRAQLLIVCSPGNPTGAVMGLADWQKLFALSDRYGFVIASDECYSEIYFDAPPLGGLSAARLSGRSLERLVMLTSLSKRSNVPGMRSGFVAGDAAILEKFLLYRTYHGSAMSLTVQAASQAAWNDEAHVESNRAAYAAKFAAVLPLLSPVLEVEMPEAGFYLWAKVPGGDDAAFALALFQQQHVTVLPGSFLARDAHGANPGRGYIRIALVAGQDECVAAAQRIVEFCRTQSAALTA

SEQ ID NO: 4984 - protein, 307 aa, Chromobacterium substugae
MTPVKQKFLATSGILTTALVWALMWYPFRSLKASGVSVPMASLATYLITIAVGVTVFFKVYRREFRLEPPLLLLMLVFGWCNFSYTMAVAEGKVMRVLLLFYLSPLWTALLSRLLLHERLTRSGWMVVALSLLGCFVFIYRPGLLAGELPLTHSYEWLALSGGLAFAFGNVVSRKLHTIPVAVKSATIWFGVALIGAVSLLRSGELHRMLEIPAESWLILAILGVVLLCTSVISQHGLSILPATQAMTLMLMELVFAAVSAYLLAGEAMSMQEWLGGALIAGASLLSGDMTHPAPHPHHHPPSQPAA

SEQ ID NO: 4985 - protein, 164 aa, Chromobacterium substugae
MTPADFSAFWPIFRDIVAAQETYAFDPAMGEAAARALWCEAPLETWLAEEDGAVLGSYFLKANAAGPGGHVGNCGYMVSPAARGKGVARAMCEHSQRRARERGFLALQFNSVVASNAAAVALWSKLGFETVGRLPRAYRHAVHGLVDCLVMYKWLGEAEPSRPA

SEQ ID NO: 4986 - protein, 230 aa, Chromobacterium substugae
MLWKKLAVPAAVLLAALLTGCATPTKMAMSENPAAKPSQDKAVYLMTATIKNAYKPSFQPDLLVTHFEKNGGATSADRINFVMDELAKNKNDAAKDGHSYLLRFELDKGKYNLRGMTAMANAFIVIGNFFIPLHQELNANEPGLYYLGHVQADVRERQGNEFRAGPPIPLIDQAATGASGGTFDVAIQDAWETDEAKFRKRFPGLADQTIHKAILPPFDRAAAQKWWEDH

SEQ ID NO: 4987 - protein, 168 aa, Chromobacterium substugae
MAHPIAVNVPAKQEIEAVDGVVKQLKEYQSKNWAIGLNGDNLAPDSFLAFFTERQLPFSYYVRAQGVSVGEPAAYQINTDTLNHYVGLIRSSEGIAVHGVIEQLNRYKANNWAIGLNGTTLQPDDFLPFFDTRGVAFAYYVRSGGVELGAPSAYDANIKALQQYLQQL

SEQ ID NO: 4988 - protein, 64 aa, Chromobacterium substugae
MAGLRIRSTDGIHDHPFRQDAIRWRGGLPWCPLRGWLDMYRQMGREERARQIERLLADPAARLI

SEQ ID NO: 4989 - protein, 70 aa, Chromobacterium substugae
MDTDIDTRLAELEVKLAFQDELLDALNATVARQQKEMELLQQQMRLLYQQLRSSQPDNGAGGGHEIPPHY

SEQ ID NO: 4990 - protein, 437 aa, Chromobacterium substugae
MNAVVLAVGAMLTLALLRTHVVISLLLGALIGGLAGGLSLSATLTAFNNGITGGASVALSYALLGAFAVAIAKSGLPHAMAELAVKRLEHSSGHGRLKWTLILLLGCVSVASQNLVPIHIAFIPMLIPPLLYVMARLKLDRRLVACVITFGLVTPYMVFPVGFGDIYLKQILLGNAAKAGMDIRGINVMHAMAIPALGMVAGLLSAVLVSYRKPRQYSLGKIENAERTRARVSPKSLATALAAIVAAFSVQLYTGSMIMGALAGFLLFLATGVVKWKDADGVFNEGMKMMAMVGFTMITSQGFAEVLRATGEIAPLVKAGAALFEGQRPLAALAMLAIGMTVTLGIGSSFSTVPILTAIYVPLCAHLGFSPLATVSIIGTAGALGDAGSPASDSTMGPTSGLNLDGQHDHIRDTVIPTFLHFNLPLMAAGWIAAMVL

SEQ ID NO: 4991 - protein, 98 aa, Chromobacterium substugae
MEALLVGADSLGNIPEVLQHYNIRIARHICGRNVAHQRKAALPGKPDVLILLTDFLGHNVMRHYRDSAAALGIPVLACRRSATAVEQRLRRHGWSRSA

SEQ ID NO: 4992 - protein, 44 aa, Chromobacterium substugae
MIFSGNENWLAWQLKQTAQQALPRVEWLKINRPAPAKPPIPPAR

SEQ ID NO: 4993 - protein, 131 aa, Chromobacterium substugae
MSVFSVEFKVRDYECDMQGIVNNGVYFNYLEHARHEFLLAKGIDFAQLARDKVNLVVVRSEMDYKASLTSGDQFIVTVAFEAVSKVRFGFRQQVIRQADGKVALDGLVIGTAINERGRPAIPEGFAERLTA

SEQ ID NO: 4994 - protein, 235 aa, Chromobacterium substugae
MIAAHLPDISRLASLLADPGRARMLLLLLDGRSYPASELAQHAGLSAQAASNHLAKLLQGGAVKVERHGRHRYYLLANAAIAQALEALSAAAHGHDLAKPAASRVAPTLRLARTCYDHLAGKLGIAVADGMQASGWLALNGERQFEVTAAGRGWFAEALGVAEPASGRRPQARACLDWSERRPHLAGAYGAALCREFLARSWVERRQDSRALRITPAGLAFLREQWGIRPETLAE

SEQ ID NO: 4995 - protein, 208 aa, Chromobacterium substugae
MQALLDYLQSHFLSEPQLLFRCRSAPERLRELQQAGRMPLPSYRLSGSGMASSHFGERRMRGELAWYPRAMMEWLIEAEHADAAALRGRFDQRYRAELRRLASEGIAAESEAPLDEEWAHFLAGVYGACTRQGRIEQIAAKGAAIAVIDRLTDGQRLARVPAADIPLLWRAVDLLDAVSALFAPDEQAASSRARCVDAVKRKYLGEAA

SEQ ID NO: 4996 - protein, 364 aa, Chromobacterium substugae
MSAWPQNVLMAARHPDPYPYYRSLAEKGWHYDEALGIWLAASHRAVGAVLDSPVCRVRPSGQPVPPAIDGSVLGQAFGGWLRMSEGAAHAGLRRAVRDSLAALSLSEVEGVAAALAARFLSEGELSGRRIDGLIDLLPVAALAAALGWPAARLSAVGEGIALLCRALAADADDAAREQGAAACWALLDELASLPVNGWLRRWREAFVDLDEAALAANLLGALFQSRDAGAGLLSAGIAWRCEGPWDWRDAGEWKRRLRVDPALHHTRRFVAEDVELAGQRLKAGDQVLVLLAAAAHDPAGPAEALDFGRGRHACPGEGLALAIACGALDALEASRPDWRALGGGIVFQGPPNIRMRRFGAGESK

SEQ ID NO: 4997 - protein, 115 aa, Chromobacterium substugae
MIAVIFEATPTADGRDAYLQWAARLAETLPGVDGFLSIERFQSLARPDALLSLSFWRDEEAVAAWRNLESHRAAQAAGRGKFFADYRLRVAAVVRDYGMDDRAQAPGDSRAAHSG

SEQ ID NO: 4998 - protein, 260 aa, Chromobacterium substugae
MPMTATPLYCAEAARIDAARLLADRFQLPLIRQRPADGYWLELGAERLELVTTGKHGAVYAEFVEGAARHRREQGGGRGQPVAKAVGLKGAKDLPYVVDATAGLGRDSFVLATLGCRVTMVERSPVAAALLADALARAARDDSTRDIAARMTLAHANSRDWLAGLADDQRPDVVFVDPMFPDTDKKAAAAKKDMQAFQQVIGDDMDSAELLAAAIAAAKVRVVVKRPRLGAAIEGVKPSAVLDGKSTRFDLYVIKALASA

SEQ ID NO: 4999 - protein, 2365 aa, Chromobacterium substugae
MAWWKSAGRQQAAKQAARPANRLLLQALEPRMMFDGAVAATANHVAQHVGVMHDPQDAGAQQHHGEARPAAAAAQSAAEAPRAVGARDGAANVPQVVFVENDVANLQSLVSQLPSNYQVVILDSSKDGLAQIAQWAQTHSGYGAIHIMSHGQENDLQLGTTQLTTANVASYQAELATIGQALRPGGDILLYGCDVAEGSDGAALVNAIAQESGRVTAGSTDLTGAASLGGDWTLEYATGKLHVATLDLSGYDGLLTQPTSGTTSFDSLDGSTTVVPTGNATLTVSNYLGWNFTMNMNSNSDGQNEMIIVEKDGSSSTETVDALSNGVKQINYFSVKPNDGSLFTLNSITVVINGYDSTFNGGTMQLVGYLNGSAVAGATLSQSVSDIDNDGSPVTFNVSSNSNFVGIDSFRVIAANGHNVTGLVGIGAINATTFHFPGPTLTASGGSSAYSSGNGNAVTVDSGITLSDTAASTQTSATVSITGNFHSGEDVLAFTNNGSTMGNISGSYNSGTGVLTLTSSGSTATNAQWQAALEAVTYRDSSLSPNTSTRTLSFAITDASSNTSSTVTKTVTVAADSAPVISNLNGDSNTYYAGSGAVSLDTGTAATVSDSDTSNFNGGNLTVHISANGHSGEDVLGISTAGTVTLSNGTNSGSTVSVGGVAVGTIDSSGVGSGGQDLIVDFNSNATASRVGTLVNALTFNDTAGTPNTSTRTVQVTVNDGRGGTSSASSVTLAISDAPLLSTSGGSSAFTAGDNATSTPVAVDGSVSVTDNASSTLASGTVSITGNFHSGEDVLAFTNDGSTMGNISASYNSGTGVLTLTSSGATATIAQWQAALRAVTYTDSAVTPNSATRTISFQVQDGGSNTSTAVTKTVTVADTDQTPIASASGGSTAFTAGDNATSTPVAVDSGITVSDLDNTTLASGTVSITGNFHSGEDSLSFTNTSAVTYGNIVGSYNSGTGVLTLTSSGATATVAQWQAAMRAVKYTDSAVTPNSATRTISFVVNDGTKNSAATTKTVTVADTDQTPLLTASGGSAAFTAGNNVTSTPVAVDSGVTVSDLDNTTLASATVSITGNFQSAEDTLAFSNTNSTTYGNISGSYNSGTGVLTLTSSGATATLAQWQAALRAVTYTDSAITPNNATRTISFVVNDGTKNSATATRSVTVADTDQTPIATVSGANGSYTLSGTPTPVAVDSGITVSDRDNTTLASGTVSITGNFHSGEDVLAFTNTSASTYGNIVASYNSGTGVLTLTSSGATATVAQWQAALQAVTYNDTSGSPNTATRVISFVVNDGEVNSAAVTRNIAIQLPTPSVSGLTAGTDTGSSSSDGITSDATPTVTGTAEADSTVTIYVDGVSVGTTTASGTGAWSYAFSDPIASGSHAITAMATSGSVNSSVSTAYTVMIDTTAPSAPTVTGLTAATDTGSSSSDGVTSDNTPTVQGTAEANSTVTLYVDGTAVGTTTADNTGAWFYNVSSSLADGNHSIRATATDTAGNVSSQATAYSVTIDTATPTTPAISGLTTATDTGSSHSDGITSDNTPTLQGTAPANSTVTVYIDGFQVGTTTANGSGAWSYSLSANLPDGNHGARVTATDAAGNVSTLSAAYSITIDTTAPNAPTGLALATSSDTGSSHSDGITDNNQPTVQGTAEAGSTVTVYVDGTAVGTATANGSGAWSYNLASSLADGNHSIRATATDAAGNISAQSSGYTITIDTTAPNAPTGLGLSVASDTGSSHSDGITDNNQPTVQGTAEANSTVTVYVDGTAAGTATANGSGAWSYNLASSLADGNHSIRATATDAAGNISAQSSGYNVTIDTTAPNAPTGLALATSSDTGSSHSDGITDNNQPTVQGTAEANSTVTVYVDGTAVGTATANGSGAWSYNLASSLADGNHSIRATATDAAGNISAQSSGYNVTIDTTAPNAPTGLALATSSDTGSSHSDGITDNNQPTVQGTAEANSTVTVYVDGTAVGTATANGSGAWSYNLASSLADGNHSIRATATDAAGNISGQSTGYTITVDTAAPQVQSFTATDALSTSASTLGYQVVFSKPVVGFNAADLSVVTSSGAHGTVASVTQINATTYAIQLTGVGGDGTLSLAIKSGTVSDVAGNQLAGTVSVPAYQVSTSVVMTSTVTPVATVETTSFGNTIQLPPITPNIVLAAVSGNPAVTTANGNTAPGTGTLPTDHAGVGTSVTTPTFGTTDTVNGAAPSFVSNVAANPTIALQVNPDLGVRPLVSGQSFSITLPPATIITRESTASLSIVARQSDGQPLPSWLKFDPATGKFIGQAPAGWNKPISIDIRVQDKSGHHGNSHIQLNFGQSRANGTPAGKAAGKAAAGKLALNQQFDRHGHKAFLQRMQAWLEGDGQA

SEQ ID NO: 5000 - protein, 45 aa, Chromobacterium substugae
MAGGRWASVALRGGRHGGVRTPAFSKFKGTAACNPKIKRDHGWFD

SEQ ID NO: 5001 - protein, 505 aa, Chromobacterium substugae
MQSKDQAGSWVVRLTVLAVAAALAGCAATPQPISLSERQATLAADRQAMFGSQEALSAPVTLQEAMARALKYNLDYRVKLMEEAMAQRQLDLSSLDMLPKLALAAGYTSRSKDNASSSQNIATGEQSLAPSISSEKRDRTADLNLSWNVLDFGVSYFSAQQQADRVLILEQRKRKVAQQLMQQVREAWWQAAGAQRLQGRVDALLKDAESALDDARHVEQQKLRAPLDALNYRRQLLDVIRQMSAVRNALSQAKPRLAAIMNVTPGQDFQVAASADMPVPALGIDVDKMEDMALLNRPEVVEANYSKRISALETRKAIAKLLPGLEFSVGQHYDSNKFLINNSWSDAGLRISWNLLNLFSAGPITRAAEAQKRVDDAQRMALNMAVLTQVHVAYLDFQGKARQFELEHELNSVDQAIYEQTRNAVDSGATARLQGILADANAVFSSLRLFQTYGDLQNAYGQMGASLGLDPLPAATQGYDLASLSAAFRGSETKWQGTVAGGAAK

SEQ ID NO: 5002 - protein, 247 aa, Chromobacterium substugae
MITRWLTLAAIGLAGHAGAATPPASTLNAADGRIRVQLMSRHAVTLSSEIPAKISALPVVEGGSFRRGQPLVEFDCSSYRAQLRKAQASLEAASQLLKVNNQLAKYNSVGTLELTQAQGKAKEAAADASYAQTLVSKCSIAAPFDGRVAKRSAAVHQYVSPGNPILDIVDSDSLELRMLVPSKWLATLKPGSRFTISVDELGASFPARIERLGAQIDPVSQSILAIGVIDGKAGNLLPGMSGWASFK

SEQ ID NO: 5003 - protein, 441 aa, Chromobacterium substugae
MGHADKSLELATLLQLQRHAREADSAAQLGFVMVNESLQLLPYRQAALWREGLHRHVATLSGLVDPDPTAPYLQWLSALFRQLAREAAGAASRRCEAADLAPALAAEWQQWLPQHALWLPLGEHGALLLARDQPWSDYELKLAEELAHAYAHALRQFAPRRNWRALLRDGLRAGPRRRRALLAALLVACFPIRQSVLARAEVVPSDPMLLRAPVAGVIDRVEVSPNQPVKRGAPLFDLDATLLSGQFELAKEERRAAEESFRASAQLAVTDDKGKLAMAQDKARLEEKDISADFAGRELKRLHVTAPADGVVVFSDRNDWQGKAVAQGEKVMTLADPAKVELTAWLPAAEAIAIQPGSQVTLYPNASPFRSYDATLLRVAYKAEVSEGNLLAYRLQASFAAGQRLPQLGQMGTARVYGDWVPLSYYALRRPLTAARQWLGW

SEQ ID NO: 5004 - protein, 703 aa, Chromobacterium substugae
MGAAALPPLRQELTLHAGPAQADGSPSWMLHDPGANRFYQLGWAGFEMLSRWPLGDAAAVLAAVNAETTLELGEDDLLQLLLFLRQHQLLQPLAPADCERVWRQYQAGKPGHAMWLLKNYLFFRIPLVRPEPVLNRLLPWLAAVFRPAFWWLMATVAALALALASRRWDEFTHTFSGYGGWSAALGIAASLSLAKILHELGHALTARHFGCRVPAMGVAFLVMVPVLYTDTSDAWKLPSRRQRMLIGVSGMLAELTLAAWATLAWCFLPDGPLRAGVFLLATTTWLATLAINSSPFMRFDGYFLLADWWGMPNLHARAFALARWQMRQWLLGLDDPVPEFFQPARRRALILFAWATWLYRLVLFLSIAFLVYHLFFKTLGLLLLGVELGWFIARPIVAELRCWWARRADLRWQLETARSAALLALIALFLLLPWQRDVFSSPAVLAAAQSQGLYAPDAAEVVEVKARDGQQVRAGQVLARLYSPELARQMAQAQVVERHLAWQASQQPFNSELQQQGPALQKQWRAAQQQVASLSRQVARLVLTAPFAGRVADSSEALRPGTVVAEGEHLLDLVGPDGARGEAFVDEDSLIGLRRGGRASFVPDSGEGWAVSCRLGPIDSLNLATLDQPLLASTFGGPIATEARDHGLVPLSAVFRVRLEDCDRQVAPLRETAGWAKLRGERYSLLQLGWRHLLAVVEREAGL

SEQ ID NO: 5005 - protein, 175 aa, Chromobacterium substugae
MAAELNFASLAQGLTLRPAQSADAPFIDKVYRSARPDLQWIQGERELIDTVQRQQLQALLQGAGQNHPNAMHFVVEQTGAAIGVVMVDFGHNEVRVIFLAMLPETRGRGYGKQVLQGLQQAARQVRCPLAVVVWHGNEQARRLYQSLGFVLEEAGAVADKLVWYPDGRSIMVGAV

SEQ ID NO: 5006 - protein, 111 aa, Chromobacterium substugae
MLAELRSEDFAPLLGQSCLFSVEQQPELELRIQTVRQKPLAQVPGREDTQRTPFVVELVAAHATELVDAVGTLSLPAADGLPERRLENVWISRTGAMGRDRQYCYFQLPFN

SEQ ID NO: 5007 - protein, 195 aa, Chromobacterium substugae
MDAYIGTILAFGFDFPPIDWAQCQGQTLQVSQNQALFATIGSHYGGNGSTVFQLPNLCGRMPISIGPAQPTYNLPSYAIGNFGGQQTVNLLTANMPLHNHGTSAVNVSFQASTVPNPTTPASAPSTSNPYLGASGGGTGLATIWSQQLESPVTVKGLGLSGNTDTAGGTAPVSVLNPYLALNFCIAVQGIFPTRQ

SEQ ID NO: 5008 - protein, 767 aa, Chromobacterium substugae
MPDGRERRARPAPGMAALIAWVVGVGGCAFLPALPDLREYALLPAALAACAWRSGWPLRRWLLVLLALCLGLGYAAARAQWRLQQELPAAWQQKPIAFVAVVRGLPDPGEYGVRLVLEVERTLTPGAALPERVQLHDYLKRDWPPGSRWQLSARFKPRRGSANAFGFDAEQWLWSEGLLASGSAGKERRRLADGHGLMAWVDGWRARQVARIERALGTGRESALVAALTVGAQQRVAREDWQLFAATGLTHIVSISGLHITMLAGLAGWACASLLRRWPVARAPRLLAAGAALSAATVYALLAGFTVPTQRTLFMLVAGWGCLQLRRQLSPFQVWWLALSLTLLLDPFAVLAPGLWLSFGLVAALMFCSLARRRPPPGWRAALDGQWAAGVASLVPLAALFGGFPLLSPLANALAIPFVSMLLTPAALLAVALPWDGLLPLAAWLARAFYFGVERLAAGPAWHVAGAPWPLLALAGAGSLWLIAPRGVPGKPLACLLLLPGLLYRPPGPARGEFRATVLDVGQGLSLLVQTAEHALLFDTGAGDAGRVVLPQLRGLGVARLDALMLSHHDNDHDGAAAGVLAALPVGKVLAGQPQTLPRAAACRQGQGWDWDGIRFDVLAPGAGAAAGEDNARSCILRVAGGRHALLISGDAPRQVEDALAAQPGIRLASSVLIAGHHGSRTSSGEAWLAAARPRLAVVSAGFLNRYRHPHPQVLQRFEQYGATVLRTDLDGAVTLDFGRELRWGCLRQQQPRYWRARGACGGISPD

SEQ ID NO: 5009 - protein, 296 aa, Chromobacterium substugae
MPHKLLLVDDEPFNLELMTELLEDAGYETRQAENGEVAWQILEREGEQFSTILLDKMMPGMSGFDVLKKIKAEPRLEFLPVIMQTAMGAASSVQEGLAAGAFYYLTKPFSRDMLLAIVGAAVGHWDRYAHFRELANLHVDALRHLQGARFRCRTHREAQSITALLAKTSSQPERVATGLFELLVNAIEHGNLDISYEQKSQLLASGEWEQELERRQLAPEYRDREVSLEFSLIGQQLQFIVEDMGSGFDWEYYQNAEPASLMTSHGRGILIARKLSFDSLHYEGKGNRVIARVSQG

SEQ ID NO: 5010 - protein, 862 aa, Chromobacterium substugae
MNRLTSLLLGCLLGAGLLFTEYWLLLEHDRAERLQEQQHWGALGTGLVVVQLEDALEHTRIMAQQLASNGQARGLAEMARRVVREDSVFAGIGTVALVEQNQRDAFENRIATSIRFLKNQHLQPSPVQLQYYPVASYLPDDANALPQGLDLSHLGDSKWLLDLARRSDQPMLLPSQLSGLGGIRLDIITRLGDDHTLLLLNLRQDKLMQPIGNELITDNPLHHVRLLIWSKNQPDVPLLDSAPGRPIPTEPPMFSRRSKVGGNELLLGAYSLQPVQPLLSPMAWTVLIASSATLALLLLLQQRQLLANRQLHEQLKQQQLLLEQNNRTLREQISDRVMSEQALAQSEARQRAILEASSDAIILIDRSGHILQTNPAAAKLVEQSAHSLENLPAGVLFPDLYNPDPGHAFEQTASQHEGRPFETRLLRSDEQQLPVELSLSRVVMPDDWFYVTVCRDISRRKEQEEALIQLKNSLAEQVEVQSRQLAALLDASPLAMAYIVDRNLRQVNHAFLELFQQQGQDVIGRPTMPYFENPEQWERTGKALYSLLNDGKVVQTEVRLRTGKGQLFWCRLHGRAVNPSVPKLGTIWVYLDISAQRSLEETLRHAKILAEETSRAKTEFLANMSHELRTPLHAILGFTEMGQLRAQSLGEAKLEQYFTRINTSGSRLLTLLNDLLDMAKMEVGRMDYNIGRGNLSQCLREACDEMTPMASRNQIRIDLECAPETLAADIDPFRIGQVIRNLLSNAVKFSPAGSEIRVRALLDEQDGQEWAHVSVADSGPGIPEKELETIFDKFIQSSTTKTGAGGTGLGLAISREIIHAHHGRIIADNLPDSGAIFTFSIPSHFQRNLEEGTPDASQTLAR

SEQ ID NO: 5011 - protein, 258 aa, Chromobacterium substugae
MTIRRVVFNQKGGVGKSTIAVNLAAVAASRGRRVLLIDLDPQGNASHYLLGEAMKEAGPSVADLFQQMLNISLFGKEPQDFVRATGIDGLSLLASQPELAELMAKLESRYKMFKLKEALDQLAPHYDEIWIDTPPALNFYTRSALIAADRCLIPFDCDAFSRHALYNLKESADEIRSDHNPALYIEGIVVNQFQPRASLPVRLVDELKAEGLPVLASPLSASVKIRESHQAARPMVYLDPRHKLSREFEALYQELSER

SEQ ID NO: 5012 - protein, 159 aa, Chromobacterium substugae
MRTRLAPLFALLLLAGCATAPQQAAAPAPAKAAEPAPPPASADWQNLGVSPNGNILNELDWLSLKRQGPLVTFRDRKTIFNLKQENFLSTPRHKVSLNTWQIDCSQHTFRLLDMTLFDENGRQIASFSYNDSQIKAMPVVQNSASYQQMLLVCKGQPGF

SEQ ID NO: 5013 - protein, 51 aa, Chromobacterium substugae
MHAGCDLREKTPLYGKRGEECAGTKKEAARIWRPQVGWRQCETKRKNALAL

SEQ ID NO: 5014 - protein, 599 aa, Chromobacterium substugae
MHDAVSILNHVFGYPEFRGQQQEIVEQVAHGGHALVLMPTGGGKSLCYQIPALLRDGVAIVVSPLIALMQDQVATLQELGVAAACLNSATSPEEARDIARQARAGTLDLLYVAPERLLTPRFLEFMSSLNIALFAIDEAHCVSHWGHDFRPEYQQLGLLAERFPQVPRIALTATADEQTRLDIIHYLKLAEARVFLSSFDRPNLFYQVVEKHNAKKQLLDFIRQEHQGATGIVYCLSRKRVEDTAQWLCDNGIEALPYHAGLSHAQREAHQRSFLREDGIVMVATVAFGMGIDKPDVRFVAHIDMPKSPENFYQESGRAGRDGLPSASWLCYGLNDVVQLRQMIEGGEMAELQKQVELSKLDAMLAFCETAGCRRQHILAHFGEDSRPCGHCDNCLHPPITYDATEPVRKLLSCIYRVGQRFPTGHVIDVLLGRQSPSIGHHRHDQLSTYGIGKDMNQRWWRSIVRQLVARQLVQVDIARGQSLVLTDACRPLLKGEESIYLRPLADEKKSRGSAAADRWLRTEREERLWQALRRWRRQVADEHNVPAYAVFSDRTLRDLVEKRPDSPAGLRHIHGLGELKLARYGEALLQCLSEAQQA

SEQ ID NO: 5015 - protein, 405 aa, Chromobacterium substugae
MAVNLNPPQAGLLPPVAGVELLVAEAGIKTPGRKDVLVVRLDKGNTVAGVFTRNRFCAAPVQLCQEHLAAGVQIRALVVNTGNANAGTGVDGRQRALSVCQALAAQSGVQTEQVLPFSTGVILEPLPAGKIIAALPTLRAADWADAAQAIMTTDTIAKAASRTLQLDGKPVTITGIAKGSGMIHPNMATMLGFVATDAAVTRPLLNQLLREVADLSFNSITVDGDTSTNDSFILISTGKSEAGLIDSAEQPAYQQLKQALLEVAIELAQAIVRDGEGATKFITVDVNGGRSVAECKDVAYAIARSPLVKTAFFASDPNLGRLLAAIGYAGVADLDVDRLSLYLDDVLVACDGGRNPAYSEEQGQAVMNQSEITVRVELGRGAASARVWTCDFSYEYVRINADYRS

SEQ ID NO: 5016 - protein, 173 aa, Chromobacterium substugae
MRYRRSMAEGGTWFFTVNLADRRQDYLTRHIDVLRQVVRQVRNRHPFEIVAMVVLPDHFHAVWALPQGDADYATRMALIKAAFSRSLPKVERIRESRERKRERGIWQRRYWEHQIRDEADLQAHVDYIHYNPVKHGDAERVADWPYSSFHRYVRLGWLPADWAGEGVVVQLQE

SEQ ID NO: 5017 - protein, 599 aa, Chromobacterium substugae
MSNLIELKVPDIGGHNNVDVIEVFVKPGDVIEKEASLITLETDKATMEVPAEAAGTVKEVRVAVGGKVSEGDVVVILEAAGAAAAAPAEVKPVETTGVASATTQAGFAPQAAPVAASHSGGADVECDVMVLGGGPGGYSAAFRAADLGLKVVIVERYATLGGVCLNVGCIPSKALLHNAAVIDEVSHLAANGIKFGKPEVDIDMLRGYKEKVIAKLTGGLGGMAKARKVEIVRGNGHFIDPHHIEVSLTTGQGREESGEKKIVKFKNAIIAAGSRVVKLPFIPNDPRVVDSTGALELKGVAKRMLIIGGGIIGLEMGTVYSTLGARLDVVEMLDGLMQGADRDLVKVWQKWNAHRFDNIMLNTKTVAVEPKEDGVWVTFEGEQAPKEAQRYDLVLYATGRAPNGKLIGAENAGIAVTDRGFIQVDKQQRTNVPHIFAIGDIVGQPMLAHKGVHEGHVAAENCAGQKAYFDARVIPGVAYTDPEVAWVGVTEDEAKKQGLKIEKGVFPWAASGRAIANGRDEGFTKLIFDAESHQIIGGGIVGPHAGDMIGEVCLAIEMGCDATDIGKTIHPHPTMGESIGMAAEVAHGTCTDLPPQRKK

SEQ ID NO: 5018 - protein, 553 aa, Chromobacterium substugae
MSNLIELKVPDIGGHSNVDIIEVFIAPGQTVSVDDSLITLETDKATMEVPAEAAGVVKEVKAVVGGKISEGDVIAIIEVGATASAPAPAAAAPAPAAAPVAAPAPVAAAPADAPAAPTASGRSEIRVPDIGGHNGVDVIEVTVKVGDEIAVDDSLITLETDKATMEVPATAAGRVVEVKIKVGDKVSEGDLIVVVEGAVAASAPAAAAPAPAAAPAAPTPLAAAPAAAPAVAPVAAAVAAAIDEIAFSKAHAGPSVRRLARELGVDLGKVKGNGRKGRVTEDDVKAFVKGVMQNPAILAPAAAPAGSGVGLDLLPWPKVDFAKFGPIETKPLSRIQKISGANLSRNWVMIPHVTFNDECDITELEDFRKTVGKEWEKSGLKISPLAFIIKAAAEALKAFPNFNASLDGDNLVLKQYYHIGFAADTPNGLVVPVIKDADKKGLRQIAQELTDLSKLAREGKLKPTDMQGATFTISSLGGIGGTSFTPIVNAPEVAILGVCKSQIKPVWNGKEFAPRLMCPLSLSFDHRVIDGAAAARFTVHLGKLLTDVRRLIL

SEQ ID NO: 5019 - protein, 887 aa, Chromobacterium substugae
MAATFPDDIDPLETQEWTEALESVLDNEGPERAHYLLEKLVERTRRRGAHLPFDATTAYLNTIPVGKEAKSPGNHEMEHRIRSINRWNAAAMVLRAGKKDLELGGHIASYQSSATLYDVGFNHFWRAQNENQDGDLIYFQGHIAPGVYARAFMEGRLSAEQMDNFRQEVDGKGLSSYPHPWLMKDFWQFPTVSMGLGPLMAIYQARFLKYLESRGLAKTMGRKVWCFCGDGEMDEPESLGAIAMAAREGLDNLVFVINCNLQRLDGPVRGNGKIIQELEGDFRGSGWNVLKVIWGSRWDPLLAMDTKGLLKKRMDECVDGDYQTFKSKDGGYVREHFFGKYPELREMVANMSDEEVWNLNRGGHDPHKVYAAYHEATHNANGRPTVILAKTIKGYGMGASGEAKNIAHQAKKMDLESLRNFRDRFGIPVSDEDLPNVPYYLPAEDSPEMKYMRERRAALGGYLPARNPVNHPLAVPELSAFDAQLQASGDREFSTTMAFVRMLGTIMKDKNIGKRVVPIVPDESRTFGMEGMFRQYGIWSTQGQNYVPQDHDQLMFYKESKDGQILQEGINEPGAMADWIAAATSYANSSQPMIPFYIYYSMFGFQRIGDLAWAAGDMRARGFLLGGTAGRTTLNGEGLQHEDGHSHIQAGLIPNCISYDPTFAYELAVIVQDGMRRMYAEQEDVFYYLTLMNENYVHPAMPAGAEEGILKGMYLLQDGGDAKVKVQLMGSGTILREVMAAADLLKADFGIGADIWSVTSFNQLRRDGMEAERHNLLNPTAEAQSSYVEQQLAGRNGPVIAATDYIRNYADQIRAYVPGRYVVLGTDGFGRSDSRANLRSFFEVDRYHVALAALSALARDGKIDGAKVAEAIAKYGIKTDKLPSWKV

SEQ ID NO: 5020 - protein, 327 aa, Chromobacterium substugae
MPILPAAPPRLTAGGRADFGVYQGTVSDLSWDGLAMSRWQRLGRRLRHKRWQYAAIAGERFFIAMAVVDVGWSGTAFAYLFDRRSGRVVAAASADALPGAGPRVADRAFGDARFRAPGKRFEFTRDGDALRLRLDSRALQLDATIALAGMPPVLAVIAPANYMAHSTHKSGGLAVSGEARCAAGRYSLDGATASLDYSNGLLARETGWRWASAHSRRFGFNLQQGYMGDAENAVWLDGRLFRVGAAAFDYQPGDPLAPWRVATADGLLDLVFTPEGARREDKNLIIAASRYVQPIGRFDGALTDPDSGERHAVRDLVGVTEDHLSRW

SEQ ID NO: 5021 - protein, 252 aa, Chromobacterium substugae
MLLLLKLLLVPALIGLISLAAKRWGPGVAGALAGFPVITGSILFILSLEQDAAFVREASLAAALGTSANLVFGIAYSWTARQARWPACLAAGLLAYALAVALGHWAQPSGWQSAVFGVLFLPVAGKLFPMPPQTPDSPPRSAGMAPRMLAGAALVLAITSLSARLGPSLSGLLAVFPVLGSVLAVFSHLSAGPATTIRLLRGMVRGFYAFVAFCVALAAALSAWPASAAFGAALGLAIAVQILMMWLGRRHH

SEQ ID NO: 5022 - protein, 186 aa, Chromobacterium substugae
MNEKLANPAPLGLMGFGMTTVLLNIHNAGFFPISSMILAMGLCYGGLAQIVAGIMEFRRGNTFGVTAFLSYGLFWLSLVLLIVLPKTGLADATPVGYMGWYLLMWGVFTLFMLLGTVNYPRAKQFVFASLTVLFFLLAARDFTGSAVIGMIAGFEGIICGASAIYLAMATVLNEQYGRTVLPIGAR

SEQ ID NO: 5023 - protein, 72 aa, Chromobacterium substugae
MQSVHGCGFLCGYRDGFTCASSGRTGEFALEVLLYSGRHATTSRRNRTKIRGRRIAGDGGDAGDCKRGKSLF

SEQ ID NO: 5024 - protein, 193 aa, Chromobacterium substugae
MDRLHTLLEHNRAFVENREYEQYKTDKFPGKGLAILACMDARLVELLPKAMGLKNGDAKLIKNAGALITHQWGSVMRSLIVAVYELRAEEICVVAHHDCGMRAIDPHKILTHAQERGVSEDTIATLRGAGIDLDNWLKGFDNVADSVRHSVNTIRNHPLMPKDIPVHGMVIHPSTGRLEVVVSGYGEEGAPAA

SEQ ID NO: 5025 - protein, 212 aa, Chromobacterium substugae
MSPRIGVFGGTFDPIHQAHLRMAAAFADELALERVLLIPAGQPYHRARGARASPEQRLEMVRLAIAGDPRLQADDREIRRGRPAYTVETLRELRGELGQDAELWFLMGGDSLATLDSWKDWTQLFQLANLAVAMRPGFDWQTLPAEVRREWQARQVHDFSNRTASGTIRSLALPPLDLSATRLRARLASGQTAEGLIDPAVLAYIRQQRLYQ

SEQ ID NO: 5026 - protein, 122 aa, Chromobacterium substugae
MEIQAISKLAVEALEDIKGKDIIELDTSKLTSLFQRMIVATGDSNRQVKALANNVQVTLKEAGVDIVGSEGHESGEWVLVDAGDVVIHVMLPAVRDYYDIEALWGGQKPSFAAGAAKPWSAV

SEQ ID NO: 5027 - protein, 156 aa, Chromobacterium substugae
MKITILAVGTKMPRWVDEAYSDYAKRFGRDITLELKEIKPEKRGGGVTAEKGIAAEHERLIAAIPPRARLVVMDERGKNWTSVKLAEGLKEWMAGGDDVVFIIGGADGLSAELKQRADVLLQLSAMTLPHGMVRVMLAEQIYRAYSILNNHPYHRE

SEQ ID NO: 5028 - protein, 132 aa, Chromobacterium substugae
MMSTWYVRIWAFAAIASAIGHLLAPQFMAAGTAWGLSSGWQCEIAIFDLVLATYLLCRLHEEPQSAHRLMALLCGLSLLLGINHLQGGLLSHWSYLHVAGVAANGLAVLAGVSLLWPYSRRRLSAGLRKHPQ

SEQ ID NO: 5029 - protein, 425 aa, Chromobacterium substugae
MTLLSGWSRGRFHYAWIAVAVTFLVMLVTAAIRSAPGVMMVPLEHEFGWSRSAISTALAINLALFGLMGPFAAAAMLRFGLRRTVLAALALLAVCVGLSSLMRSNWQLQLLWGLMVGCATGATAMTLGASVVSRWFVRHRGLAMGILTASSATGQLAFLPLMAYLTEWHGWRSTVWLLAIAAACAMPLVALLLPERPSSIGLRALGEADDAPPPPVLGHNPIRIAFDALARAARSRDFWLLFATFFVCGASTNGYIGTHFIAMCGDYGLTPVRGASLLAAMGMFDLLGTTLSGWLSDRFAPQILLFCYYGLRGLALIYLPYAFGLEYFLGLPLFAMFYGLDWVATVPPTVKLTAGSFGSQEAPVVFGWIVAGHQLGAAFAALGAGMLRNSLGSYTAATMISGGLCLLAAGLVLLINRPSRVWRAA

SEQ ID NO: 5030 - protein, 121 aa, Chromobacterium substugae
MAELYASQGWGEEKAFDLQAMERAFRACFGVCALDNGRVLGFARGFSDGWQAGWLAEIVVHRDCIGLGLGTALARAFMLRCGAEVVYCEALAGREPFFERLGFKVRPRLSAMAWRAPTGCG

SEQ ID NO: 5031 - protein, 293 aa, Chromobacterium substugae
MLASLSDLAVFITVAEQGSFVGAGRLLGVSASAVGKRISRLEAELGVRLLQRSTRSLALTAEGDAVLGRGRRMLEEASAMAAELEQAGKLPGGLLRLSLPPIGGVMMAELSAFQQRFPEVSLELDYSERNVDIIEEGFDAAIRVGEGDDGKLRSLALPGFRRLIVAAPDYLARHGSPRSPAGLADHRLIHYRSPNSGKLEDWPLADTSLSAALVCNSMHARLEFALQGQGIACLPDISIRRELDDGRLRPLLNSDSGERVPLRLLWPSSRGLSARMAAFVDFMRQMAGEAEYG

SEQ ID NO: 5032 - protein, 380 aa, Chromobacterium substugae
MTLAVAAFAIGTAEFIIMGLLPLIAADLRVGLPRAAYLVSGYALGVVAGGPLLAGLIARLDEKRALSGLMLIFIAGNLACLLAPGLWPLLLARMFTAFCHASFIGVAAVMAARMAPPGMAGRAMALMFSGMTLANVLGVPAGTLIGQWAGWRASFAAVAALGFLTLLLIRWQLPTHIGNHTSGETQARLPGRVWPALLASVLAAASMFAFFTYLVPTLSQVSGLAAKHASAALLLCGAGLVIGGWLGGRLADGNLDQALSRCLILLCATLATFYLLAARLPFALALMALWGGLAFALCMLLQTLAIRQAGEAAAQASALNVGAFNLGNALGAWLAGRLLDHGGTLAQTSLLAAALAGLTWLLARFISRVETARRVALARA

SEQ ID NO: 5033 - protein, 326 aa, Chromobacterium substugae
MTAALAKGLAPLYLVHGEEALLALEAADAVRAAARAAGYLEREVLTVEAGFDWSQLFDAMSSVSLFASLKLLEIRIPGGKPGTEGSEALQRLAANPPADTLTLITLPKLDKTQQQGKWFAALEKAGLAVEARPVGRAELPGWISRRLKAQGQQLGSEALAFFVERVEGNLLAARQEVDKLALLYPKGELSLADLQAAVANVARFDVFQLSESWLAGDAPRLMRMLDGLMAEGEAPVLVLWSLSEDVRMLLRLRQGLKDGRQLRDMARELRLWGDKQRLAEPALRRIGPRKLMQALSECARIDRQIKGVEPGEPWQTMRALATLLAA

SEQ ID NO: 5034 - protein, 185 aa, Chromobacterium substugae
MKQSLNCLLLAGLVLLLSACGFHLRGLGGSVKELPFSTMYLEAANTGIEADLRTVLARNSKLTLLPAAKQAQAVVTVLNENQSKDILTINASGKISEYQLTYTATVRVVLGGVPIEPDMEVSVRRSMNYSDSAVLGKEQEEGLLWADARRDAAEQIVRRLAYLKVPAVSPAGPQSLKPANAVTQP

SEQ ID NO: 5035 - protein, 905 aa, Chromobacterium substugae
MQEHYSPRELESAAQQKWQKTAAFKAVEDASRPKYYALSMFPYPSGKLHMGHVRNYTITDVLARFKRLQGFNVLQPMGWDAFGLPAENAAMKNGGAPAAWTYSNIEYMKTQLDSLGFALDWERELATCKPDYYRWEQWLFTRLFEKGVIYKKNGVVNWDPVDQTVLANEQVVDGRGWRSGALVEKREIPMYYFRITDYAEQLLADLDQLDGWPEQVKTMQRNWIGKSYGSDVVFPYDEASIGHKGELKVYTTRPDTLMGATYVAVAAEHPLATQAAAGNAELQAFIAECKSGSVAEADVAKMEKKGMPTGLFVTHPLTGERLPVWVANYVLWGYGEGAVMAVPAHDERDFEFAKKYRLPIKPVVLNEKNVDDVNVSYAEVGGASNGENGVPFRFPVIRRANNLVVEHRISWDEWQPSFAEHGKLIQSDEFNGLTSSEAFEKICSKLQDKGLGQKKTQYRLRDWGISRQRYWGCPIPIIHCASCGDVPVPEKDLPVTLPENVIPDGAGSPLAKMPEFYETACPKCGGAAKRETDTMDTFVESSWYYARYASPKCDTAMVDKQAADYWLQVDQYVGGIEHAILHLLYARFFHKLMRDEGLVSSDEPFKSLLTQGMVICETFYRDLPNGSKDWIAPQDVILERDAKGKIVAATHRVDGQPVVVGGIEKMSKSKNNGVDPQEFIEKYGADTARLFMMFAAPPEQSLEWSDAGVEGAFRFLKRLWKSAREHVEAGVVAPYSAGELNASQKELRFKLHGTIQKVADDYGRRQQFNTAIAAVMELLNAYDKADTSGDTGRAVAQEVLEAATLLLSPIVPHVCDGIWSQLKPGTELLAQSWPKVDEAALVKSEIELMVQVCGKLRGSVTVAADAAKDAIEAAALAHENVIKFMEGKPAKKIIVVPGRLVNIVV

SEQ ID NO: 5036 - protein, 267 aa, Chromobacterium substugae
MLAPPLLVALLGCGAVAGFLAGLLGVGGGLIIVPVVLAVLAAAHLGGEHAQHLAVGTSLAVMVFTSASSVRAHHKKGAVDWRIVRGMAPAMVLGTLAGSLLAGWIPGRALAWFFVVYAYAVAAQMLIGKQPRAGREMPGRAGQGAAGGAIGMISSWVGIGGGSMSVPLMSWCNVPVHTAIGTSAALGWPIAVSGALGYLASGWRAQGLPWGSVGFVYLPAMLALMLMTVLCAPLGARAAHRLPVARLKKAFALLMAAMASEMLLRLL

SEQ ID NO: 5037 - protein, 152 aa, Chromobacterium substugae
MRYWLMKSEPDETSIDHLAAEPARLFEWTGVRNYQARNFMRDDMRPGDLLLFWHSSCPEPGIAGIAEVAAPAHPDSSQFDPDSPYHDPKSDPAQPRWQCVDVRFVSKTRLVSPAELRGHPPLEGMTVLKRGNRLSITPVTAEEWDYLTREVL

SEQ ID NO: 5038 - protein, 51 aa, Chromobacterium substugae
MKTWILAVIAIGSLSGCVVEPPRVGIAPVVVRPAVVVAPAYYYGPRYYGWR

SEQ ID NO: 5039 - protein, 109 aa, Chromobacterium substugae
MILLLLLPLLAACLLGRLGWGWWLPYAALALPTLLAYWLDKRAALRGAWRIPEARLQLLHLAGGWPAAFLAQRWFRHKTRKQPFLLIYWLAALANLAPPLAWWWLQRQP

SEQ ID NO: 5040 - protein, 202 aa, Chromobacterium substugae
MTDILPITDKPTLRRQLRRARMALPPAYRAAAAQAIARHASRLLKRGKRVGGYLAAGSELDLAMLLNAALWRGARVYLPQIPRRGRRLWFTRLAAADRWYLHPRYRILEYAGARLRAERLDVVFVPLLGVDREGYRMGQGGGFYDSTLAFRRRVAAGGPLLVGVAFDCQLVDAVPREAWDVRLDCLLTESGLRRLPLREAEA

SEQ ID NO: 5041 - protein, 103 aa, Chromobacterium substugae
MSDVVQVEIELLGRHFTIGTPQGEQETLLEAVRLLEGKISTIQQHGKVMDADKIAIMAALNIAHDLLKTKVGEGLEMAAFQRKIRDMGEAADNALRQSQQPLF

SEQ ID NO: 5042 - protein, 69 aa, Chromobacterium substugae
MDNELEYLESRVAALIARIRELETQNGRFAEALSEALKENAELNFRVNETRSRVAALVARLPGAPEDEQ

SEQ ID NO: 5043 - protein, 284 aa, Chromobacterium substugae
MAALLLAGAAQADIRVTDGDGQEVALRQPAQRIVSLVPHATELLFAAGAGDKVVATVEYSDHPPAAKKLPRVGSFTGFSLEAVLRQRPDLVVAWKDGGTPRELARLRSLGVPVFISHPLQPGDVALEIGKLGRLAGSEAAANRAAAQYRRQMAALQQRYGGRAPVRVFYQLSQAPIFTISGKSYIDSLIRTCGGVNVFADLPLPAPQVSTASVVAAQPQAIVASDEATLAMWRRWRGVPAVSHAALFALPGDDISIPGPRLVEGAAALCERLDMARQRLGLTPN

SEQ ID NO: 5044 - protein, 175 aa, Chromobacterium substugae
MPHLISGGARSGKSAHAEDLARRHAGPVCYLATAEVRDAEFARRVERHRAQRPAHWRVAEAGRGLAAAIAAADCPGGLVLVDCLGMWLMRFFGEPGFDEAGYAVERDALLAALDGARGEILLVSNEVGWGVVAGDAETRRFVDELGRLNQLAAARCQRVTLVACGLPLVLKGGPA

SEQ ID NO: 5045 - protein, 657 aa, Chromobacterium substugae
MFKFQSCALFAALTAAGVVQAADLPEFAGDPVIVTASRVPQKVSSLPANVTVITAEDIANSTATTVQDVLSSYAGVHVSNSSGSASTAMVDLRGFGVTGMSNTLILVDGVRQNTNDLSAPNLGAVTLASIDHIEVVRGIGGVAYGGGATGGVINIITKSGAANGVNGSVMLTGGSYDLRQLDANLHAGNQYVALDGYVQSLKTDNYRQNNAERDDNAGATLTFKHDGGDIKLFAKTASQGLRLPGSIVMDPANGQNPLLNNPTGTATPNSHSSTGTSSGGVSLSQDLGAGTLYADWSRRVKDADSCVQYAGIAGCSRDQRNLGENAASARYELPIGKHTLSFGSDWLDSSMSVYNSLGNKQTSQKRVGYFVDGQFKLWQGATLSAGGRQQLVDDKVNAMSGGANLSTIHTSLHAWSLGLKQDLRAGWSVYARSGQSFRLGNADEVTYTNGLPLQPQQSHDREVGAQWANDAAHAKLALFRNDLTNEIAYNPFVGLFGANANLPETRHQGVELEGGAKLSQRVGVNANLTWTQATYRSGAGLAGNTIPMVPKLMANTAVNWSISDASKVSVAAQYVSQQYFDNDQSNAFGRKLPAYTVVDAKFSQAFGKHVSATFSVNNLFNRHYATYGGTDAYTSPTAYDLYPANARNYQAAVTYTF

SEQ ID NO: 5046 - protein, 344 aa, Chromobacterium substugae
MNSSKPLDLSARNAARARQAVLTKPPGSLGQLEELACRFAAWQGRACPEELKPAITVFAGDHGVTVEGVSAFPAEVTTEMVRNFSAGGAAICVLARALDARLEVVDVGVAGDVSALPIIHAKVRAGSHNLAKQSAMSAEETAAALETGRAAARRAVDAGANLLIAGDMGIGNTTASAALICRLTGAAPELVVGRGTGIDDSGLSNKRRVVKTALARVAWENLSGEDTLAELGGLEIAAIAGFFLEGARLGVPSLVDGFIASAAALCAKAIDPTLHDWLLASHRSAESGHDLALAALQLHPLVDLGLRLGEGSGAALCVPMLQMAVKLHNEMATFAEAGVSGKSA

SEQ ID NO: 5047 - protein, 200 aa, Chromobacterium substugae
MNPYTLTLLRHGEIDHDGRLIGLTDLPLTEHGHHQLGRSWQRISSLAPVTAIASSPLQRCREFAVKQALSGSLTLKVDPRFAEMDFGGWDGQPVADLERVHPGWGEALADGRLSPPGGESFEAFRTRVLAGLADWMTEARGSHRLLVTHGGVITVLMAELLGTDFSVAKLMTVQRGGFVQLSMLEGHPAYLLRLESACAD

SEQ ID NO: 5048 - protein, 246 aa, Chromobacterium substugae
MRGLILAVQFLTRLPTPQLAEFKPEWLAASARWFPAVGALVGALLLGALQVGQPVDPWLAALLALLVWTGVTGGLHLDGLADLADALGASHRSRERFFEVLKDPHLGSFGVLSLILAVVCKLVLLMLLARQSGPVWGLLLAPAWARGFAIAWSATLPAIAPGSGERFAWRRDWAGMGLNLAALLALSAWLAPALLLAPLAGLAWWAFLKRRLGGMTGDCLGAGVELCEIALLAALLILPTYFPVLK

SEQ ID NO: 5049 - protein, 358 aa, Chromobacterium substugae
MAAPVHADVWQGELGGAPVVMEWSVDNEGEVDGRYFYRKFHNDIALTGKRDAQGALRLSESLGHGEARADLALRPSGTGWVGEWREPKTKRALPVTLTPLAMSSEEGTDEADWIDDYNRARLADLRLRRVGEQVFLGHRLSWWEEPVSRIRWFRLESGYSADAMARLNRIFERRQWRAVVDAFECVAAAQGSTLGRYQQAVTPRLLTPRVVSISIETSAFCGGAHPDSGDAPLNMEVASGRVLHLEDVLWLGRGEPQDARGEDGLLRDAGYESKVLQPWLASVFGKLYPREMAGGEGGGCDYRGPEAWNAFNWYLTPKGMQIGAFFARARKDCDNPAWSLLPWALVRQHPGVLTPRLP

SEQ ID NO: 5050 - protein, 279 aa, Chromobacterium substugae
MGRRFACRIAMARHFHITRLLDRGRFNDKVLRQLGWAMAFIAGAINAGGFLAVHRYTSHVSGIVSGMADAWGTGEVRLALSLLVMLCCFIGGAMHSTWLILWARRQRLRGGYGVSMMEEALLLLVFGLLGAGLSLHKGLFTPPTVMLLCFIMGMHNTIVTKLSGGLLRSTHMTGIATDIGIELAKMSYYNRQQGPRIQAVRSNRNKFRVYSLILLSFFAGGVVGALGFKHLGFGFTLPLALFLFLLGLRPAWYDVRLRWRWWRIGLTAARARAGALRRT

SEQ ID NO: 5051 - protein, 276 aa, Chromobacterium substugae
MALVVVLNLVVAMYGSFKQRPPMDVHAQEVSPGQVKLLPTGWTPDASAGQASAPHAAASAPASAAKAASAPLAAAKTDKHAKPAASAPQEQAKSAKAQAKPAAKQEASKPAAAKSAEAAPPAAKACYRWAGLSDSLLARVKGGVPLLKLKAGQLQEDSKEESKGSSRFWVYYPPLATQAETKTLSAELKDKGFDNYLVSGDEFKGNLSLGLFGREDAAKTLAARLKAAGYDKAVVKSKNEAAKVTTLSFKDLDAAQAEHLKALQKRLTPGIALKGC

SEQ ID NO: 5052 - protein, 247 aa, Chromobacterium substugae
MKLLIDAGNSRVKWAAYRGAECVAKGAAEHGELASLAPVWSQLPLQGAWMSSVARKEVADALAAALACPLHRVHAQSRFGAVCNHYRNTAEQGADRWLAVLAARELCGGDVIVACAGTALTVETLTADGDYLGGLILPGYGLMLQSLAQGTANLDRAAGAVVDFPQGTQDALASGVMAALVGAIEGQRRKLAERTGRQPATVILTGGDAGRIAPWLAAPLEIVDNLVLMGLLKVANASSGLWRWWWC

SEQ ID NO: 5053 - protein, 321 aa, Chromobacterium substugae
MNEHAFAVLHHLSDGRFHSGEDIAQALGCSRTLVWQAVHAIEADLGLTVFSVRGQGYKLAQPFAWLDVAGVRAGLSEAAAEVYTLAVAERTDSTNSQLMARAGNGGLHGLVLACELQTAGRGRLGRRWQARLGSGLTFSLLWRFERGVSELAGLSLAVGVALARALRGLGAPVRLKWPNDVLLDGSKLAGILIELSGDALGPAAVVIGIGLNVADPGEVDQPVATLRQAGVAADRNSLLAALLNELQTVLSAFDRDGFAPLRDEWCALSAHQQAPVRLSFSHGEPVDGIACGVADNGALRVETAQGMRTFHVGEVSLRERQ

SEQ ID NO: 5054 - protein, 166 aa, Chromobacterium substugae
MTYPMPSFEDKICPPEQLAERLAALPRPLVFTNGCFDILHRGHVTYLAQARALGASLVLGLNTDASVKRQGKGEDRPINNEHNRAAVLAALESVSLVTWFDADTPAQLIEQVRPEVLVKGGDWTVDKIVGSAETLARGGQVHSIPFLFDTSTTQTLNKIRAGEGKA

SEQ ID NO: 5055 - protein, 183 aa, Chromobacterium substugae
MSGNSRGFTLLEMMVTLAVMVILLTVAMPAWQTLMQNQRLISTRDNLLSAMSQARASAVNDDSVVTICPYSAASSTACGSSWSAGWVISEQQSGSAVLLKSQPLVSGSPTIGTLAAGTASGTIASVSFNPRPPYVAVAQTGDFRICDSRGAAVALSFNLQSTGYAQSAASAGATLSGASLSCP

SEQ ID NO: 5056 - protein, 135 aa, Chromobacterium substugae
MRGITLVEMMVTLAVVAILASIAYPLYTSHVQQSRRGDAWQALTAAQSQMEQCYAQYFAYNNAACTVSASSPGGYYQVQVSSATTASGYVLTATPAAGGLQAADTTCSSFNVSNSGLRSAANAQGSDTSSTCWPH

SEQ ID NO: 5057 - protein, 1217 aa, Chromobacterium substugae
MADWKPAVRIVVGILLLACILLAARKVAGGGSTATLAISQVPLTITTPARPQVVIAVTNSESMDGSTITYCNGTGNSGANCSNGFSTSYTGRGGALLTGAGAVSGLTGSSSPINYPVPASFTPPVSGGAAGSLVPYTSTLSGGQLADNSPSRLNVAKAGILSILNTYLATTDFALLSYQMSNTRMYTTWVYYMAPTGGFAFTNTPTATSSTDTVYNPCYNYLTSSSTTVASNCASIALSLGLSGSSVSGSQYMTVAATSDDANINDVLYSSSLNPVFMTYGTVSPSNPYTYYSLSSYKSGSVSVSYSTMAPGGRTNWATSPTNAGYVPYSPQVMYVQRGWGYGGSQSYSGATTNVTMTNLGSPSASQLTSAYNSFSPFLQPETNSTSTSEIKSAAGQSPIYALLKTAQTSFTSTSSSSGCSPQKYVVLITDGLPTQDKSGNFWPPAGSAAASGYGVTASFNADGSLNTGATNDQALLDTISQIQSLANSGIKTYVIGLGAGVAPATNPTAAQTLTAMAVAGNTGSYYPAVSATAFSNALSSILVQIQKGSYDQASVALNSTTLSTNSQAFLASFNPSDSPYNDWTGNLSAYSLSTSSGLNVGTSANWQAQTQVDTFSSSNAWQNTRLIATWDAVNSKGVPFEWPASGVTGINSTQQGWLQPSDTKGSLRLNYLRGDKSQEVQNGGGFRNRSHLLGDIIDSGPVYVAKPDGPYSDASYLSFINANANRTPLLYVGGNDGMLHAFNASTGNEAFAFIPNGVFSNLYQLTSASYNNNHIYFVDGSPQAGDVMFANGVWHSLLVGGLGGGGSTIYALDVTTPSNFTSETALANAALWEFSDSGLGYTYGRPSIARVNATPGFAVMFGNGYASSGNHAIFYAVNPQTGATLAKIDLCSSVPAACNSSAPQGLSEVVAINSSGNAGAAVDMVYAGDLQGNVWAINIGSSNPASWSVRLLFTATDSSGNHQPITAAPAATLNANFPKQKGTMVYFGTGQLLAQSDLTNTNTQAFYAVYDNLSISGLTPSNLVQQTESLVTSAQSGFTNTTVTSTTYNWQSPNPPLSCVVGRTCPTLYGWYYTLSFAGSGTRVLTNPQVFAGNVVYTTFAPPSTPCTSGGLSFLMASSYATGGPPTQPFLDANGNGVVNSQDVYNQLPVSGVQLGSFFASTPAFVTSNQGGYSASILVGGGNGNSNNNCANGKLSCTSSSPLQQYYSWSGWWQIM

SEQ ID NO: 5058 - protein, 182 aa, Chromobacterium substugae
MKPLRKAGSERGVVLIIALIFMLVIMILGLAGSTQSLSQLHMASNNVQYQSNLELAEGTLRQAYSAMLQGVFASQTYTVAGNNGYYQFNANTVPAWQQNLYTPSFWTNSAMTIPGYTGTPPNSAVTSSYVVENMPAACRAGTSCGNRGIYGQAAGGNNYRVTARVVTSNGASPVVVQAIFTQ

SEQ ID NO: 5059 - protein, 354 aa, Chromobacterium substugae
MRPTRAQTGFSLVELMVAVTIGLLLLTALVGVMVAGRKDYSTDAGQGQLQNAGATVSSLISQTARSAGFFGCSGATTSNALVSANGLLGNFSAPVTGYDAVVASSTLTLSSLNGANDSALTDWSPALDSSLQGKVQPGSDVVVFSGQSNGTVPVWVSVYASTGATSLQTLSASGVAANNLLSVSNCAHSSIMQVSGVGSASGGSVINLNQALDSDFPVGSVAALLSQTAYFVGQASGTQSALYQAVYDGTGGGWQVTPIVPGVDTMQVWYGIGSAPGVTTEYLPANQISSWSQVNSLRIAVLLEGPQGTAPLSKAGNCLNRTQWTVLSNTVNVPCDTRLRHVYTMTVSLRNAGL

SEQ ID NO: 5060 - protein, 146 aa, Chromobacterium substugae
MLEVLIALLVLAMGVLAAIAVMLNAERASGSGYLRQMANQYAYDMVDRMRANSAQVAAGAYDVASGVSASTFQSNCVATACTAATMATFDKYQWLTDLQNNLPNGTGSIYQPASGATTERVVQVWWTDGNAASGGAVLTEIVRTIM

SEQ ID NO: 5061 - protein, 248 aa, Chromobacterium substugae
MANRQLLREIRLVHAEVNGIYGHRRIHAELLAQGFACGRHRIAGLMRRNGIRVRTRKHCRPVSGGQHLLPVAPNLLQRQFAAGGDINQRWVSDMTYIRTGEGWLYLAVVLDLYSRAIVGWAMHHRMPQELVHAALTMAVARRQPSGEVILHSDRGSQYCAFDYQALLKRHGMVPSHSRTGNCWDNAAMESFFRSLKSERVYLTHYRSYEEARTDVFDYIRFYNHQRRHSTLGYLTPVEFERRRSELSA

SEQ ID NO: 5062 - protein, 562 aa, Chromobacterium substugae
MSHHRFALPGSFRLRLAALFGGLFLASALVAGLCLDQVLSQRMLRDQGEAMGSLTGSIAQAIESNLRERHREVMLLAQTPTYVSAPLDGDELRQSLERTKQTYRYYAWIGVADTQGKVLSSTGGMLLGQSVAKRPWFIQGRHAPFVGDIHQAVLLAKLLPSAKLQGEPLRFVDFASPLYDASGKLRGVLATHALWDWVEEIIRTRLPAKGGLEAFIVDKQNNILSPFEAIGRTRAPAPLPVGQTFRLGAWPDGGDYLYSEAWAQHAGVGWRVIVRQPRQQALAALNQLRGVLLLLGLAASVLLMAAVYRLATSFSRPLEELAEIAERVGRGEEGADWEIHGGAQELRQLSESMREMTTALLARKQQLADINASLEGAVADRTNELREANRLLVAKATQLAKLARNDALTGLNNRMAANEQLQDEHQRYGRSGEPYAVLLLDIDHFKRVNDSCGHDAGDRVLAHLAQVIRQAARATDFVARYGGEEFLLLLPATDAEGAAVLAEKIRAVVEQSQAPDVGRITVSIGLAVAGRADEQPEAVVKRADQALYQAKAGGRNRVEGGA

SEQ ID NO: 5063 - protein, 474 aa, Chromobacterium substugae
MKSDNREAGAAPSAAWAVASLALTMLMPSLDTSIANAGLPALAQALDATFQQAQWIVLAYLLAVTTLIVSVGRLGDLLGRRRLLLAGIALFTAASLLCGLAPTLPALIAARAAQGLGAAVMMALAIAMAGEAAAQGRTGSAMGLLGSMSAIGTTLGPSLGGLLTAGLGWRAIFLVNVPLGLVNFALARRYLPADRRAAKPGRQDFDPLGTLLLALTLAAYALAMTQGQGRFGALGGGLLLAAAAGAALFIRVEARAASPLLQPAMLRQPELAAGLAMSALVSTVIMSTLVVGPFYLSRALGLEAARVGLALSVGPLLSACCGVPAGRLVDRFGGGRVSRAGLLGMLGGTLLLALLPSSLGIFGYLCPMGMTTAGYALFQAANNTALMANAGAARRGVAAGMLSLSRNLGLITGAAALGAVFAAASAHSGAGPAEAAAAGMRATFAAAALLVAAALAISTAGQARARRLLAERGG

SEQ ID NO: 5064 - protein, 314 aa, Chromobacterium substugae
MSKPDLNLLIALDALLAENNVARAAKRLRLSPSAMSRTLARLRETTGDPLLVRAGRSLTPTPRALALREQVGRLVEEAEAALRPAQTLDLAQLARTFVLRANEGFVENFGPALLARVGAQAPGVRLRFAPKPDKDSGPLRDGSVDLEIGVVGKATGPEVRARALFRDRFIGVVRDGHPLAQGEITPARYAAGRHVLASRRGLERGPIDDALAALELERDIAATVAGFSSALALARESDLIASVPERGTGKLRAGMFNFALPLAAPEITVSMLWHPRLDADLAHRWLRGCLLAVCEPPAQTGCTPPSGLAASRCR

SEQ ID NO: 5065 - protein, 206 aa, Chromobacterium substugae
MHAAIRASRLALPLMALLAAVPARAMDCAAPRLSGAETWICATPALLMADMSLNDSYRIAALLAPSRPALRREQQAWLRAREQCRDQRCLRQSYVDRARQLRARIRDWAQPCAVDPRRILGDWESIRSGTFDQFQLAPGHRFHSWLHQRPEFNDKPWTFAASDCRLSIGAGRDGIAFAFLLAQPRPDRLILIDSGSLDAQLYKKLR

SEQ ID NO: 5066 - protein, 183 aa, Chromobacterium substugae
MRGLSLWLYRRSSAPAALVLLLAAAALAWLFNFSDTALSVSRLARLYGQPILDLRPWYSADAVRALLAAYGAAGRQGYLHFLAFDTLFLLCYGAGFALLISLLRRRLPRPGWFNLLPLMVAGADALENLCSYIDLVSYPDFYPPIAWAGGAMTSGKHLLSAASLLCLGYSAWRAGRRAAQAVS

SEQ ID NO: 5067 - protein, 312 aa, Chromobacterium substugae
MGANGRFGMAMVQALRERGWQVRAQTRAGWRGEGRVEEVHCDGHDRAAILAAARGCQVVAHALNPSQYTQACWRRDALPMLDNAIAAAQAAGALLLLPGTVYNFGSSLPATLTEGTPAAPGHVFGAIRIEMERRLATAPGLDSFVLTAGDFFGQGTGVWFDKVIAAGLQRGVFTYPGPLDSVHAWTHLADLAEAFARLADQRAGIRGFNRMMMPGHDLTGRQLQEALQRVLGRPLRARALPWGWLGLMRPFSPMLRSMWGNRYLWRRPHALDGRALRARLGDWTPTPLDTALAQSLRQLGQEVAAEGGACAA

SEQ ID NO: 5068 - protein, 297 aa, Chromobacterium substugae
MDWNLVQAFLAAAEAGSLSAAADKTRQSQPTLSRQVAALEAAMGVSLFERSPRGLRLTQAGEALLAPARAMRAAAAEVATAAEQGRQLLPGTVRVAASEMTAAYLLPDMLSALRRDYPQIAIDIVVNNGLDNLLEREADIAIRHARPAQGALIARQLGELKIQAWAHDSYLARHPPLKRLQDYDWIGMDRSDFLLRRMREAGFDVDRDFFALRCDNQVVGWQLALAGAGVAFAPAATASRFPGMRPVLPELAQGMMPVWLACHRELRQNARIRCVFDHLAASWQNLLASQPPAALRH

SEQ ID NO: 5069 - protein, 400 aa, Chromobacterium substugae
MDTPSTGLSRAMTLLFAVSCGAVIGNIYYSQPLLAVIAHGFGQPAASLGFVVTLTQLGYACGLLLLVPLGDVWDRRRLIVTLLGSSALALLAVALSPGLAWFAAACVALGLCTCAAQLLVPFAASLAAERERGRVVGTVMSGLLLGILLARTFAGLVAQLGGWRLVYWLAAAVVLLFTVILARALPRDGGKPPLRYRELLASLLTLARAHPALRLRALYGALAFACFSLFWTGLTFLLSQPSYAYSEAQIGAFGLVGAAGTLAASGAGRLADRGRGGLVTRCCCLGILLAFGLLWLGGQWLAALLAGVLLLDVCVQALHISNQSVIYALAPEARSRITTVYLVSYFLGGALGSGAASLAYAYAGWLGVCLVGAGIACLLLGLCLAARRNALSGEARLAAG

SEQ ID NO: 5070 - protein, 156 aa, Chromobacterium substugae
MQQSHTTQDARVELTARIIAAKALQDLSWEQLAAGTGLSLAYVTAALLGQHALPKAAADRVCDKLGLDAADSANLQAIPLRGSIPGGIPTDPTIYRFYEMIQIYGTTLKALVHEKLGDGIISAINFRLDIQKVADPEGGERAVITLDGKFLPNKPY

SEQ ID NO: 5071 - protein, 211 aa, Chromobacterium substugae
MQAIIDGFLKFQQEAFPKRSELFRQLASSQSPSVLFVTCSDSRVVPELLTQQEPGDLFVIRNAGNIVPGYGPEPGGVTATVEYAVAALGVSDIVICGHSDCGAMTAISRCACLDHMPAVAGWLRHADAAKAVNAARTHASAEARLSDMVRENVIAQLANLKTHPAVAVALEQGRLRLHGWVYDIGTGNIETLDGAAKRFVPLGDFPHTRAA

SEQ ID NO: 5072 - protein, 295 aa, Chromobacterium substugae
MILRHIRYLVAVAEHGNFTRAAEALHVSQPTLSQQIRQLEDQVGAPLLDRSGRAVRPTDAGAAYLEYARRALRELAAAQRATQEVADLSRGALRLAMTPTFTCYLLGPLVERYAARHPGVKLEIREMTQDAMEAALAADELDLGIAFDTAGAPEIQRQPLFAEKLCVVAGPRHRWRELATPLDARALEQAPLALLSADFATRGHIDAHFRQLGIAPRVAMEANTIGAILETVRRGAMATILPEAIARQDPALHALEMRPALPARTAALLCRRDGYRSAAARACLPLLEELAGQLA

SEQ ID NO: 5073 - protein, 133 aa, Chromobacterium substugae
MSSIQIVQTFLDHVFSGRMAEALALVADDAVFIPSRPQASAKVSLYGTYRGQAGAAQVFQSFAAELKPGEFEVESAFGDGEHAAMHGRLRHYSVATGKPFASDWALIGKVRDGKIVLYHFYEDTAALEEALAE

SEQ ID NO: 5074 - protein, 340 aa, Chromobacterium substugae
MPAVGILAAPPAELRDLILPVPTPAGWDVLVRVDAVAVNPADCRVRRRKADDGARRRCSAGTPPVWWRPAGLRRRRQPGDSIYYAGDVNRPGCNSAYQLVDARLAARRPANWSAVEAAALPLTGLTAWEALFEHLGYAPDAPADGRTLLVVGGAGGVGSIAIQLARLVPGLRVVATASRAESTAWCRQMGAHEVIDHSLPLRPQLEAIGIPAVQSVLLLNRPDEHFAALAELIAPFGHIANVVPFSRPVELNALMRKSASFSWNYMFTRSMFQTADMARQGDILARLTALAEAGRIRSTRREHLGQLSARALGDAHARLERGDAIGKLTLSGFSNFQEPV

SEQ ID NO: 5075 - protein, 281 aa, Chromobacterium substugae
MQWDDVRYFLALAREGSLSAGARALGVEHSTISRRVGQLEAALGLRLFDRLPRGWQLTQKGESLLPQALALETGIAGMLRSASAKNALAGQVRLTAPPQLLNHVLLPLLTTFRQRYPDIDLTLLGERRRARLEQGEADLALRLDVPDTPELIARPLALVGYALYGTARWRQTEASEWLFIGFDDSQAGLSLKRWLGEHAGARRVALRGNDLDTHFQAARQGLGVALLPRFLARAAPELAELDSPPPPDKQLYLLMHPDVRRAPRVRALADFIAAALPGALA

SEQ ID NO: 5076 - protein, 306 aa, Chromobacterium substugae
MPYIKILVVAIFILSTVYVHFRGRVRLGFWRQLSDHSTIMAPINCFMYLFSKVPPKPYLPVERFPELQALTANWEKIREEAVALYDRGNIKASDKYDDLGFNSFFKTGWKRFYLKWYGQDHPSAQALCPYTTELLKQFPNIKAAMFTALPPGSRLVRHRDPFAGSVRYHLGLITPNDDRCYIDVDGQQYSWRDGEAVIFDETYLHYAENTTDQNRIILFCDVERPMWFWPARVINRIVSRVLVGAANAPNEAGDRVGALNRAFRYIQQVRLFGKRIKAQSRFTYYLLKWLILGGPIVLWLFWGSWG

SEQ ID NO: 5077 - protein, 175 aa, Chromobacterium substugae
MPFQTLRHFKNWIVGIFNPPYQLSLCEILPGRQGGGTVYVFKQYGTHDIVKLSHKDIIGNVQILAAINPKDLIGIALYENNLKEAAGECQVLETIRGNQYRIASHGREEVYSGESICGNLDLFQRLPPHEICKIAYETGFSKGRKVSGQLRALAEQGRAEAGAAAANVVPLRSRQ

SEQ ID NO: 5078 - protein, 245 aa, Chromobacterium substugae
MNILQLTDLHLFAARDGRLLGRDTYAALQKVLAAVRALGPDAVDAVFLTGDVSQDESAASYRLAAEALAGLGRPVYWIAGNHDCRSTMAEVFAGYPLLRPLDEVKLAGWTFIGVDSCVAGLDEGLIGADELARLREQLAAVDDGHAAVVLHHHPLAVGTPLLDDCMLRQSSQFWQAARAERLKLVICGHVHGAHSIDYRGRMLEVGPATCFQWQAGASDIDIDDRQGYRLFSFSADGYRVATSLA

SEQ ID NO: 5079 - protein, 238 aa, Chromobacterium substugae
MNEFRLYGLIVGLTVTIMIICDSLVYKTVDVFSLKITASGIVFSLCYLLSTISTEVYGYKLGGRTVWIIVICQTLFVLILNAFALIQPDNNAISKQYYQLFHEFWRVMVGTWISVPASYFCNGFIVSRMKIFFAGRFFFARYLIASMLAQAVLLLTAYPISLSSKYSGHELVNIIATTWSYKVVMSVLLLPLGYYLVSVIKKIERTDYFDWEVSYNPLTVFRDSDGAIERNRFESAKA

SEQ ID NO: 5080 - protein, 221 aa, Chromobacterium substugae
MVKGVEKALPANDDPLAVISGNLASLMQRHGVDAVRLSDETGLGIATINNLRRGVGNPTLSTLVELARYFQVSIGELAASGAKQSALPRQAVFSMPLVGIGHVGDFIETGIADQGDYCAEVVGYAERPLFAVLVNNDTLYPHYAQGTVFVMVRESRPQDGDIVLVTIGANSPCLRRVYVEEDFLLFSSISPQNDVAPSLYKNYQVLAVVLKAIKTLSGGVR

SEQ ID NO: 5081 - protein, 85 aa, Chromobacterium substugae
MHNPNLTECIHEDEFAVDVINGEKVLITLPTMLGQQGSEWEGSPIFGRSYLMSLIRRGIENDVLHPADIQRALSREASLRACSME

SEQ ID NO: 5082 - protein, 784 aa, Chromobacterium substugae
MLRRFLAIMAGVFLGGVVLLAGAAAIAIIITYPRLQSLDVITDYRPKIPLRVYSADNQLLGEFGEERRSFSRIHEVPQLMKQAVLAAEDERFYQHSGIDYLGIMRAAVGNLVSGHARSGASTITMQVAKNFFLSSEKTFTRKFNEALLAFKIEHTLSKDQILELYFNQIYLGQRAYGFAAAAQAYYGKPINELSVAQMAMLAGLPKAPSAYNPIVNPERAKLRQQYVLRRMRELNFITQAQYDEALNEPLKLASQAADTSQPGQYVAEMVRQAMYERYKEAAYTEGFKVYTTLDSRHQKWAYDALRAGLVDYDRKMGYRGPESTIDLPSGGGEDLTEALDEAMGDLRDSGDMLPAIVLSASPSEIQAYMRGGKTISIKGAGLEFARRALSGKASQQLQIRRGSVIRVSANAKGYWEVVQMPEVEGAFVSLDTHTGAIKSLVGGFDFNRRSFNHVTQAWRQPGSSFKPFIYSSGIERGITPSTMINDAPLSVPGINGQNWEPKNDDGKFSGLITLRRGLTQSKNLVSVRVLMAVGTDYAQQYIQRFGFSAKQHPAYLPMALGAGSVTPLQMVEGYSVFANGGYRTKAYFIDRIEDQSGRVLAKTVPTVAGQNAQQAIDPRNAFIMRSMMGDVVRYGTGYRAMSLGRTDLAGKTGTTSDWKDAWFVGFNPNLVAATWVGFDQPRSLGRYGYGGSAALPIWINYMGNALKGQPEVELPVPQGIVVKPGAGQRGGDEYYYQEFQKTNPELHIDNQGTVPGSGDDASAPAADDKPAAQDAVENVKDQLF

SEQ ID NO: 5083 - protein, 359 aa, Chromobacterium substugae
MLEQLGLGQSRNASLLGLDISSTAVKLVELSRNGKNYQVERYVIEPLPKEAVNDGNLVEIDGIAEALRRAWKRLGSPIRSVAIAIPTPMAIYKKLLVPVSQTEELDQMIESEANQIIPFPLDEVNLDHQVLGPSPSSIDDLEVLLCAARKEKVEERVAVVEMAGLRALVVDVESFAMMTAFEQIQHQLPDQGMNQTFAMFDIGATRIHCNIIRNGQQIYYREQMFGGHQLTRDIQRRYNISFEEAESGKRSMAMPDGYESELMHPFIDSLAQEIQRALQFFYTTVSVSQYLRVDYILLAGGCSMLPGLDDAVAGRTQISTMIANPFTTMVQSSAIRLKELLMDAPALLIACGLALRRFD

SEQ ID NO: 5084 - protein, 190 aa, Chromobacterium substugae
MIRINLLPHREQRKAAHRLRFQLLLAGTAVSALLLVGIAYLVLEHQLSRQEQRNRYLQAEIGRLDGQIKDIGKLKKQRDDLLARKQLVERLQEGRNEAVHLFDQLVRQTPDGVYLRSFRQNGNQIVLTGFAQSGARVSSYMRMLGQSETFEAPVLVEVSSSIVNNQRVSAFTLNASLRQAPAGGPQGAKP

SEQ ID NO: 5085 - protein, 205 aa, Chromobacterium substugae
MTLDELRGLDPKDMANWPLQAQALMLAILTLLVAGLGYFFVLGDQLDHLNQARLQEAQLKQTFVDKKRQAVNLDALQQQLREIDASFGALLKQLPTKSDMDTLLTEINQAGLGRGLQFELFKPGSESRSAEMAEVPISIRLSGSYNDLAAFVNDVAQLSRIVTISDISLNPGGGKDNRLTMDATARTYRALEPSERSGLPAAQPK

SEQ ID NO: 5086 - protein, 172 aa, Chromobacterium substugae
MKKTCVCLLPLLLSGCGGPGTEDLQQWMASSSQGLRGQIEPLPQVQTYKPFNYQAYDLLDPFNAQKLQAGKQQNSANAPDLKRPREALENYDLDKLAMVGTLKRGDSLYALVRTPEGAIYRIQPGNYVGPNFGKVTAIHDSEIVLSETVEDLNGEWVQRDSSLHLDEQGQNK

SEQ ID NO: 5087 - protein, 697 aa, Chromobacterium substugae
MKKLAIRWMAGLLLSLAGGLAAAGPAITAIEPGKVDGNLQLVQITFDGPAVRPGSFAMSNPPRIALDFAGASVKLARPAINIDSALLKSAVAVEAPGRSRLVLSLARNASFRSVVNGNKLLLTLDGSMAPALDATPQEQTSAAAPQAAGQAQIGQAGLDFRRGANGEGRVELALPNANTPVDVRRDGKNLAVDIAGAVLPRQQVRRLDVTDFGTPVAKVDAANQGNNIRIQIIPQGDWDYSSYQTDGKLVVEVRRPAPETLANSDGGKPVYKGDKLSLNFQNIEVRTVLQVIAEFTGLNIVTSDSVSGNITLRLKDVPWDQALDLILQTKGLDQRRNGNIIQIAPRDELLARDKQLQEARQQLATLEPLRSETFVLRYRSAEDFKKVLDGDNTSGKKESLLSERGSVLIDPKTNTLIVNDINAVIDKIRDVIAKTDIPVKQVLIEARIVEATDNWERDLGIQLTYDRMDPKGIISGSPLGTAVNNVTNLNTGQPYVIQTTPAGVNLPIANPSGTLTALYNVGHSVILGLELQAMQAEDKGRIISSPRVMTADRQEATIEQGTEIPYQEASSSGATSVSFKKAVLSLNVKPQITPDNHVMLDIKVNKDSANFQQTVNGTPSLTTEKIETQVLVDNGGTVVLGGIYQQQLDNVVNKVPFLGDIPLLGALFRSSQKIDKRSELLIFITPKVVNDLIVAGR

SEQ ID NO: 5088 - protein, 180 aa, Chromobacterium substugae
MERLAGNFFLVGLMGAGKTTVGRALARRTGKTFYDSDQEIEARTGVRVATIFDIEGELRFRNRETCVIRDLAQQSDIVLATGGGAVLRQENRQVLMQYGTVIYLRAPIDDLLARTQHDKNRPLLQIADPRAKLESLFNERDPLYREIADVIVDTTQQNVNLLVSRLIDQLQPPITKEADS

SEQ ID NO: 5089 - protein, 359 aa, Chromobacterium substugae
MITLDLILPDTRYPIHIGHGLLEQVELLLPHLPIPKVAIVSNETVAPLYLARLRQALESRGVACASIVLPDGETHKDWQTLNLIFDALLSGNAERKTTLIALGGGVIGDMTGFAAACYQRGAPFIQIPTTLLAQVDSSVGGKTAINHPQGKNMIGAFYQPKAVIADMDLLATLPDRELSAGLAEVIKYGLLGDADFLAWLEDNMARLRARDSAALQYAVRRSCEMKAAIVTEDEKENGARALLNLGHTFGHAIEAGLGFGAWLHGEAVAAGMVLAAAASAELGWLAAADLDRVRRLIAAAGLPVTSPAMPVHRWLQLMSHDKKVEAGTIRFVLLRALGQAVIQPGLADSLLEKILRENS

SEQ ID NO: 5090 - protein, 127 aa, Chromobacterium substugae
MDVFTALASSLALMLVYYSLRQFWRRLRYTKPVHRGIDPVGEAEVYLAYGRTKEAVRVLKDSLKDDPDNLHAKVALLRAYSSARNSEAYVLLARDVQAQVQDQPVWHTIQENGRQLAPQDPLFDAKL

SEQ ID NO: 5091 - protein, 413 aa, Chromobacterium substugae
MAIERQRDLRYDWLVWGLTFIVIALGFVWRGSATIVACLLSLIGIALSFRKNYFKICWDLYRPWIFAMSILGLAIICRELISGDPRFRFADSASRTMLAIPLFVAMCHSARFDLKSARWIFAAAVFLMLIFGYWNMTHGGDLRIATAFTNTIPYSAFCLLFGTIFFLYSYSLGGWNRVASIVVIATTYLVLYFSESRGVWAAGVVAALFLFTTVFGFNWKSFAGILLLVFALLVLSYFCSAIVKYRIDLAVSEYHAFFVGKKDGSVSMRMDMALASWHIFKMHPIFGVGRDLPPVMHALYEQGFVGLPVADAADTHGELFFNAASLGSVGLLAYVIFYVGGSYPYWKAAVSGEPELVKIGKIGLVCNVIFFIVGYTHITLGLVMYASVYATVQAVLLSTLYKLQYGKASQVSA

SEQ ID NO: 5092 - protein, 206 aa, Chromobacterium substugae
MGKEIQKYYGIDEAKIKVLYPPVDTHKFSLDARANREEVRQKLGIRPNQFMLLFPSNNHDLKGADIILDAIGRMDEDVVLVAAGKAPLKSDKVINAGFCDEMPPLYAAADATILASKYEAFGMVGPESILCGTPVLFADTVGATEILSEPGCHVFKRDAAALRTCLERVVRQAKHLERDPASLASQSIHYPYSLEDHVLDLLALLE

SEQ ID NO: 5093 - protein, 280 aa, Chromobacterium substugae
MISTYNRPDALDAVLSGFHHQSGMLAGDWEIIVADDGSGPATQAVVKAHQKIFHDRLQHVWHEDLGFRLAEIRNRAALQARGDYLIFLDGDCIPQSDFLFQHAKLAERGWVVAGNRVLMSERFTLSYVSGECRPVSNWTGFSWLAHRLRKNINNFLGWLRLDLPKWRKKRKDSWKLLRGCNIGVWREDYLMVDGFDATFSGWGYEDSDFAVRLIRNGVGIKNGRFAMPVLHLWHKENDRSFEGENWRRFEASIRSEHVKALKGISSLDIDPGWLSNGKSE

SEQ ID NO: 5094 - protein, 182 aa, Chromobacterium substugae
MPRCRHAWVLNLDADERLEPDFIAYVKNTDLDALGVDLVETRRRNYIGDRFTPYAGQYPDYVKRLFNRHRADFTPVVAHTCVKAATSTKVAVHITHYSYRNYPDMIAKCKYAEWLSVGLAKSGKKIYPWHPALHGGWAFFRHYVIKLGFLAGLDGLTLSMCKGIGSYLKYAHALELRRSGKV

SEQ ID NO: 5095 - protein, 582 aa, Chromobacterium substugae
MSFLDNKTSFALYKRVMLYLRPYWKVFILSMLTMTIAAATEPMFARLMKPLIDGGFVNRDPHAIVWTPLAIVGLFMLRGLTSYINEYTSSWLSGHLVQTLRQEMFARMVRLPVNYYDNNQSGSIVSRVVFDVTQISEAGFNVITVVIKDGITVIGLLALLLITDWRLTLICLAVMPIVAWCVRYVSKRLRGLSRKNQQDMAEMTQILGESIDCQRVVKVYGGQDYESERFSRSAESIRHNMVKERATSAASTGVTQLIIACALAVILYFAGTLAQHGSFSAGDFMSFLTAMLMLFAPIKRITSISQTVQKGLAAAESVFKFLDERAEPDEGRIRLGSTKGNFRFKQLSFQYPGAERPALRDINLDIRAGETIALVGSSGGGKTTLASLIPRFYEPTAGQILLDDVPLTQISLVSLREQIALVSQDVVLFNDTVAANIAYGRLGDVTRDGIREAARAANALDFIEAMPQGLDTLIGENGTRLSGGQRQRLAIARAILKDAPILILDEATSALDTASERLVQSALDNLMKNRTTIVIAHRLSTIESADRIVVMHQGEIAEIGKHQDLLDKQGIYSKLYLLQFGS

SEQ ID NO: 5096 - protein, 347 aa, Chromobacterium substugae
MHHGDVLLTSPVFTVLKNHAPHIEIDALVYHETREMLTLHPAISNVFTIDRGWKKLGAWARLRHELALYSSLKARGYQLIVVLNDNNRATSLVRLLKPRWSVVPDVPDRGRFFRKTFTHRHGLVLGNKRHIVEWHLDALRRLGIYPKEAETALSVVPGAEAEQSVSALLQANGVAAGRFILVHPGSRWFYKCWPADKVAGLINALHEQEWQVVLSGAPSAEENAMIREVRAGVRRPVVDLSGQLSLKQLAALIAQARLFIGVDSLPMHLAAAVQTPVVVLFGPSRDKVWGPWRVPHRQVSLDLPCRPCNLAGCGGGERSECIERIAVAQVLAEVESLLAETRPSHAC

SEQ ID NO: 5097 - protein, 579 aa, Chromobacterium substugae
MSIILHGVAIGGGIAIGRAHLISRSMDDVAHYLLEEGEIPAEKARFDEAVRATRKELEMLWGSIPENAPAELGAFLSLHIMLLGDVTISREPREIIEKQHCNAEWALKLQCDHLIEQFDAIEEDYLRERKNDVLQVVERIFKNLDGDAPQLPAQEDLVDDHILVAHDLSPADMVYFKDSNFAAFITDVGGATSHTAILGRSLDLPSVIALHHGRELIREDEMIIVDGLQGVVIINPDTLVLNEYRRRQRAWRGARRKLSSIRKSSAVTRDGSVIELLANIERPQDVDDVRESGAVGVGLFRSEFLFLGRDTLPTEDEQFEAYRHVAVALKGMPVTIRTMDLGADKSPKWLGHDQADNPALGLTGIRLCLAEPLMFRAQLRALLRASAYGRIRVLFPMVNSLPELRQALAQFEYAKSELRDEGIGYAEDIEVGAMIEIPSAALVAGSFTKLVDFLSVGTNDLIQYTLAIDRNDDTVSHLYDPIHPAVLKLILHTIKCGIKANVPVSVCGEMAGDAKLTRLLLGMGLRKFSMHPANLLSVKQQVLTTHLDEIASITTRMLRSEDPDKIADLLQLLNAEPGD

SEQ ID NO: 5098 - protein, 89 aa, Chromobacterium substugae
MLRSEVEIINKLGLHARASSKFTQLASRYKSDIFIARNNRRVNGKSIMGVMMLAAAKGAKVELEISGEDEQQALEALIALINNRFDEAE

SEQ ID NO: 5099 - protein, 135 aa, Chromobacterium substugae
MVGVLIIAHGDLGRSLADCAKHILGREPDNLAVMVVDKTEDPERKLAEAQGLVDGLDQGDGVMVLTDMYGGTPSNIASRLIRPGRVEAVAGASLPMLVRALCYSSQPLEIVVSKAITGGLEGVLYIIPGEGNAAI

SEQ ID NO: 5100 - protein, 470 aa, Chromobacterium substugae
MDFFPIFLKLQQQPCLVVGGGEAALRKARLLAAAGARLQVAAPALAPELAEMAGRGELTHLAGAYAAEQLRGQRLVVAASEDDELNRRVARDAEALGVLVNVVDDAEASRYITPAIVDRSPLMIAIASGGGVPVLVRMMRARLESLIPGAYGRLARFAAGFRERSKQRFPDVDQRRRFWEDALEGPLADAVLNGHEEQAAAEMERRLAGAGPETVGAVYLVGAGPGNPDLLTFRALRLMQQADVVLYDKLVAPELLQLVRRDAERVYVGKARANHALPQDDINQLMVDLARQGKRVLRLKGGDPFTFGRGGEEIATLAENGVAFEVVPGITSASGAAAYAGIPLTHRDYAQSVTFVTGHKQDGSIALDWPALTRPQQTVVVYMGVSTAAELCQAFIANGRAAATPAAAVEWATTARQRTVCGTLSTLPGLMASHGIASPALIIVGEVVELADKLAWYRRSENSAVTIQED

SEQ ID NO: 5101 - protein, 42 aa, Chromobacterium substugae
MAGRGPGRLGEEREQTGEDGQGGGSAGQTALQAKGGKPKREF

SEQ ID NO: 5102 - protein, 615 aa, Chromobacterium substugae
MSQAGWLLAMLVTALWLRGRQQRRKARATLQDACLGLLEFDLARQYVRGSVHTLQRLLGLPAHTRGMDCARWLTLLHPEDRPRFGELLRQPPQMPEAGYELRIRHYSGHWEWLEMSLQPTWRAGKVSALTAICRVITARKHSEAAMMRREQQFRTLVENSEDIIARYDLELHCLFINRSVSRFSDLPLEEHLGKTPREKGWTDEASTRFEMECRQLINNWEARSFELELYKDQQRHIFEIRLFPEFDSAGMLKTILSVDREVTASRQGERLLAEENAVLEMIAGNHPLPQTLNQICQMMESQQPRGLCSIMLLDEDGAALRFAAGLSLPPAYRKEVERVAVGPSAGSCGTAAHWKRTIVVDDIQESPLWAHARHKAQPFGLRACWATPIFSSDRRLLGTFATYYREPRSPTPEELALAHRSTHIIAIALQRHGHEKQLFRLATQDSLTELSNRRQFIELADREVERSRRNHGPLTVLMMDLDHFKDINDLHGHALGDDVIRHFAQLCREVLRASDLCGRLGGEEFAAVLPDTRLEDALLVAERLRAAVAASRLPTDDGELGYTVSIGAAMRLPAESDIDEVLSRADKLLYQAKRAGRNRICADLDAPAANAPLSG

SEQ ID NO: 5103 - protein, 279 aa, Chromobacterium substugae
MAAFPTERPAVNHWHAAYLSHPLYAPLRPLLAGLTPSDWPEQPDYDRLLAAARAAGRPLPPALRFVCGLEPDGYYESHIAATGEVPTRRQNWHDWFNALAWLAWPQAKSALNRRHARALSRGETRRGPLRDAATLLDECGVIVATADPELGRALDDMRWRRLFIERRADWGRSIAAHTLGHAVMEMGLTPHIGWCGKALILEVAPDFFARDDAARQRLLDAALAARLDDDAFLASPRALCPLPLLGIPGWWPDNQDPAFYDNTGYFCPTRRAKSATVSA

SEQ ID NO: 5104 - protein, 402 aa, Chromobacterium substugae
MQVQRFEPYFGFARFLARRMGGLRVLQVSGSLTFTTLLALVPLFTIALTVISAFPVFSDYSTRFKIMLLSTLVPEFAGKVITVYMRQFADNAEKLTAAGIVMLGVTALMLMSTIERTFNAIWGVRRGRPWLQQGMVYWTVLTLGPLVLGGSLLSWRWLFRVTRFEKNLPLLASLVEAGGTIVLTALVLSLLYRIVPNRFVPIKHAIWGALATSVLLEATKAGFGFYIGQIASYQLVYGAFASIPIFLLWVYCLWLVVLAGAVFTSALSYWEGDAWRRRNQPQRRFLDALAVLLLLDAAHARGEAMTPPQLRQAVKVGYDELGLVLDKLARRGYVQKGQGDAWVLMKRAAAIPLSELFELFVYRRDLGRGDALGTALAELLAPLTGGLQAETVADFARRVGQK

SEQ ID NO: 5105 - protein, 198 aa, Chromobacterium substugae
MLDILVLYYSQHGATRELARLIARGVDSVPGCQARLRTVPKVSTVCEASEPAIPENGAPYVEKQDLIDCAGLALGSPTRFGNMAAAMKYFLDGTSGEWMQGALSGKPACVFTSSASMHGGQESTLLTMMIPLLHHGMVIAGLPYSETALAATQTGGTPYGVSHVSGLDNRQAISEHEKALALAQGKRLAELAVKLAAN

SEQ ID NO: 5106 - protein, 260 aa, Chromobacterium substugae
MRGKPRDYPAGLETPRHNHPTAQLLCAVEGLMLVSAERGQWVVPPTRAIWLPIGAWHQVKMVSDVRMRSIYVREDKLQGLPEACCVLEVTPLLRELVVAAMAVAVPCAAGSRDEKVMDLLLEEIARAKVLPLSLPQPSSAALRQLCDGWLAQPDDARGAAEWARELALDPRTLQRRFRRETGLSFGQWRRQARLMLALQRLACGDSVLKVALDLGYASPSAFATMFKRELGAPPSSFLAVSGASPRRGDAPVGVRFADEI

SEQ ID NO: 5107 - protein, 399 aa, Chromobacterium substugae
MTASTQLAAPAQDTRFRVLGAISFSHFLNDMLQSLLVALYPLLKGNYHLSFAEIGLLTFTYQCTASLLQPLVGIYTDKKPQPYSLVFGMGSTLIGLLLLSSAGSFPLLLLAAALIGTGSSIFHPESSRVARMASGGRPGLAQSIFQVGGNAGSATGPLLAALIVLPLGQGSVAWFSLAALLAMYVLFRVGQWYAHQHRQAKKGAAAAKPALPPGRVKLTLLLLLLLVFSKHFYLASITSYYTFYLIHHFHIGVQSAQLHLFLFLFAVAAGTVLGGPIGDAIGRKRVIGFSILGIAPLALLLPHADLFWTSVLSFPIGFILASAFPAILIYAQELLPGKVGMVSGMFFGFAFGIGGIGAAVLGELADLNGIEFVYQLCAFLPLLGLASLALPDLHRQAKA

SEQ ID NO: 5108 - protein, 180 aa, Chromobacterium substugae
MRRFVCQLAIASVALSASFAAMAKEYPIGKPTLKNGMEIGAVYLQPTKMDPDGMMLKPEASDIHLEADIHATKNNPNGFEEGAWMPYLVVKYELTKVGGKTQKGDLMPMVANDGPHYGDNVKLQGPGKYKLKYTVMPPSANEHAHFGRHVDKETGVAPWFKPFEINYEFTFAGIGKKGGY

SEQ ID NO: 5109 - protein, 111 aa, Chromobacterium substugae
MTVLRLLAAALLAGLFSASALAEEMPVFKLEIKDGYFKPARLVVPAGKKFKVEVMNTGKTPAEFESTPLRKEKVLGPGAESFLVFQPLSPGEYKFFDEFHMKTGQGVIVAK

SEQ ID NO: 5110 - protein, 274 aa, Chromobacterium substugae
MGQVLFIVWRESVEALLVVGILNAWMNQNEAGRAGKPYLWGGVALGVALAIALAVALFAASSLMAGAQDYFQLGMVFIAAALIVQMVLWMREHGRTLKKELESGLSENARSDNWWGVTVLAALAIAREGSEAVVFLYGMLAEAQGMELAKMGVAGLVGLLLAFLTFYLLQLGGKVLSWRLFFRVTEIMLLLLGASLFLNGVEKLISMDILPPLVDPLWDSSALLDDMSPFGGVVASLTGYRSHPALTSLIAYALFWLAIWSLFQWRNRRQAAAA

SEQ ID NO: 5111 - protein, 482 aa, Chromobacterium substugae
MKADPKRLRPQRVIPIVAAPGGGSCSPQRQPRGLLALAGIWLRDHAALLRKLQWAVVLVYAFLLIVPACLPLPEDTARMWDNLTIFAQFVFWGIWWPFVLLSMVLFGRLWCGVLCPEGALSEWAARKGMGRPIPRWMRWGGWPFVAFVLTTVYGQLVSVYQYPKAALLVLGGSTVAAVAVGFVYTRGKRAWCRHLCPVNGVFGLLSKLAPLYYRVDEAAWKASHERTPAVDCAPLQPLRHMQGGSGCHMCGRCSGHRDAIELSLRPSNDEVVRVAEKEADGWQTALIVYGLLGVAMGAFHWTMSPWFVSLKQAAAEWLVDRDIMWPLDTGAPWWLLTHYPQHNDVFSWLDGASLIAYVAATALVLGSGILACLALSVTVSGRWHTQRLHHLAQALIPLAGCGVFLGLSALTVTLLKAEGFAMHWVNDARLALLAGANLWALRLACGILSRWRGGLSRLAALLPFCGALALVDCAWGYMFWWW

SEQ ID NO: 5112 - protein, 253 aa, Chromobacterium substugae
MRRLLPLVFALSLGGPAAAQPAVELATGEWPPYVSQSLPQDGVFSQIVRQAFQRAGYPVHFTYQSWPQAEAAAKAGRAAAAFPYRPTPEREQDFDFSAPLMRSTSYLFYHKPHMPHPPPQFKSLDELRGYRVAVQLGYWYIPLFQQHKLNTLLTSDEVNALRQLQLGRLDLAPMTLERGFFLIHSALPGHEKEFGYIPTPLDKETPLGLMFSRGYPQVARIREDFARALESMEKDGTLKAIYQRNFPEVTPPR

SEQ ID NO: 5113 - protein, 159 aa, Chromobacterium substugae
MSSKAPVTQAVRALREHKVDYTEHLYKYEDKGGTTVSARELGVDEHAVVKTLIMEDDNKRPLIVLMHGDREVGTGMLAKQIGAKKVHPCDPKTADKHSGYQVGGTSPFGTRHPMPVYMEASIAELPLIYLNGGKRGFLVGVSPQEVIRVLNPTLVNAAA

SEQ ID NO: 5114 - protein, 205 aa, Chromobacterium substugae
MTTLRMKTPAAPADRRLAVGKVLLFIACLLPLMRAAWIVLMGEAVNPVEFITRSTGTWTLVWLLATLAMTPLRRLTGQAWPLKCRRMLGLFAFFYASLHFTTYIWLDQFFDWHHILKDIAKRPFITVGFAAIALMSPLALTSTQGWMRRLKRNWGKLHRLVYPVAILAVTHYWWLVKKDVTQPLIYAAVLACLLGLRLWWRARKA

SEQ ID NO: 5115 - protein, 305 aa, Chromobacterium substugae
MLIRKPADHLPSEITPEKVYFNRRQFMAGAAGLLLSAETLAGLNARKSPLSQLAANDKPNSLKDITSYNNYYEFGTDKSDPAENAGSLHTRPWSVLVDGEVAKPRRFSIEELLKFPLEERVYRLRCVEGWSMVIPWVGFPLASLIKQMNPTSRAKYVSFETLQRPSEMPGQRQAVLDWPYREGLRIDEAMHPLAILAVGLYGNALPNQNGAPIRLVVPWKYGFKSIKSIVRIRLQETMPATSWNMANAHEYGFYSNVNPDVDHPRWSQASERRIGEFFKRKTLPFNGYAEQVAGLYRGMDLRKNY

SEQ ID NO: 5116 - protein, 144 aa, Chromobacterium substugae
MKKQLAIALTVGSLLLCQSALARREPLEQPQRVTLTAPNGDVGKTKAAIIRAASGLQWNVVADQPGKLTFKHVKGNIVLVLDVSYDATGYQVRYASSENLSYQETETGARVHPTVNRWMDNLVRHIGGDRTDGDDDDKPASAAE

SEQ ID NO: 5117 - protein, 252 aa, Chromobacterium substugae
MPSKLKYQIQPAPEVDTATLRRLHALRLAQFPFRRADPAREAAMWREFQDSYRQRAAWSVIFRDADGAPRGFWLAVCERPRPPAPRGVLLRVDYLYTEPGWRGSSVLIASTLRLLWRTKLQAPGLPLWFGCICFPNSFIRVAATFEQVRTLADAPLAAADRALLLQLGADAAGARWRAASGLADFSDHHPPALAAGIADTPRLARHLARYEAANPDWRRGMAMPMFCRIGLATAIRGVWHTLRRAWRRKPAA

SEQ ID NO: 5118 - protein, 60 aa, Chromobacterium substugae
MFGRLFKFFVLCLVLWAVARWLLRPSQRRTLHELFSALAIALLISAALFCALYWLGWHQL

SEQ ID NO: 5119 - protein, 380 aa, Chromobacterium substugae
MTDTNCSVGIVAPQDAVFDVPLPLASGAVLPSYQLRFETYGALNAGRSNAILICHALSGHHHAAGRHHPDDKAAGWWDNMIGPGKPIDTDRFFVVAVNNLGGCHGSTGPSSVNPATGQPWGSAFPVVTVADWVSSQARLADRLGIERWAAVIGGSLGGMQALHWSIAYPQRVAHALVIASAPKLSAQNIAFNDVARQAILTDPEFHGGDFYAQGAVPRRGLRLARMLGHITYLSDDGMGEKFGRMLRSGEYRFGYDVEFEIESYLRYQGDKFSDYFDANTYLLMTKALDYFDPAKEHGGDLAAALRQASASFLVASFTSDWRFAPERSRETVKALIAAGKRVSYAEIESAHGHDAFLMTDPPYVDLMRAYLSRVAEEANA

SEQ ID NO: 5120 - protein, 197 aa, Chromobacterium substugae
MNHPALRPDLRIIYDWISPSSRVLDLGCGRGELLAALQDGKQVQGYGVDFDVANVVGCVAAGVNAIQGDLETGLAEFEDQRFDHVVLSQTIQAMRHTEAILNEMLRVGREAIVSFPNFGYWQNRWQILQGHMPVSDTIPYQWYDTPNIHWCMLGDFEALCAKNGIRIVQRVVMDKGKRVSLLPNLRGSLAFYRVARG

SEQ ID NO: 5121 - protein, 62 aa, Chromobacterium substugae
MRLLLAIFLPWLQFFTIGRPFAGLFCLVLQLTLIGWIPAALWSVYALSQYKTDQKIAKALRR

SEQ ID NO: 5122 - protein, 425 aa, Chromobacterium substugae
MTLASIHWRRDVFSRAMLVCVFTGFASGLPLYTLINLLPAWLRSEGVDLKSIGLFALIGLPYTWKFLWSPLMDRYALPLLGRRRGWMLASQLALLFALGLFGLFDPRADIWNIAALALAVAFFSASQDIVLDAFRREILSDAELGLGNTIHINAYRLAGLVPGSLSLILADRMPWGGVFVVTALFMLPGALMTLLVKEPSLAAGSPKTLREAVVEPFHEFVTRQGWQGALWILGFIFLYKLGDSMATSLATPFYLDMGYAKSQIGLVAKHAGLWPAVAGGLLGGLWMIKMGINRALWAFGVVQVLSILGFAWLASHGRFDSVGAEQLGMLAAVISFEALGVGLGTAAFVAFIARSTHPAYTATQFALFTSLAAVPRTLANAATGYIVDSIGWTSFFFLCTALAIPGMMLLVKVAPWGDDPAASKA

SEQ ID NO: 5123 - protein, 141 aa, Chromobacterium substugae
MKTNVGGFSLLELVGCMAIAALLLAVALPGYQSYLQRARLEEARSALLEDNHFMQRWYHEHGVFHQEGPLAWPALPVIETAAFDIGFSSALPSADNVEQTSFIIEARAKTGSGLEEWLLKLDQDGNIRQCRQDGGGEQCRP

SEQ ID NO: 5124 - protein, 215 aa, Chromobacterium substugae
MRASRQRGGALLLVLSLLAALSMLALSSSQLTISAQRLADNVQDRRRAQLLARQALLGAEDWVWRLDRRLDMAALAARPAELYGEGRLFPPSCHGPQGKGLCEPKEPPERRANGAVPLLHPCGNSRAFPLEPEPAQSRCPQQVRSGGLSWANPRYVVELIDPGFLARDGSPGRLYRITVRAWGRTPYSSVTLQSWYRVGDGEAAGRRLNWEERRE

SEQ ID NO: 5125 - protein, 405 aa, Chromobacterium substugae
MCATPSCAAASTTRWPTWPAPSSPGRTACGRIIWKAAMTIIRLASARGRALPRSWRPPISAISSRRCARAAAAPNRGRWCAAATAACRPPSPGRAAARRGSWRYGWPGAAAPAGNGRSMPVSGRCSPERARQRGSLLLGQLVALALLSYVLAQAVSSYGVADRAVRLAGQGLERRQEARWAMRQLAQDLSMHGRLGCAQEAWRREDFGQTAWTLSLPGRWLRHRQAVLDDAGGLSRLLLEPQDSDWRAWRESRLVSCGQSLRLAGGEASWSGGAATPSLELSPALAAGSLHLPSLQLWLPRQRQYRLLRPGRSGQLLMRDALGGIADGGERVALDGVKSLSLRVLAQTGCGPDARWAWRGIDSLTAGEAGRLAAARVTMEWYPDSGEDKVIKLSHDAALTPLQPC

SEQ ID NO: 5126 - protein, 180 aa, Chromobacterium substugae
MGIAKQAGISLLEWMTVLAIVAIGSGSALPLLDRSLERQRLRGHGLALLGSLQYARAQALRRNQPVYLCAANLKRNRELQGCLPPQAGPQAVWPEGALVYADRGAGNGYYDSGERLKLAMFDGARVAVRAPARQLTLTAEGRLREAGAMVFRLSGGRQCLALTLAEDGRARLGEVSDDCG

SEQ ID NO: 5127 - protein, 927 aa, Chromobacterium substugae
MIDGSSYLYRAFHAMPDLRSPDGRPVGAVYGMVNMLRRLEKEVEFDYSACVFDAKGKTFRDDLYPEYKANRPSMPEELASQITAVHDVVQASGWPMLVVPGVEADDVIGTLARLGAAAGMKVIVSTGDKDMAQLVTPDVTLVNTMTNELLDEAGVKEKFGVPPNRIIDYLTLIGDKVDNVPGVDKCGPKTAVKWLEEYGSLDAIVAQADSVGGKVGENLRAALDWLPMGKRLITIDCEVNLATDLPHGLPGLQHGRKDKPRLAELFQDLGFRTFYREVTEGAEMPAVAQRGEDAPAAPRGDQAQGDMFAEPAAAPAAQAAPAEAALTRHYETILTEAQLDAWLEKLAAARVVSFDTETTSLDPMQARIVGVSFSVEAGHAAYLPLDHHYAGAPEQLGLDAALAKLKPWLEDASQKKCGQNLKYDCHVLANHGIALRGIADDSMLASYVLESHQRHNMDDLARRHLGENTVSYEDICGKGAKQIGFGEVDVDIAANYSAEDADITLRLNQYFAGELSGDLEKVYRDIELPVAEVLFKMERHGVLIDRDKLAAQSHQLGSQMLELEQQAYELAGQPFNLNSPKQLQEILFGKLAIPTKGVKKTPSGGYSTDESVLEQLALDHPLPKCILEYRGLAKLKSTYTDKLPTLIYPQTGRVHTTYAQAVAITGRLASNDPNLQNIPVRTAEGRRVREAFIAPAGWQIVSADYSQIELRIMAHLSDDEGMLKAFASGEDIHRATAAEVFGVDLGAVTSDQRRAAKAINFGLIYGMSAFGLAAQLDIERSAAQQYIDRYFMRYPGVAEYMQTTREKAREQGYVETVFGRRLYLPDIKLSNPGRRAGAERAAINAPMQGTAADLIKLAMIAVQAWLERDGLQSKLIMQVHDELVLEVPQAELELVKRRLPEIMAGAAALKVPLLAEVGAGDSWEAAH

SEQ ID NO: 5128 - protein, 242 aa, Chromobacterium substugae
MSLSDKLPQTSDRHAMMQRFRSREAWHVMKILSEFVESAEELQGITPAVSIFGSARTPRDHKYYKLTEDVARRLSDSGFSVISGGGPGIMEAANKGAFYGRSPSVALNIVLPHEQKPNDYQDLSVKFNHFFSRKVMFVKHAIAYVVMPGGFGTLDEMFEALTLIQTGKSRKIPIILCCSEFWTGLLDWVKDRLVSEGMINPDDLNLIQLIDDPQQIVDTIFKHYETRGFDALPEEREQLLNL

SEQ ID NO: 5129 - protein, 109 aa, Chromobacterium substugae
MRRLTALLLLLPLAPAFAADASAPAKAVVPPPPIISQDNSAEPEPEVRLIQKGDEKIEEYRLNGQLYMVKVTPGHGVPYYLIDDNGSGTMKQVDPATRIMIPRWVLVRF

SEQ ID NO: 5130 - protein, 313 aa, Chromobacterium substugae
MSVYTTVSRESLQQWLQGYALGQLLELQGIAAGITNTNYFVTTTHGRYVLTLFETLQLDELPFYLSLMSHLARHGVACPAPIADHTDRFASTLAGKPACLVTCLQGADVSAPTAAHCRAVGEMLAQMHKASATFPLKMQNPRGPRWWSRVAQQLYPQLPAEEADLLRAEIQFQDGHRFDHLPSGVIHADLFRDNVLMNGEQIAGFIDFYYACNDILLYDVAIAVNDWARRDDGSLDDALAKALLDGYQSERQLNPDERASWPVMLRAAALRFWVSRLQDLYQPASGELTYTKDPAVFRQLLRDHGQRTVFWLD

SEQ ID NO: 5131 - protein, 91 aa, Chromobacterium substugae
MLLKKIITVTLAVMLASPAFAAGEETVGGTAGTAGTAGTATAGTAGIAGTTAGIAGLSVGTIAAIGAAVAAAVAVSSNSNSSSSHSAATHH

SEQ ID NO: 5132 - protein, 949 aa, Chromobacterium substugae
MQNKSRRYLASGVLQGGLPLLFACSAIAQPSLTGQMGYVNMPSARVGEDGTFSLGYGYDKPYGVLWTSTTVLPWLEVSGRYTSISGIPGFDNPQYGGNYGRYKDKAIDLKFKLWDESALMPEISLGTTDIVGNRLWKSTYLVASKNLLPGLEASLGYGKDRIQGAFGGLRYTPQALPNWSLVAEYDANNYRQDPYESSTLAADRKKGPVVGIEYQWGWLGLQVARQKTLNSVNAHIDIPLNVKEFVPKIQEPDYFRGGPDLPSRPTLAQWKDSGDYASQLATALAKQDFKNIRIAMQRDALVLELSNSRISNVGRAVGRAVRTALYFAPLETREIKVVYTEFEQPVATYSFYDMPTLNDYLLGKANRARFLETVNIRPGRDEETQPLASQSLAQGLKESIQLNLLTNQEGDLVQVTSNDAEDNHFHMAPKFGVYFNDPSGAFHYDIMAEATYKRRLAKGLYLDSALSADLYNTITAVTQPSNSLLPHVRSDIADYKRVKAPKLNRFMLNQYMTLSPNTYARASVGIYEEMYRGAGGQILYYPGVKNWAVDLTVDALQQRDVQGWFGKRDYQTITALAAMHYQLPLGVTATVRAGRFLAKDDGARLELKRRFHSGIEAGFWYTKTNGNDITSPGTPSKPYNDKGMFFTIPLNSLLTFDSRTAGDFSLSPWTRDVGQMVMTPGDLYEILSDPKRDINAYDGLGNFAERPDEQNLPAVNPPQPSYHPWPMIRMRLEDSGTQWLQMDDKAAALGTIGFATLTAMALDRSVNRAFQQHEQNRLVKDWGKLGKDLPYAAAALSGAAFALGDDRLSNTGLIALESSAAAVAGSELLKGLVNRARPDAGAGPWSTQPSGESRLQSSFTSNHAAVLFAAVTPFAKEYDQPWLYGVAAFGSVGRLASRDHWLSDVTVGGFLGYLVGNWLWQAQRDDSRYRSNVIVSPKQVGVQLQIPIQ

SEQ ID NO: 5133 - protein, 636 aa, Chromobacterium substugae
MALCLLAISSCPQAAGGGNVSYPSTTMPGYETDNNNGLPAINSLPTGQQAFDKPFPQLQQQNGRSNQAYPQRNQPYLDDNGYELNPLNGKPKLPPFADYVQKATEQTLPIFGSKLFRNPYNNFESADGVQVNPDYVIGNGDQLQIKGWGMVDIDLTMTVDRNGAIYLPRVGSVAVAGVRYRDLQGVLKKSVSRVFNNFDLSVSLVQSRSVQVYVVGHARQPGSYTLNAMSTLLNALLKAGGPDDSGSLRRVALMRGGKEVAKVDLYAILVDGDKSEDQTLRDGDVIQIPAAGPRVALLGDVKIPAIYEFRDGDNVGNLLHWAGGLESAAEGKELWIEKSVNNRFLNLAHVQNDDRQLSGIALKAGDIFRLHVPGAQPVSVQKNDEFVSVGGEVGHTGTFQIQKGETLRQLIMRLGGVNDDGYVFATQFKRESIRQMQQQKLDEVSARFEKELEQNAAGRLGKLTDKDAIASVTAEVERQRQIAAKMREIKAEGRVVLEMKDANAQVKDLPDLELQDGDQVEIPRRPGTVNVLGAVYQSNAFIYRPQRSVSDYLTLAGGVVDSGDKSSIYVLRADGTVASSNNGSWFSGVGGKRINPGDTIVVPEELNAGSWTQSLKEWTSILYQFGLGAAGLKVLK

SEQ ID NO: 5134 - protein, 394 aa, Chromobacterium substugae
MQTATDGRAKDEVDLPTLLAQLARHKRWIASSTLLFGAAALAYCLLAKPVFTATTSIMPPQQQNNGMSALLGQLGGLAGAAGGLTGLKSPNDLYIGMLQSRSVADKLIQRYQLKQRYQQDTMDATRKALQSLSSFANGKDGLISISVDDGDPKFAAALANGYVEELKAVNQSLAVTDAAKRRLFFEQQLKQTKDLLTEAESELRKTQEKTGMVLPEGQLPAIVGSVTQLRTNIAAKEVQLEAMKSFATAQNPLYIRAEQELAGLREQLAKLETGDGNGRDMLVPTGKVAQSGLEYLRRLREVKYQETIFELLSKQYELARIDEAKDSSLIQVLDAAVPPELRSKPKRSLVLALGLFAGLLVGTLAALLRARLDERGARRGPSQAEPAFALKNNG

SEQ ID NO: 5135 - protein, 401 aa, Chromobacterium substugae
MSSSARSHFGLVFLLAALSTIGPFSIDTFLPAMRAIGDSLAASPLQMQQALTVYLFCYALMMLWHGSISDAIGRRPVVLATTLLFGLASLGCALSDSLGMLLLFRGLQGLCGGAGLVVGRAIIRDKLDGAEAQRLMSHVTMLFSLSPAIAPVVGGWLFGAFGWHSIFVFMALVGFALFALCWFGLEESHHREARQPLKVRYLLANYWQVGKKRDFQLLTAAVSFNFAGFFLYVPSAPVFLMQHLHLGPSQFLWMFGPVVSGIMFGAYLSGRMAGHASQREIVSRGYWLMFAAALANLAYNLAADQLTLPWAVLPLALYTTGMSLAAPSITLNLMDQFPSLRGTVSSLQGFCQTMMSSLVAGALAPLAWGSPLRLACAMCVLLALGFVCRMGYRLRMRAIGR

SEQ ID NO: 5136 - protein, 116 aa, Chromobacterium substugae
MIRLYHNPKCSKSRAALALLEEAGAEVEVVEYLKHPPSAEELDRLLQLLGMEPRELMRQKEEEYADLYLDDITLERKHLIAAMVDNPNLIERPIAVGDGRAVVGRPPEQVLLLLSR

SEQ ID NO: 5137 - protein, 166 aa, Chromobacterium substugae
MSPNKSFAQLEQAINHVEARFPGVPRQEVILTRLIFHIVPRLSAHMCESLKQHGLNETVWMALLALYACPNQALNPSDISETLDSSRTNATRIADELVKNGWAARSASSEDRRKIVLELTAAGVALVESLLPYSREVHKTLWADFDSEEKALLERLMRKLLSKLGG

SEQ ID NO: 5138 - protein, 474 aa, Chromobacterium substugae
METDKVNKKSWPQTAGVLLISAVLGGCASFGPDVTPDQALSAEQLKLAAPGKQNLSGNWWQQLNDPALNQLVDSALKDAPSLKLAAARLRQARAAVGIVESKDGPQLDATANVAQIHTDQLKPLLHEDYVTAYTAALVGSWEFDFWGKNHAAVSAALGQQQAIAFEGEQTRLMLTQAVIAQYTQLQRSQAQADLLAQRLAIAQSREKLTQARINAGLLPGDNQRGNEVSIEKLLQQQSAFANDIERSRHALAALTGQGPQAQAAPQPGKLDPAPAPQLDSLDANLLGRRPDIAAQRARVEAMDSSVKEARAEFYPNVKLTVFAGQTSLEMDQLFKSGSSLWGFMPAINLPLFHSGQLQSNLSKQQAGYDMAVQQYNQTVLDALRDAADSVSGWQNSQRQLKQAERALASSLKANDAMASRLRAGLVNKLSLLDAQDALLGQQSAYIDAKAANRLAWASLNTALGGGFQAQPASH

SEQ ID NO: 5139 - protein, 384 aa, Chromobacterium substugae
MDQKLETAQSRKRNLLVATTLFAAIAIGYGAYWSLVLSHQENTDDAYVAGHLVQVTPEVGGTVAKVLVDDTQAVKAGQVLVSYDNSDAELAFERARNEFAQTVRQTRQLMANTQQLDAQVALRQAELSRAEADLKRRKLLAGSEAMSAEELGHAGDAVAAAQAALTAAQEQAKAGLALVGKDALAQQPAVKAAASRLKEAWLNLQRTEIKAPLAGTIARRNVQVGQRIAAGTPLMAVVPLENLWVDANFKEGQLAKIRVGQPVEIKSDLYGGKVVYHGKVQGLSAGSGSAFSLLPPQNATGNWIKVVQRVPVRIALDPQELKDHPLRVGLSIDAVVDTSNQDGKSLAEAAPAAAASENNNTLPDLKQADKLVAEILAANAAAGK

SEQ ID NO: 5140 - protein, 510 aa, Chromobacterium substugae
MNHPPLTGSKLVWITLALSMSVFMQVLDTTIANVALPTISGNLGAATSQGTWVITSFGVANAISVPLTGWLAKRFGEVKLFTASTLLFVLTSWLCGMSSSLEMLILFRVLQGAVAGPMIPLSQSLLLSCYPPAKKGMALALWAMTVIVAPVFGPILGGVISDNWHWGWIFFINVPVGLAAAFISWRILKPRETDTVDLPIDKIGLALLVIGVGSLQMVLDRGKELDWFNSAEVVTLAVVAALALVYLVIWELGEEHPIVDLSLFSQRNFTVGTVAISLGFMLYFGAVVLLPLMLQTQLGYTATWAGLAAAPIGLIPVVLSPIIGKNAHRWDMRWVVTVSFSVYAICFFWRSNFNTDMDFSYVVWPQVVQGIGVACFFMPLTTITLSGLHPSRIASASSLSNFLRILAGSIGTSITTTMWDRREALHHSKLTEHVTQYDPESVSWFGAMSKLGLNPGQQQALTQLQVTKQGYIMAANEIFWVSGILFVLLIALVWLAKPPFTAAGGDSGAH

SEQ ID NO: 5141 - protein, 289 aa, Chromobacterium substugae
MSLHISLRELEVFVAVAELDTVTRAADRVALTQSAASQALCKLEQGLGAQLFDRVGRRLLLNEHGRLLLPRARALLDAAADVQGLFDGDALALRVGASTTIANYLLPPLLAAFRRDWPRARLELEVANTRDIVEAVAAFRVDFGLIEGPCHHPELLASPWRQDELIVFAAAGHPLAGRKVAAAELAQAEWILREAGSGTREEVERVLLPHLSRLAISMELGHSEAIKHAVAAGLGVSCLSRHVIADLLAAGAVAAVDADLPPLTRTLYRVQHRDKSASRGMAAFGGHLQ

SEQ ID NO: 5142 - protein, 341 aa, Chromobacterium substugae
MTKHSNILPGLLLALGLAAAAIWAAELPAMKSLGLSALTLAIVGGMVIGNTVYRFIAGPSHHGIAFSKQKLLRAGIILFGFKLTFQDIAAVGFSGVLIDALVLTSTFLLAFWVGRNKLGLDEQSVILIGAGSSICGAAAVLATEPVLKAHAEKVAVAVATVVVFGTAAMFLWPLMYEAVRYLGISEFSYGLFAGSTIHEVAQAVAAGKSVSDAAMNTAVITKMIRVMMLAPFLIGLSAWLAKRHRGNSHEKTGITIPWFAVAFLAVAGLNSFNLLPHALLRQIIALDNLLLAAAMGALGITTHLSAIRQAGSKPLLLASMLFGWLIVGGGLINAGVAMLIR

SEQ ID NO: 5143 - protein, 1197 aa, Chromobacterium substugae
MRHWIIALLALLLGTAADGIELGLSLAAIAGIVSLAFGKSAGAGGNSEIIPGQPPSRALTLWQMQQRLEALEIEVELLREQARARSDAAPAAPDYSWRPVEPDEAPPPAPQEPPPLPAPEPPPQEPPLEIEWEEVGPPHAQTPPAPQPVRAAPDIAPARPSAPTLLERGWQYARAWLLGGNSVVRVGMLLLFFGFAFLLKYAADNSLLPIELRLAGVALGGCALLAAGWRLRLKRRGYALILQGGGVGTLYITAFVTLKFFQLLPPGLTLAFLVLLGAASAWLAIRQDAPSLAGMGITGGFLAPILTSTGGGSHVLLFSYYALLNAGIFGIAWRRSWRSLNLLGFSFTFVIATAWGVLQYQPEQLASTLPFLALFFGFYLGIAVLYGLRQGLALRHYVDGTLVFGTPLVTAGLAAGLLRHTDFGMAWFALALAAVYLLLTFWLRRRAALPLLAECFLALGVIFATLAVPLAFDGRVTTALWAVEGAGLLWVSLRQNRRLGLWFALGLQLCAGAACLSHLPAQAAGWPVLNASLIACLLLAASGLFSGWQLQRRGGNAAVPPSWLAVWAGLWWLGGGIRELKLYLPAGYLADGVMLLLCASALACGLLRRRLDWKLLAYPALALPALTLGWSLLGALPYLQRLSELGWLAAPAALAASLWLLRRHEEETADAGWLHACWQWALVALLAREAGGWLWQWLPDGVWRHVAFPFAASALLLLGGPLSRLEWPVRRHRAAYLGYGPAPLFPALAGWMLWSLLSDGNPAPLPWLPLLNPLDLAVGFSLLALCAWLLRLNRHWPTQPRAAAAWLLCPAILLAVSADVLRAFHHWAGLPYSLDMLWSASDSRIVLALGWCALALLAPRLAAGRESGRVVAWWSAAAGAVLLLWMLLANLETGSPLLLPWLPLLNPLELAQLAVLACVWLNWRRAGFPRPRSLPWLDYAIAAWLLAFGCAIVMRAFHHWQGVDYRLDAALRSPLPLTVLMLCWALLALAAPRLAAGREGAAAVTASLLRLLSPVLLLWSVLANLQGERLLPLPHLPLLNLMDLSQLAVFAACWLNWKRGLLRCAPLEPWLRWLAGGWLFLFGNAVALRSLHHWLDIPYRFGALLHSTLAQATLSLGWTLAALGLMVAATRRGQRLPWLCGGALLMLVVAKLFAVDLASVGSIARIVSFIGVGLLFLLIGYLSPLPPRAHQPEQDRP

SEQ ID NO: 5144 - protein, 62 aa, Chromobacterium substugae
MAEVWRAMVQTARLMVGQRDYDLYVGRRRRFDPDAQVMSREEFFRYCQEQRYGGKSMKKCPC

SEQ ID NO: 5145 - protein, 688 aa, Chromobacterium substugae
MQQLKQCVVWLLVALAGATAFAMVALNRGETINAVWLVVAALSVYAIAYRFYSRFIADKVLELDARRLTPAEKFNDGLDYVPTNKWVVFGHHFAAIAGAGPLVGPVLAAQMGYLPGTLWILVGVMLAGAVQDFMILFLSMRRDGKSLGEMIRQELGDIPGVIASIGVLMIMVILLAVLALVVVKALADSPWGTFTIACTIPIALFMGVYTRFIRPGKIGEVSVLGFILLMLAIVYGGDVAKSATLAPLFTLKGTTLAWTLIGYGFIASVLPVWLLLAPRDYLSTFLKIGTIVGLAIGILIVAPQLHMPSVTKFIDGSGPVFAGNLFPFLFITIACGSVSGFHALVASGTTPKLVESETQARMIGYGAMLVESFVAIMALIAACVLDPGVYFAMNSPAALIGKTAADAAQAISGWGFIVTPDMLTQLAADVGEHTILSRAGGAPTLAVGMAHILSGAIGGKAMMAFWYHFAILFEALFILTTVDAGTRVLRFMIQDLLGFFIKPMANTESWGANLVATGLAVGAWGYFLYQGVVDPLGGINTLWPLFGIANQMLAGIALMLATVVLVKMQKTRYVWVTAIPTAWLLLATLVAGWQKLFHESPKISFLTHADKFSAAAAKGQLLAPAKSMAQMQQIIFNDYVDAALTAMFMAVVLSMLVFGIHVIRKSLAVKWATAKEVPAVYRQGGVDG

SEQ ID NO: 5146 - protein, 237 aa, Chromobacterium substugae
MAQHILIVEDDARLAELIAAYLTKHGYQVSLHGRGDTAPAAILDTRPDLVVLDVMLPGKEGFDVCRDVRPHYGGRILMMTARDEDVDEILGLELGADDYLAKPVEPRRLLARIRALLRRSGAARQDGGGVAVENDCIAFGQFNISQATREALLGDEQIELTTAEFDLLWLLATHAGQVLSRDDIMSELRGIGFDGLDRSIDARISRLRRKLGDNPDAPARIKTVRGKGYLFSRSDWE

SEQ ID NO: 5147 - protein, 450 aa, Chromobacterium substugae
MPSKNLRSWLKPSLGTLFARYFLATMLVQLLIIIGFGFLVTKLYEKSDQVSKLEFMNGTIALLRDRLQAQPPQDWDTQLAAMASRFSYPLKLVDQLPAELERDARPQLRQGKPYLDGDNQLLYATLPGSPRLLALGPLDVQSSDSNWISEDIEVLLIWMLLSGATLGTLLYFSLQPLWKDLLEVRRTAEVFAEGDFSARARTAKSRLFAPLPLAFNSMASRLERQLETRQALSHAIAHEIRTPIARLRFGLTMLEEEEDAAEWQRYRDGMERDLQELEELISTSMEFAKLKRSEVPLHLETIDLFDWFDDLIDLVTPLKPPGLELTLDCAREEGAFDRKLMYIATRNLLLNAFKYAQQQVRMRVYHQGSQLIIEVDDDGCGIPEADREKVFEPFLRLDRSRDRATGGHGLGLSFVRLIAEHHLGHASAGASELGGARFRMIIAQPDARQP

SEQ ID NO: 5148 - protein, 272 aa, Chromobacterium substugae
MVSSRPAALLVHGLGGTAYDLGALGRTLEDADIVTHSPVLPGHGGSPEDLLGVGWEEWVESIRSEYRALKAKHKVVHLAGVCLGGLVALEVARREKHQDKLALYAPPMFLDGWSLPKLTWLRHAVYCLPQLAKKMRVPEVSPFGIKNARIRKAIQQRFERGDRFHYAYIPLMCIREVDRLRRQLMPRLAEITCPTLIVHADEDDITSPRSAHYLLQYLGGPVDFMPLSNSYHMVMVDNERAEVLQRSLKFFNSHARQQSAEQPCGWTAFAAA

SEQ ID NO: 5149 - protein, 194 aa, Chromobacterium substugae
MALSALSAHAADLGAYAFGTAGASYSTIERGDNLPSSASVNSGKQTDAAWEMGAGYRFDRSLAVEVSYADFGKSDANFNFCGFLSCVNGNLSAATTAVRASLLTFLPINDKVELFGRLSLNRVQTKVSLGSDSQDFNRTRAGFGFGAHYALSKQLALRGEFEYLAGAMDLQYNGYSLVKTSGQSALKAGLSYQF

SEQ ID NO: 5150 - protein, 302 aa, Chromobacterium substugae
MSHPHSDAVKSFLLDLQDRICAALEQADGAGQFAEDAWRREAGGGGRSRVLKDGEVFEQAGVNFSHVHGDALPASATAHRPELAGRRFEAMGVSLVIHPSNPHVPTSHANVRFFIAEKDGEAPVWWFGGGFDLTPFYPREEDAVHWHTVARDLCAPFGAEVYPRYKKWCDEYFYLKHRNEARGIGGLFFDDLNDWGFERSFDFMRAVGDGFLGAYLPIVARRKDQAWGDRERQFQLYRRGRYVEFNLVWDRGTLFGLQSGGRTESILMSMPPLARWEYGYQPEPGSPEAKLYADFLPPRDWL

SEQ ID NO: 5151 - protein, 552 aa, Chromobacterium substugae
MHTTSGSATAPHRALEPALWLLFALIWFGSLGYRGLIHADEGRYATISLFMLHSGDWVTPRLNGLLYFEKPILQYWMGALSFAIFGVNEFAARFWPGLTGFLSVAAVSLTARRLWGAAAGRHAALAAGGMAWIVANSHFLSLDMGVSFFLTAALCGFLLAQQDNASRAQTRWAMWITWAAMAGATLSKGLIGLLIPGATLVLYSLINWQWAFWKRMHWLSGLSLFFALTAPWFVLVSERNADFAHFFFIREHFERFLTTEHKRTGAPWYFVPYLILGLLPWTTLLPRLVKDAWADRAAGLRIGRLLLIWCVFIFAFFSKSSSKLPSYILPMFPALALMLAYSFGRMRPAELKKHILLPALLWLALLAAWPFAGRFANQDSPLDVIQPFAHFIAAGAAVFLLGSIYAWRALGQQRMLAAIAALSFGSLIAVTLAASGHDSYGRLKGSKEIVKQIQPYLTADSEVYSVRYYDQTFPYYVGRPVKLVDFVDEFEFGEGQEPQRWMPRLEQFTAAWRAAPKAVAMLTDGTFQELQKQGLPMKVIYQDPRRMVVAKP

SEQ ID NO: 5152 - protein, 123 aa, Chromobacterium substugae
MKLIEFGLILFGVLLNAAAQLCLKAGVRQIGHFDFSAANALPIGWSLATNLPIIGGLSCYAVSVVVWIMALSRVEVSVAYPMLSIGYVVNALLAYWMFGEALAAQKLIGIAVIIVGVVLVARS

SEQ ID NO: 5153 - protein, 374 aa, Chromobacterium substugae
MEFLPFTRPAIDEDTIAAVGEVLRSGWITTGPRCQQLEAELSAFCGGRPVRLVSSATAALEMALQIAGVGPGDEVITCPLSWVATANVILKVGATPVFVDADPTSRNIDLAKVEAAITPRTRAIIPVDLAGLPVDRERLYDIARRHGLRVVEDAAQSMGASWQGKRIGMEGDLVSFSFHANKNMTSGEGGCLVLNNADEARLFEKLRLQGVTRLPDGTMDVDVLGGKANLTDIAAAIGLGQLKKLDGFNARRRELAKLYFAHFDRELGCELPPADFEQSNWHMFQPLLPLARMSISRGEFIARMKAEQIGVGVHYPAMHLFTLFRAKGYAEGDYPAAEDIGARTVTLPLFPAMRDDDVARVCAAFSRVLRPVLS

SEQ ID NO: 5154 - protein, 315 aa, Chromobacterium substugae
MNTSIHLSVVIPVYNEQDVLQALFDRLYPALDALNVRYEIVFINDGSRDKSVAMLSEQFNLRPDVTRVVLFNGNFGQHRAILAGFEHSRGERVVTLDADLQNPPEDIAVLLAEMDKGHDYVGSIRRQRNDSLWRHLASRAMNRLREKLTRIKMTDQGCMMRAYSRRIIDTINQCNELHTFIPALAYQFAQNPTEVTVGHEERFAGESKYSLYSLIRLNFDLMTGFSLVPLQWFSLMGMAISAGSGLLVAYMLLRRLFLGPEEGGLFTLFAIAFFLIGIALFGIGLLGEYIGRIYQEVRARPRYVIQAVLEQGDKR

SEQ ID NO: 5155 - protein, 307 aa, Chromobacterium substugae
MSRAVVFAYHNVGVRCLKALIGRGVEVALVVTHQDNPNENIWFQSVAQTAREHGIPVITPDDPNTPEVAAQVEACRADFLFSFYYRHMLKAPLLEAVKRGAYNMHGSLLPKYRGRVPINWAVIHGETETGATLHQMNVKPDNGPIVDQMAVPILPDDSADEVFSKVTVAAEMVLWRSLPGLMDGSAPHVQQDLSLGGYFGGRKPEDGRIDAQAPARRLHDFVRALTLPFPGAFADTRAGRLLLWKTLPAGQAAPAGAAELYREDGRLWLRCADGGRLAVLRAELAGQALDAGNFAALAGGDALPLGG

SEQ ID NO: 5156 - protein, 347 aa, Chromobacterium substugae
MKKVLILGVNGFIGHHLTKRIIETTDWHIYGMDMHDDRVAEWKDHPRFHFFEGDITINKEWIEYHVKKCDVVLPLVAIATPSTYVNNPLRVFELDFEANLPIVRQCVQYKKHLVFPSTSEVYGMCHDDEFDPENSELICGPISKPRWIYSCSKQLMDRVIHAYGMQEGLNYTLFRPFNWIGGGLDNINTPKEGSSRVITQFLGHIVRGETIKLVDGGHQKRAFTYVDDGIAALMKIIENKDGKASGQIYNIGNPANNYSIRELSQMMLDLARVYPEYQLNADQVKVEETTSGAYYGKGYQDVQNRVPKISNTMADLDWKPTVTMADALKGIYDYYRDQVAASRDLSE

SEQ ID NO: 5157 - protein, 162 aa, Chromobacterium substugae
MERLRILAALGPLACACRIEHIGSTAVPGLAAKPVIDIMLGLPKLNDLEPYFPALAAAGFHRQPQMAAAMPDRHYFTQPVLPPRQAHLHAVALDSDFWRDKLAFRDALRADGHLAEHYADLKRRLAVTHGGDRAAYTDAKSGFIASVLAMTAGKPHGKSATR

SEQ ID NO: 5158 - protein, 299 aa, Chromobacterium substugae
MKKLALKIDVDTWRGTREGVPLLVDMLKRRQANATFLFSLGPDHTGRAIKRVFRPGFLSKVSRTSVVEHYGIRTLLYGTVLPGPDIGKREAALLRSVRDAGFEVGIHCWDHIKWQDHVAGEDAVWTRAEMHKAARRFQEIFGEPPRTHGAAGWQINDAALAYQQELGMLYASDGRGTHPFQPVDAAGRNLGVPQLPTTLPTLDELIGLNGLTNDNVHEHLLRLTETAPDTGHVYTLHAELEGMRLAETFERLLQGWQEQGYQLVSCLDLFNSLDRAALPNGRVAMGEIPGRSGTLALQA

SEQ ID NO: 5159 - protein, 117 aa, Chromobacterium substugae
MHWYFSVLSKYAVFRGRARRQEYWYFVLTNLIISLMLLVVQHDVFGDHNRWLTNLYSLALVLPTIGVSMRRLHDIGRSGWWMWILFIPVVGAIVLLVFHCQDSQAGDNQYGPSPKDA

SEQ ID NO: 5160 - protein, 81 aa, Chromobacterium substugae
MEIAQIERLLLINLAFHYAILILWFGVFHCFHGWLYRLHSRWFRLSEPAFDLLNYGGIGLYKILVLVFNLAPLLALWLTGS

SEQ ID NO: 5161 - protein, 337 aa, Chromobacterium substugae
MVIAESRVECMVVHRVGNPTRGEPLQLSERTTSVDEAVSGMLLDGYLKGIVSDRKKHQFVHETDLNLNEIYHYTRQFFRGEIDFLAVSQRIAKHLYGRSQHPNISAGDLLIIEFSGLSDGDRDMRALGVFKSEIRDDFLTIIDGAGVFDISHASGINPRLIDKGALILEHGPTVYAVDRLSREAKFWLDDFLKALRVPDKASSSKMLASVVEQLSGEIEDPMEQARFKDELLTLVESQQEEVAAKSLTDAAERFVPRAQVEEALGSAAESYGFELDDEAKLPAKGMAKQLEKTLSRYGVGHGISVLLPSGITLKNIQSVNDGEGGLSLTLFLNKREG

SEQ ID NO: 5162 - protein, 293 aa, Chromobacterium substugae
MAAWEGIQEFVAVADSGSFTQAARLLGISVAQVSRQVSQLEARLGARLLYRTTRQLSLTEAGGLYLTHCRQLLESLAEAEQAVSRLQAAPQGKLKLTAPLAYGQSHIAPLLLDFMQRYPQLEVGLNLSNQLQDLVHDGYDLAIRIGHLTDSSLMARRLSQRRHHICAAPAYLARRGAPARPQDLAGHDCLLLGQDSWHLQAGGKRQAVRVRGPLRCNNAQVLADAALRGMGLAQLPDYYVAAHLASGALVEVLADYAEPEEGIWALYPHNRQLSPKVRLLVDFLAAALAPAWP

SEQ ID NO: 5163 - protein, 401 aa, Chromobacterium substugae
MADCAAQAARHPARKKESRMSPSVIRCKAAVAWAAGQPLSIEEIEVQPPQAGEVRVRMVATGVCHTDAFTLSGADPEGIFPCVLGHEGGGIVESIGPGVSSVAVGDHVIPLYTPECRECKFCLSGKTNLCQKIRATQGKGLMPDGTTRFSKNGQPIYHYMGTSTFSEYTVLPEISLAKVNPAAPLEEVCLLGCGVTTGMGAVVNTAKVKAGDSVAIFGLGGIGLSAIIGARMAGAGRIIGIDINEGKFELAKKLGATDCVNPGHFDKPIQDVIVEMTDGGVDFSFECIGNVKVMRAALECCHKGWGESVIIGVAGAGQEIATRPFQLVTGRVWRGSAFGGVRGRTELPEYVERYLQGEFRLDDFITHTMPLEHVNEAFELMHEGKSIRSVIHYRPAGQDAV

SEQ ID NO: 5164 - protein, 278 aa, Chromobacterium substugae
MLEKISENQAFGGWQQQWRHRSAMLDCDMRFGIYLPPAARYGKVPLLLWLSGLTCTDENFSHKAGAQRVAAELGIALAMPDTSPRGEGVADDAAYDLGQGAGFYLNATQAPWSRHYRMYDYVADELPALLEAQFPLNGRRAVAGHSMGGHGALICALKRPQDYVSASAFSPICRPTAAPWGRKAFAAYLGADESRWKEWDASHLLAERGCSLPLRVDVGLADPFLAEQLQPEALELAAQASGCRLELNRHAGYDHSYYFVASFIEAQLRFHARHLFPT

SEQ ID NO: 5165 - protein, 243 aa, Chromobacterium substugae
MPLSTHRPVCSLISSRAHTDLAALPLLRDAPEALITHLARHTTPVDGKQRKLLFLRGDPENFIGLVLRGGVYHSLQEPDGHEVIMDRTQPGEMVGESALLQSGRRSSNALLGSNSQLLLLHQQHFAPLQDCAQLMNRVQQQLCARLQRISSFVETVCLYRLEARLARHLLAEMEQSGRPGPDGVTLPMPANQGTLAAMLNASRPRLNAQLKQWQRDGLIQLSRQTLRILDPDKLSRIARQLQP

SEQ ID NO: 5166 - protein, 223 aa, Chromobacterium substugae
MAIMQSFSQAASESTDSSFSMVWREIHAKLQRRARHLCKGDIHRADELLSDTAFKVHLYLQHSSARVQNLAGFMFLALNHAFLDLKRRQRREIKVIDPDSDPDGDQALSCTGHGPTPEQQLSLRQQLAELECAFAALNPDQQQLFQLKFEEDLSYCQIAARLGINEALARKRVELLRKALRKQLNPGFTLSDGSRPYQQKRQRQSAANGPLCAPCADDKDKAA

SEQ ID NO: 5167 - protein, 167 aa, Chromobacterium substugae
MTAKLGSLISGLKRAVIEAQRSVCHQHIEELQQFFVPDQEQNPAQSFPEGAWTARMVGMNVPREVSRNGVVTMEHHEVQVPLITLLPLKSFAIEKVEVLTTLSLSLTEPPDGQPDADDEAADVLVSMRRQDEQTAEIKIVIQGLEPPAGYQRVVAAYEKLLNAQLPT

SEQ ID NO: 5168 - protein, 224 aa, Chromobacterium substugae
MADTSDNNLLSMAQQFSGLPMKSLIGGPLQAAAQAQQSLAMTQTQAILETGFIRLGDRNGKLTGYKPLTAVIEMASSRPGPAGQASSALTLNLPVLTLMHIPSLAISSVDIAFDMEVKSSFTRETDEQSASKLEAGAAWDARAGWGAFGVELKGSVSYDSSHSRDDKQGVSKSNDARYHVEVKAEQQPVPEGLRLLLQAFGKNMDMAQAPADAPAVPPPAGAKS

SEQ ID NO: 5169 - protein, 267 aa, Chromobacterium substugae
MNAMLLHFISLPSSAQIAAWAASGCLCATLVHLLLRKLAPDHVTQKQSDEVGVIIAVVGIFYGLIIAALLVRAINHFDASTDIVEREAELAGSLYRMSAQGLPSARQTVKDNLLAYLDAVVAREWPRQQGGEEVPSGSPELGRLSRALAGVRPADRREAEYLNLAQSQLNGLYASRHARLSDQAMTIPWDIWSVSLIGEVLLIFFAWLMHVPSKGVHFFLTCAMAASISIVLAIILIYDTPFYGDISVSPEPYRKVLHAIRADSLDG

SEQ ID NO: 5170 - protein, 79 aa, Chromobacterium substugae
MADNTAVNGQITDAVTQTNVKVVAEAPAQAMASLYQLASHSAGLALQNSVHSQQALNQISSAVISKAVSMILSIGEKSS

SEQ ID NO: 5171 - protein, 204 aa, Chromobacterium substugae
MPFPNFKNLFGAKPPAGQDSAQPKPDQPAASAAKNEPAQPPGPPPAPPPPSPMRGFTNQLKTAPDASPDTSALNSQIVQAVQLSNSETAAYAGSQIAVAPNMMISQAGGLVAQAGANYFDSASKLALASKSVLLKNMTEKFAKEDLKGAAEDALGILITDLLVGTAAAVAAAAGAMEGEAAHFALDKIDQSLSKYQQFLDKKTN

SEQ ID NO: 5172 - protein, 135 aa, Chromobacterium substugae
MDTPDQDANDAAPRGGLLRGSIPELSKSPVHLLSAIVTLAADKLWDVMLLDMAKTMPLQEKTRFLLCAGLLLLGFTALSASMTQLWVDKDDPGMALAKGLAMGILAGLPYSFGSTELGLLFIGWSGINELQKLEK

SEQ ID NO: 5173 - protein, 350 aa, Chromobacterium substugae
MRVTLTSRSHLAALLLAACGQASAAAAPLPALGADPKQNTVSGLSSGAFMAAQFSVANSARVAGAGIVAGGPFYCAGLGGLNGPERFLTTATTQCMRPLGAAPSGAAAWQAAQKFAGQGLIDPVDNIKRQRLYIFTGASDSIVLPKVVAQTRAFYQSAGVPDAQVRYVDNVNAGHALITANATDLKCPANAAPNLNNCGFVQSQDILRQLYGQLKPPAAKLSGQLKDFDQTEFSKKGYTGLSDIGHVYIPAACAKDSCRVHVAFHGCTQEDSRIGNRFYATTGYNEIADSNRIVVLYPQIRTDPKRNPQGCWDFWGYSSKDPSNPDYYAKSAPQMSAVRAMVDRLNSPRK

SEQ ID NO: 5174 - protein, 169 aa, Chromobacterium substugae
MDPQFLSAWLQNVNDSWQRLAQTGLPDEREWKGALKAWLDSGQRLSEWQQEAQRQWTEDWRARAGADSLLAFYRQCDEVCTEFVRQNLLWQLEWSAGLRRQAGELAGSLLQTRGEGDALLALNAAVQGGRKDWDEKLEMLQQTLSELSPALAQNLQQWLAPPPADAPAA

SEQ ID NO: 5175 - protein, 146 aa, Chromobacterium substugae
MKTNAAGISLIKQFEGVRLAAYQDMVGVWTIGYGHTGPDVKKGMAITQQQADQLLAEDLQTFETGVGKAVTVPLNENQFSALVSFSYNLGLGNLRSSTLLRLLNKGDYAGAAAQFPRWDRAGGQVVPGLLRRRQAEQALFLTPAPC

SEQ ID NO: 5176 - protein, 67 aa, Chromobacterium substugae
MQDELSTLHAHVSQLLSQHLIDWAGELMNGAAGEDDSRRLTKLRALLATRDALAPLLGGEQQDASHG

SEQ ID NO: 5177 - protein, 193 aa, Chromobacterium substugae
MAEAPLNPALRQVAEQYLGRPLQLQEAQTLMAFQQNTQSPSPQLAPIQQARQQTQQAIAQSQSRAGAGVRDILASIQASSSQALQIQEAEEQAILKLLEGTQDLAELRPSALQPAMASLQPGSQLALGQIAEHLSNLARQEVEKCFNQYFGPLSAQLQEVVRKLQAQEAAQASTEAAAAENDIHSDDAPPSKQ

SEQ ID NO: 5178 - protein, 106 aa, Chromobacterium substugae
MSFPTTVNDQITDAVTQANVKVLAESPAMAMGSIYQSMAHSTGILFQNAVSAQQQQNTLAQAAANMGVMQIYSMDTMSGAAATEKVSQGGIADNLTSLLTVLQSFR

SEQ ID NO: 5179 - protein, 107 aa, Chromobacterium substugae
MANNTAVNDQITDAVTQTNVKVLAEAPAMAMGSLFQTASHSTGILFENATSAQQQQNTLSQAAANMGVMQIYSVDTMADAAGTEKVSQAGIADNLSSLMTVLQSFRR

SEQ ID NO: 5180 - protein, 107 aa, Chromobacterium substugae
MANNTAVNDQITDAVTQANVKVLAEAPAMAMGSLFQTMAHSTGILLENATSAQQQQNTLSQAAANTGVMQVYSVDTMADAAATEKVSQGGVADNLSSLMTVLQSFQR

SEQ ID NO: 5181 - protein, 108 aa, Chromobacterium substugae
MAFPTAVNNQITDAVTQANVKVLAESPAMAMGSIYQSMAHSTSILFQNAVSAQQQQNTLAQAAANMGVMQIYSMNTMAGAAATEKVAQGGIADNLTSLLTVLQSFRNR

SEQ ID NO: 5182 - protein, 288 aa, Chromobacterium substugae
MNWDNARYFLALARAGTLRSAALRLDVDQATVGRRLQAFEEEIGSRLFLRMPQGYQLSESGAMLLADAERMEAAADAFSRKAAHSDRQLAGPVRIAATDTVAGAFVIPALAELSRRHPELEFTLLTGLSLSDVAAGEVDFAIRSLRPDKGEVLVRKLAAIDMSLYASPDYLARRGRPLPGDGFAGHELLMFPRDTVPRHWQRLCGESVDQARIALQANSQLALRQAALAGMGIAMLSCFLADQDAGLERVWPERTDPVDMWLVLHPDLQRVARVRAAVEAIAAVFARR

SEQ ID NO: 5183 - protein, 465 aa, Chromobacterium substugae
MPHRSHPQAGLPALLTLSAGMFMAILDTNIVNLALPELQRGLHASLSQLTWVVDAYVLTFAGLMLSAGWLADRLGARKVFAWGLGLFVLTSLLCGLAANVELLIGARLLQGMAAALFMPSSLGLLRHAFPQPAERARAVGVFGGLVATAAAAGPVLGGLILGPLGWRGAFLVNVPVGLAALLATARAVPAQPPAPGRRPDVPGQLSGMLTLLLASCALIEGPRLAGGWQLPALLAASAASACLFCLLERGNPQAMVPPQLFRHPAFAAANWVGFAIGAAYFGSLLLLSLYLQQGLRMDALRAGLALLPLALCLTAGNIAAGRLLPRMGARRQIRDGLLLAAAGYLLLALASRLGLPWLLAAMLPLALGTALAIAPMTATVLESAPPQMGSTASAVLNAIRQAGALVGTAGAALVAGRCADLGQALLYGMALAALLSLSGALAAGRIPRPDGLRGLEAAAPSPVTR

SEQ ID NO: 5184 - protein, 37 aa, Chromobacterium substugae
MRYLYRLYPWLFQRERAVGCRLGLRRQWEAAARRVIL

SEQ ID NO: 5185 - protein, 332 aa, Chromobacterium substugae
MFQINAQSRTNCPDMKTMPSPDNLLAFDALARAGSFTAAADLQGCHKSLISARVKELERELGAVLVLRSTRKMALTEAGERLRPHAARLRETMAQARMAVDQTQSGLAGPLAISTTSSLAQYVLGPVLSELATRYPDLTLSLRVNNRLQDPVADVLDFCLRSARSHKVHDENLVARLAGYASENLYASPGYLARHPPLRQPADLSRHRLLVMESEQRDGLLLKKGEQLLRQPIAAQLYLDHYPLRAELALASQGITLLADYTVERHLARGELVRVLPEWHCDYWPIYLVHPFRTPLTCKYQTFIDFVLPRVAAALPDNRAQAGSDGRASSTR

SEQ ID NO: 5186 - protein, 315 aa, Chromobacterium substugae
MIVIEKLTVDMARGVENNLEGLQIFVAVAEAGGFTAAAERLGMTKANVSLQVGRLETQLGATLFNRTTRRVKLTEAGQALYLDAQPALATLRDALLQAGHGAAALSGTLRLTAPVSHMAESVAPAATQFIRQHPGLQLELHASDHMVDLVASGMDLAIRLGMLRDSSLRALKLGEFAQLPVASPAYLQARGHPERPQDLAEHDWVALTLLKTPLSWPFAGPGGEEQAVRMKARIKVDSAASLRALLLAGAGVSVLDSFSVQEDIRQGRLVHLLPQWTLPKGGVYAVFPPGRHAPAAARAFVEFYRVLLARPSLPA

SEQ ID NO: 5187 - protein, 212 aa, Chromobacterium substugae
MKIALIGASGYVGSALLQEALSRGHHVTALVSRPERIEAQANLAAAKVDVQDSAQLAEQLKGFDAVLSAFSGHAQAEQFDYFVKGIRSIIAAAKAAQAPRLLVVGGAGSLEVAPGVQLVDTPEFPEQWKASALGAREALNLLRAETELNWTLLSPSAMLQPGQRTGQFRLGKDQLLVDAAGNSHISVEDYAVAMIDELEKGEHQRSRFTVGY

SEQ ID NO: 5188 - protein, 137 aa, Chromobacterium substugae
MKNEELAVWAQVRDTLAQIARWLGDGPHGEEALAALMMDFDAGFAMVAPNGARLDWQGLRAFFQGAAGSRPGLEITLERMTLLMGDGDAATVAYYETQALGDGSGNGRHATAVLFRDGANWRWRHLQETGEAVWPPR

SEQ ID NO: 5189 - protein, 473 aa, Chromobacterium substugae
MEYRKRVAAVYLLGFFIDLANLFVGNVAFPDIARTFHRDVAELAWVGTAYILGLTAVIPLGNWLAARWGGKRVFVASLLLFMAGSAGAAQAGSLGALIAWRALQGLGGGLLIPLGQTMTYRLYRPAERPGLTAMILLVGQLAPALSPTLGGLALDALGWRWIFWLNLPLAIVPLVLALRWLRDEREPEPAAGLDWLGLLLGSLALLLALQGLGDLAQPSTWARGGALLAAGLALGAAYARHSRRHPRPILRLELLRDPLLRMSMLMYLLVPGAFMGVSLVAMLYLQQVLGVSASAAGLLMLPWSLGAFAAIALTGRGYRRLGPRPLLMAGALAQGIGFLSLLAIDRSGQLPWLAGSYALMGLGGTLCSSASQSTAFLGVAPARMGEASALWNINRQVSFCVGMALACVLLNLLLAGQGIADPAAPAARELAARAFHLCFLAAALAMLPPLWLGSRIGNAEVLRLLNRPQMGEA

SEQ ID NO: 5190 - protein, 301 aa, Chromobacterium substugae
MSLQRFRIFAAIVESGSLTAAAEALGHSKAVVSFNLKQLEAELGVALLTRSTRRLQLTETGRRFYQDCLHVLRMAQTAMDDARRGHGGLQGTLSVSTTPEYGRRRVIPALAAFSLLHPRLAVRLESSSRHADLISQQVDVAIRLGSLSDSSYRARLLEEFDIWPVASPGYLAQPDKQVESVDGLARADWLAHSRLAAPLRWKLTGKDGEAMLDAGDAPRIVADTSGALLDFARQGCGVALLPDWQVTDDVAAGALARLLPDWAFPRQGVYAVYPDTRHLPEKVRAFIDFFADYLAPRQGEG

SEQ ID NO: 5191 - protein, 644 aa, Chromobacterium substugae
MFKNWSVKQKILVSVALILLIALAIAGAVSTRMFQAALTERLEQHELKATVEGIRNELDASIALPLSQTRQLAANTYLLDWTAAGEPESGVGPWQRYAKALMQTSGASIISWTSEATLNIYIDHATVKADPKGNDKWLADFLASGRDSQFTLGSETGKQQVMMFVNVLANKGQAGHRAVAALGFDVTQMAERVRKMAVGERGQVYVVDAAGQVRLHRDPAAMQKKTMLAELPGLSAIAPQLLNKSGFNLAHFDGPNGPTIAASSYMPNADWFVVVEMDAGEVYGAVTRTIWWVAAIDAVVLLLSLLVIWQVSGFISRPLVQLRDAMRALSSGHGDLTMRLPADSRDETGQVAAAFNQFMEQLRAMFLQVREQSGQLHRSAGELARMTERLSAGSRHNADLSETTAATIEQLSVSVSHIAGNCHGTAEAVQQAGALSEQSAQAVGKVSVEIGSVASSMDEVKTVMEELERRSAQVGSIAGVIKDIADQTNLLALNAAIEAARAGEQGRGFAVVADEVRKLAERTSQATVEIDDMVGGMQQGSGQARERVAKTYGAVQGGVELAEEAQRQIAEIRSSMQLVVRQAAEIRDAASEQSKATEDMARTAEQMSSQALQSDAEIGRAGQVVADLERLSQSLEGVVSRFKL

SEQ ID NO: 5192 - protein, 167 aa, Chromobacterium substugae
MSFPELFPSLFRYKAWADEELHAEAARLDGAAHPDKRHLAIRILNHIHVVDRIFRGNLTRQPHGYAATNTPDTPELAALLAAVRETDAWYVEYSSSLSAAELAEAIDFTFTDGGHGRMSRAEMLLQVITHGGYHRGAAGRVLAECGLQPPRDIYTRFLHDSEPARRA

SEQ ID NO: 5193 - protein, 200 aa, Chromobacterium substugae
MRTKSESKRQAIIAAATEVFLERGYEAASMSEISTRAGGSKATLYNYFSSKEELFLEVMACLAGEMSKVYVKLVPGGDLAAVLQDFGEAYLDNLFSPELRALRAIVMGSGSRSEVGLLFYENGPKVGWGNLAEFMAAEMQAGRLREASPWTAAMHFHGLVHAECQVALITGLVDQLAPKESRPAWVASAVEVFLIAYGAR

SEQ ID NO: 5194 - protein, 481 aa, Chromobacterium substugae
MRTAKFFPPRPLSIGLLAALALLGGCAAVPDMGPAPQIKPLQPYQNTQSLPSEQGQWAAGQWWRKYGDAQLNKLMDEALSQAPDLAAARARVERAEGLAQQAGAARLPSADLNAAINRDKQSYNNGMPAPIGFNSSGRATLDFSYELDFWGKNRASVAAATSELTAARADSAQARLMLTTSLAAGYAELARLFAERDAAAQALDVRSHTAQLMSERQRQGMETLGSARQAESREAAARADLAAADENIVLQRHSLAALIGAGPDRGLAIARPAAGLFREQRLPDTLAAELLGRRPDLAAARLRAEAAAKRIDAAEAQFYPNVNLTAFVGAQSLGLGLFDKAGSGIAGVGPAINLPIFRGGQLQGQYRAARGDYDAAVASYDAALSQALRETADAVASQAALTPQLEQRRLALQTADEAYRVSQNRYQGGLANYLDVLNAEDGVIASRRSLAALDARRFALDVALIKALGGGYQQTEPQAAR

SEQ ID NO: 5195 - protein, 384 aa, Chromobacterium substugae
MSENVQALPASEAPAAAGRPLQRKKLFTLLFGAVAAAAVGYGGYWTLVGSRHVSTDNAYVAAEIAQVTPEVAGTIQQVKVVDTQPVKAGDVLVVLNDSDAKLALAQAEADLARAERRVKGYFANDEGLSAQAQARSADEARSAAQLASARADLERAKLDLQRRQALAKSGSVSGEELSNAQNAYATAAASLKAAEAASQQSAANYRAAVGSLKANQTLTADTTVADNPEVTLARAKRDQARLDLARTVIRAQVDGVVAKRQAQVGQRVQSGTPLMSLVPLQNAHVDANFKEVQLNKVRVGQPVELTADLYGGKVVYHGKVAGLSGGSGAAFAMIPAQNATGNWIKVVQRLPVRVALDPAELKAHPLQVGLSMEATIDVSEGPHV

SEQ ID NO: 5196 - protein, 511 aa, Chromobacterium substugae
MSSANPAVQQPLTGNMLWLAALVLAAANFMVVLDTTIANVSVPNIAGGLAVSSSQGTYVITSYAVAEAIIVPLTGWLAARLGTVRLFVGSMLLFGLFSMLCGLAGSLETLVLFRVLQGLAGGPLMPMSQTLLLQIFPKHKAGAAIGLWSMTTLVAPIMGPILGGTLCDQASWPWIFYINVPIALGCGFLGWSLLKRYQSQVLKLRIDVVGLALLMVWVASLQLMLDKGKELDWFGSPIIVGLAIAALVGFAAFLIWELTEAQPIVDLRVFRHRGFWASVLTISLAFGSFFGATVLTPQWLQAYMGYTATQAGYATAMSGILAVMVAPVAAKLSTKLDPRKLVFCGVMWLGCVTLYRSFSTTDMGFWQVALPLLFQGLGMPFFFVPLTGLALASVEPAEVASAAGLMSFMRTLSGAFATSLVTTAWDDKANYNHAELVGMVDGGGDALRALTGSGLSDSTAWGTIEQALQAQSIMLSTNQIFWLAGLSFIVAACAIWLAPRPSRVADTSQAH

SEQ ID NO: 5197 - protein, 41 aa, Chromobacterium substugae
MPRALVAGAFFRPVSKASLYIRPPSCNRLLHIQRAINMPTQ

SEQ ID NO: 5198 - protein, 544 aa, Chromobacterium substugae
MKHSIQRLALAAAAALACQAAAAAPLQPIRHDAFAQACQALWGSANARSHWVKDDGQGGLAYAPLNGDGDRIMDFSSAGYMGGGVALPAAPVKATVKPSGNAAGDLANIQAAIAKVAALPAVNGVRGAVLLASGTFLLNGPIQLNQDGVVLRGSGSGAGGTVLKAQGSGHAMLSLGGASARLTPVGSTAIISDSYVPSGSRVIHVASASGFQPGDAVMVRRRASAEWIHFMDMDQLVRDGQAQTWINAGNNNEIWLRTVAAVSGNQLTLDIPLSDSFDSGYLGTNGGSVQKYQASGIAAQIGAEHLALEGLPNGSGTDYGVANLDNLADGWLNDIQAHNFTNGVVVGKQARRLTLESIALNHDHNNVDCKGAKAFEFSIAGSQVLVDRSASTGSKKSFYYATQAQAGGPNVLLHFSGRAEACGNIEPHQRWATGLLVDNADISGAIALGNRGADGSGHGWSMGWGVAWNAKADQLAIAAPPGATNWAIGSSGALTPNVPDAQGVPVPPKLGTVDSVNVRVGPDSLYLMQLCQRLGPQAVKNIGY

SEQ ID NO: 5199 - protein, 210 aa, Chromobacterium substugae
MNKPEFFVDTSMGELLAQTRRNFAKRPRWWHGVCGRLLHTHPPTFIAAEDGLQEIYRQQRLLFNHGSVRWAALVQANRLLFEVGGYDHPLLLLHSGDPYFDRQPQALAVLASDLYQLKNTEQADEERARLAQLVTDEMGRCLSMTLPQAWSERPVEASTAMFFRRYAPNARITGRWYPILTHPSTPAVLQLPKLFWPERLAQMWENGDLH

SEQ ID NO: 5200 - protein, 113 aa, Chromobacterium substugae
MSEELKMEDLVVGEGKEAVRGALITTHYTGWLEDGTQFDSSIDKGRPFQCVIGTGRVIKGWDQGMMGMRVGGKRKLWVPAHLAYGERQIGDRIPAHSNLVFEIELLEVLTRDE

SEQ ID NO: 5201 - protein, 267 aa, Chromobacterium substugae
MKMPKLGVGTFRLKDQQAEESVAMGLELGYRHIDTAQIYRNEADVGRAIAKGGVPRGELYVTTKIWTDKFGPGLLIPSLRESLDKLGLDSVDMALIHWPSPKDEVPVAVYMEQLAEAKQLGLTRDIGVSNFTIAHLKQAMDAVGADAIGTHQLEVHPYLQNLKVRDFCREHGIALTGYMPLAYGRVVSDPVLQAIGQKHGATAAQVALAWQLRQDIAVIPSSTKRANLAANLDALTLRLDEDDMARIAKLEDGGRIADPDFAPAWDA

SEQ ID NO: 5202 - protein, 397 aa, Chromobacterium substugae
MPLALWALTLSAFAIGTTEFVIVGLIPTISASLGVSLPSAGLLVSLYALGVAVGAPLLTALTGRLPRKWLLIGLMALFTIGNLVAWQAPGYQALIAARLLTGLAHGVFFSIGSTLATGLVPKDKGASAIALMFSGLTVALVTGVPLGTFIGQHFGWQATFLAVSLLGVVALLGSLALVPSNLPKPAPASLSSQLAVLAQPRLLLVYAMTALGYGGSFTAFTFLAPMLETVSGFAPGAVALIMLLYGVSVAIGNIWGGRLADRKGPVAALKIIFAGLALVLLALTFTAGSKWLVALTVLAWGAVAFGNVAGLQLYVVSQARARVPQAVDVASGLNIAAFNVGIAGGAWLGGHVVASLGLMATPWIGALIVLGAWLLTAWSGRLDAGHASGMTVAAGRI

SEQ ID NO: 5203 - protein, 315 aa, Chromobacterium substugae
MLSTESLITFIAIMDCGSFTAAAEQLGVTASNVSRSLAQLEKQLGVRLLTRTTRRLELTEEGAWLLERARAIAQSLDDAEQQLQAAAARPSGLVRVNAAIPVLNHLLAPLLAGFQARYPDIRLELTGAEAVVDLIEERADLAIRVGPLADSTLNARLLCESPLRIVAAPGYLRQRGHPRSAADLPGHRLLGFTSPATLNLWPLGARGLKVSPSPAASSGATLRALALQGCGIACLADFLVGPDIAAGRLADIRLPEQQDWKQPIWAVFYKQGRPQPRVACLVDYLAAALAEPAGGSPPASQHAAAAANPSPAHPT

SEQ ID NO: 5204 - protein, 236 aa, Chromobacterium substugae
MVVGVGDQAFPPYKLGNQTLDPRRPGLSVELVRLASQSCGLQADFRLLPGARLLKELENGNVDAVMMLSYTPERARFAVYPLRSGLPDEARRLATLSYVLYALKGSRLAWDGHHLSNQKRAIGTNAGWSINLDLQRMGIPAEAANSVEQNFDKLLSRHIDGYAVHESLGDAYLARHPALPARKLSPPISTKPYFLPFSRRYAATQPRQMQCVWQAIAANRDELLRQRIAAYLDDKR

SEQ ID NO: 5205 - protein, 51 aa, Chromobacterium substugae
MKIFILLSLLIALVAYLSGNSVWWGLAPIGVAAILLLLLIVMALVQLKQRR

SEQ ID NO: 5206 - protein, 39 aa, Chromobacterium substugae
MHGVSPVDSGMDAVWRYGAADGALIARKCVLRRSSRGQR

SEQ ID NO: 5207 - protein, 260 aa, Chromobacterium substugae
MQLNGKVALITGAASGIGKEIAIVYAKAGAAVAIADINLDAARKTADEIASAGGKAIGVAMDVTNEDAVNQGTQQVVDAFGRLDILVSNAGIQIVNPIVNYSFADWKKMQAIHVDGAFLTTKAALQHMYKDKQGGVVIYMGSVHSHEASPLKSAYVAAKHALLGLARVLAKEGAPYNVRSHVICPGFVRTPLVDKQIPEQAKELGISEDEVVKRVMLGNTVDGVFTTVDDVAQTALFLAAFPSAALTGQSFVVSHGWFMQ

SEQ ID NO: 5208 - protein, 402 aa, Chromobacterium substugae
MAQTKLNPACHVDAGIHHSPALPAGHRYQVVALVLQGGGALGAYQAGVYQGLAEANLHPNWVAGISIGALNAAIIAGNPPETRADKLEQFWNTISRQPLLPPSPHNLLDLGQTLPPSLQGLFNGWEAWRALTEGQNGFFVPRKLVGAGSLLRPGNASFYDTSPLKSTLEKLVDFDRLNDSGEMRVSVGAVNVRSGNFVYFDNTRERLRAEHFMASGALPPGFPAVEIDGEHYWDGGMVSNTPLQQVLTAQPRKHSLVFQVDLWNARGALPEDLSKVALRQKDIQFSSRTRMITGYMQEAQQFRQMLREVLELVPEEKRQAPAYRRAAQQACDRLFNVIHLIYQDKPCEGHYKDYQFSASTMREHWQSGLSDIRRSLSHPDWLQMPPPERPFTTHDVHRLHQA

SEQ ID NO: 5209 - protein, 245 aa, Chromobacterium substugae
MAAIQDKVVAITGASSGIGAATALLLAERGAKVVLAARGERRLRGLAERIAQAGGHCAWTCADVRRREDASRLVRLACERYGRLDALINNAGVGPISPLDELRVDDWEQMVDVNIKGVLYGIYAALPVFRAQGFGHFINTASTAAQRILPNMAVYAASKAAVRAISEGLRQEAGDKLRVTVISPGFTRTNFAESMTNRAVKAHIAASMQAFALPPEAVARAIAFAIEQPADVDVGEIIIRPTAQA

SEQ ID NO: 5210 - protein, 315 aa, Chromobacterium substugae
MIVQISMDPLSDIFHLLKVESVLSARIEAHGAWSLRFSAYQHIKFGGVLAGSFWLWFEDGAPPLRLKPGDFYLLTQGQPYCAGSDPALAPVDGREVLAANLCADGIVRYGQGGETVSAAGGRFVFEPHSSALLLQALPPLIHIPAASASAQALRATLELLRLETEASRPGASMAAASLANMVLVQVLRAHLASGAHTPGWLGALADPRIGKALGLMHADVARHWKVEELASAVAMSRTSFAERFRARVGMAPIDYLTRWRIAKAGAALRAGQSLAAVAQSIGYGSEAAFHTAFKRIVGHSPGRYRRRQAAEPAQR

SEQ ID NO: 5211 - protein, 100 aa, Chromobacterium substugae
MALAAEDAFGERDEALVTTMSKADFPPGIKVGGQLQRPGPDGQPLYYFVTKIKGPTVLLDGNHPLCGQDLRFALKVIDVREATAEEIAHQHVHGEHGHQH

SEQ ID NO: 5212 - protein, 313 aa, Chromobacterium substugae
MFAKAVELGSIRKAAQAQGVSPQAATQTIALLEKHLGVRLLHRTTRSLALTEEGLQFLEDAQPALATLERAVSTARAGREGISGPLRIVGPKSSFASILMPLLDTFCREHPGVRPDVQLDDGIGNWVLERVDVGFRIGASAQDGVISRRLFPIQLIVCAASDYLARHGMPDTLEELAAHRCSIFRHPSSGKVSPWYLTIDGSVVQRHFSPAFYSNDTELELQAMLAGQVIGQVANLSAAPHIRAGRLIPVLLPFMSAPIALHVYYGSRAAQPSRVRSFLDLAISKLSDSPDYVLSSIELAAAHAAFAARRYPL

SEQ ID NO: 5213 - protein, 284 aa, Chromobacterium substugae
MNHMKETLVVVGAGQIGQAIARRIGVGKQIMLASLRIEEAEQAVELFRHAGFSATAASVDVSSRASVSALVEQACQLGPITGLIHAAGVSPSQAPVAAILRVDLYGTALVLELFGNVMASGGSAVVIASQSGHRLPALSQQQDRLLALTPTEELLQLDFLQPGQVLDTLHAYQLSKRANSLRVMAEAVRWGPRGARVNTISPGIIITPLANDELNGPRGAGYRSMISASPVGRAGTPDEVGHVAALLMGPDGTFITGSDILMDGGVTSAFRFGDIAQPVAQGGA

SEQ ID NO: 5214 - protein, 352 aa, Chromobacterium substugae
MSYRVKSYAAQSSSSPLAPFQFERRIPRADDVVIEILYCGVCHSDVHNVRNDWGNANYPMVPGHEIIGRVIATGAGVTRFKEGDHVGVGCLVASCQRCDACDHGHEQYCQNGATYTYNHTDPIDGTRTFGGYSEKIVVAEDFVLKVPNTLDLAGAAPLLCAGITTYSPLRHWKVDKSSKVAIVGLGGLGHMGLKLAKAMGAEVTLFSRSPGKERDARRLGADHIVISTDVQQMAAIAGRFDLIINTVPYKHDVNPYIPTLASGGTMVMVGYLGPLDNFNTGPLVFRRKALAGSLIGGIAETQEMLDFCGLHGIHSDIELIAIQDINQAFERMLKADVKYRFVIDMNTLKESI

SEQ ID NO: 5215 - protein, 41 aa, Chromobacterium substugae
MNHIAIQEALDGKSATWQEAVSDADYLGGKLDVNLSDQSPP

SEQ ID NO: 5216 - protein, 609 aa, Chromobacterium substugae
MCGIVGAIAKRNIVPILVDGLKRLEYRGYDSAGVAVLAGDEIRRVRRVGRVAEMESAAAEESLQGQLGIGHTRWATHGGVTEYNAHPHISFGKIAVVHNGIIENHEEQRQRLKDLGYAFESQTDTEVIAHLVHHYYQSGDSLFDAVKKATRELTGAYAIGVIALDRPDELVCARMGCPLLVGLGEGENFIASDVSAILSATRRVIFLEEGDIGHLTRDGVKLMDKHDQAIERPVHLSDVSLASLELGPYSHFMQKEIHEQPKALSDTIEAVQDYGFNPELFGDAAAGILPQLEGVKILACGTSYYAGLTAKYWIESIAGLPCDVEIASEYRYRDAFANPKHLIVTISQSGETLDTMEALKYAKELGHQYALSICNVRESAIPRASDLVFYTRAGAEIGVASTKAFTTQLVGLFALAATLGKARGRVSAEMEAQYLDELRHLPGSVQHALNLEPQIKAWSERFAAKDDALFLGRGLHYPIALEGALKLKEISYIHAEAYPAGELKHGPLALVDENMPVVVIAPNDALLEKVKSNMQEVRARGGELFVFADADSHFSESDGVHVIRTPRHVGILSPIVHTIPVQMLAYHVALSRGTDVDKPRNLAKSVTVE

SEQ ID NO: 5217 - protein, 264 aa, Chromobacterium substugae
MTKRNTQQRRHAIATLVQERGEVSVEELTQRFATSEVTIRKDLALLETGGLLLRRYGGAVSLPSEMAAEPDVGQVSKRKQAIARAAAERIRDHNRVIVDSGTTTSAMIPLLGSKRGLVVMTNSLNVAGQLRELENEPILLMTGGTWDPHSESFQGQIAEQALRSYDFDQLFIGADGIDLERGTTTFNELVGLSRVMAEVAREVIVMVESEKIGRRIPNLELPWDKIHTLVTDDGLAQDARDKIQAKGVTLICAPAVQDSSARRK

SEQ ID NO: 5218 - protein, 454 aa, Chromobacterium substugae
MDSLSIVILAAGKGKRMYSTMPKVLHPIAGEPMLARVIRTARGLNPSRLVVVYGHGGDQVRARIPDADIVWAEQTEQLGTGHALKMALPHLPQDGKTLVLYGDVPLTRASTLQRLIDAAGSGMAVLTDVLADASGYGRMLRGADGKLKAIVEHKDCTAEQLAIREINTGMMALPNAQLAGWLNALNNGNAQGEYYLTDVLELAVKDGVAVESASVDASWEAAGVNNKLQLAELERILQTNQARALLEAGVTLADPARIDIRGELKHGMDVSIDVGCVFEGVVELGDKVLIGANCVLKNVKIAAGSQIAPFSHLEDAMVGEECRIGPYARLRPGADLAGHVHIGNFVEVKKSKIGDGSKVNHLTYIGDAEIGRKVNVGAGSVTCNYDGVNKFKTVIGDDVFVGSGTLMVAPVTLEDGATIAAGSVINKTAPAGELTVARARQVTIPGWKRPQKKS

SEQ ID NO: 5219 - protein, 140 aa, Chromobacterium substugae
MSKMRVEVVSTEQLIFSGEAEFVVAPATEGEIGVYPQHVPLLTRIKPGVLRLRVPDSKEEVLVAVSGGMMEVQPSLITVLADTAIRGEDLDEARANEAKRAAEDALKHATDDMSTAKAHAALAVAIAELKTLDYLKKRAH

SEQ ID NO: 5220 - protein, 465 aa, Chromobacterium substugae
MSQGKIVQIIGAVIDVEFPRDAMPKVYDALKLVDADLTLEVQQQLGDGVVRTIAMGSSDGLKRGMAVASTGAPISVPVGAATLGRIMDVLGNPVDEAGPVATEARRAIHQAAPKFDELSAASDILETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEHFRDEKDENGKGRDVLLFVDNIYRYTLAGTEVSALLGRMPSAVGYQPTLAEEMGRLQERITSTKDGSITSIQAVYVPADDLTDPSPATTFAHLDATVVLSRDIASLGIYPAVDPLDSTSRQLDPLVVGDEHYTIARGVQSTLQRYKELRDIIAILGMDELSEEDKLVVARARKIQRFLSQPFHVAEVFTGSPGKYVPLRETIKGFKAILAGEYDHLPEQAFYMVGSIEEAAEKAKTLN

SEQ ID NO: 5221 - protein, 288 aa, Chromobacterium substugae
MAVGKEILTKIRSVQNTQKITRAMQMVSTSKMRKTQERMRAARPYAEKVRTVMAHLAQANAELGHPLLARRETIKRAGIILVSSDKGLCGGLNVNSFKRFFAKVKELQDQNVEIDVCCLGQKGLGAAQRARLNVVASAVHLGDTPKMEKLIGPLTVLFKQYAEGELDAVYIVYSSFVNTMKQEPALEQLLPLTPHHMVVEHSHSWDYLYEPDAPTLMEFLVRRYLESVVYQALAENMASEQAARMVAMKAATDNAGNTIKQLRLVYNKARQAAITTELSEIVAGAAAV

SEQ ID NO: 5222 - protein, 514 aa, Chromobacterium substugae
MQLNPSEISDLIKAKIQNLAEGAEVRTKGTVISVTDGIVRIHGLADVMQGEMLEFPGNTFGLAMNLERDSVGAVVLGEYEHISEGDEVKCTGRILEVPVGPELIGRVVNALGQPIDGKGPVNATKSSPIEKIAPGVIARQSVSQPMQTGLKSIDSMVPVGRGQRELIIGDRQTGKTAVALDAIINQKGNGVICIYVAVGQKASSIANVVRKLEEHGAMGHTIIVAATASEAAALQFIAPYSGCAMGEYFRDIGEDALIVYDDLSKQAVAYRQISLLLRRPPGREAYPGDVFYLHSRLLERAARINEDEVEKLTGGAVKGKTGSLTALPIIETQAGDVSAFVPTNVISITDGQIFLETDLFNAGIRPAINAGISVSRVGGAAQTKVIKKLGGGIRLALAQYRELAAFAQFASDLDEATRKQLSHGEVVTELMKQKQFSTLSTAEMALTLWAVNKGSYEDVPVKKALAFEAEFLANVRANHAEVLQAVNASGDLSADNEKVLAKAMESFKAGYSFN

SEQ ID NO: 5223 - protein, 178 aa, Chromobacterium substugae
MAELITVARPYAEAVYSLATEQRSLDQWSDALSWLAAMVNNPDLAQVVTNPKHTAQEVEALMLDVLGGRGNEDVKRFIAALIENARLTLLPEIAAQFELLKAQSEDIVDAQVESAFAMSDAQQAELTTTLSKKYGKTVRLDVRENPDLIGGVRVLVGDDVIDASVRGKLQAMAASLKN

SEQ ID NO: 5224 - protein, 156 aa, Chromobacterium substugae
MEFNVTLLGQAITFAILVWFTMKFVWPPLTNMMDERAKRIADGLAAAERGKQDLEAAEKRVADEIRKAKQQATEIVVAAEKRANQIVDEAKDAARTEGARIVADAKSEIDQEVLRAKESLRAQVAELAVAGAEKILRKEIDAAKHADLLASIKAEF

SEQ ID NO: 5225 - protein, 95 aa, Chromobacterium substugae
MEALVSQIQSMTAIAAALIIGLGALGTAIGFAILGGKFLESSARQPEMIPVLQTKLFIIAGLLDAISMIGVGVAMLFTFNNPFLAAALAVVKAAH

SEQ ID NO: 5226 - protein, 270 aa, Chromobacterium substugae
MASNATDYIKHHLTFWNSDPSAGFWSLHVDTFSISLLLGFLFVGVFAMVARRASIEAPGRLQLFVEMIIELVQTQVREVFHGKSKMIAPLALTIFCWVFLMNFMDLFPVDLFPMAAQWIGYTFFGLEPHHVYFRVVPSADVNSTFAMSLSVLILIVGFSIKAKGLGGWGKELLTAPFHSSHPVGAVILAPLNFAFQLVELAAKPISLSLRLFGNLYAGELIFILIALLPWGLQWVLGAPWAIFHILIITLQAFVFMMLTIVYLSLAVEAH

SEQ ID NO: 5227 - protein, 112 aa, Chromobacterium substugae
MLRLQASLVGLAVLISLLVGAGSLVVAVSTLLGGIVVLVPALVYARIAYAKRHVPPAALIKAHFLAEAVKFCLTVLLSGAVLAGFKDLSVVGFLGGFFAAISGYGFGLLIKN

SEQ ID NO: 5228 - protein, 285 aa, Chromobacterium substugae
MAKLKGLGRGLDALLSTVDTVDDRLTSLPIDSIRPGKYQPRSFMDETALEELAASIRVQGIIQPLIVRDLGLGDYELIAGERRWRASRKAGLVEVPVVIKSVPDEAALAMALIENIQRQELDPIEEAQGIKRLIDEFGLTHESAADAVGRSRSAVSNLLRLLVLPQPLQQMMHEGQLEMGHARALLSLPTVAQLELAQEVVRKGMSVREVERRVQQHDAQKTTVAAQQNRVDPDVERLENQVSEAIGAKVSIRHANGGNGRLVIEYASLDELDALLEKLQKKPQK

SEQ ID NO: 5229 - protein, 263 aa, Chromobacterium substugae
MNPRVIAVANQKGGVGKTTTVVNLAAGLAELGKRVLIVDLDPQGNATMGSGIAKQSLEKSGYDVLLGEASVEEARQDAKAGGYHVLPANRDLGGAELELVNELAREARLKSALAEVEDQYDYVLIDCPPSLNLLTLNGLVAAHSVLIPMVCEYYALEGLSDLVSTLRKVRLAVNPKIEIMGLLRTMFDARNNLSQQVSAQLARHFGDKVFQTVIPRNVRLAEAPSHGLPGLVYDRNSRGAQAYLTLAQELIERLEPATATPTV

SEQ ID NO: 5230 - protein, 209 aa, Chromobacterium substugae
MTQHIAELQQGLAALALDFTESQQVLLQRYLALLVKWNQTYNLTAIRQEERMVSYHLLDSLSLVPHLAGGARMLDVGSGGGMPGIPTAIARPDMQVVLLDSNHKKTTFLRQVVVELGLANVQVVTDRVEAYQPEQKFDRITSRAFSELAEFVKLTRHLMAEDGQYVAMKGVYPYEEIALLPQGVAVSEVLPVTVPGLDAERHLVRMVLQ

SEQ ID NO: 5231 - protein, 633 aa, Chromobacterium substugae
MIYPTSFDVIVVGGGHAGTEAALAAARMGCATLLLTHNIETLGQMSCNPSIGGIGKGHLVKEVDALGGAMALATDIGGIQFRTLNASKGPAVRATRAQADRILYKAAIREMLENQPNLTLFQQPVDDLLMDGDRVAGAITAIGITFRAKTVVLTAGTFLSGKIHVGLENYTGGRAGDQAASTLGARLRELNLPVGRLKTGTPPRIDGRSVDFSVMEEQPGDTPEPVFSYRGKRDMHPKQLPCWITHTNERTHDIIRSGFDRSPMFTGVIEGVGPRYCPSIEDKINRFADKDSHQVFLEPEGLTTHEFYPNGISTSLPFDIQLAAVRSIRGMENAHILRPGYAIEYDYFDPRGLKASLETKAIQGLFFAGQINGTTGYEEAAAQGLLAGLNAGLYVREQAAWCPRRDEGYLGVLVDDLITKGVSEPYRMFTSRAEFRLQLREDNADLRLTEMGRKLGLVGDAQWDAFCRKRDAVEAEKARLAATWLHPSKLQAPDALANVLGKPIEREYTLSDLLKRPNVAYRDLMSVPDAAAGAPELDEVVAEQVEIQVKYQGYINRQNEELARRDNLEDIRLPGDIDYSLVKGLSKEVQQKLNQQRPETMGQASRIQGITPAAVALLMVHLKRGFTDATKTA

SEQ ID NO: 5232 - protein, 249 aa, Chromobacterium substugae
MLLNEQLAGRSKPRLAVRLAAGAEDIRRAQKLRYDIFAGEMGAELASRDLGIDCDEYDELCDHLIVEDHNSGMVVGTYRMLSPANARRAPRLYSEHEFDLSRLSHLRDGLIEMGRSCVHRDFRSGAVIALLWSGLADYVSQRGGEYLAGCASVSLTDGGHQAVSLYRQLEGQYLAPAEWRVFPHLPLPLDRVVDDTAPVPLPPLIKGYLRAGAHVCGEPAWDPDFNCADFFMLLPMSRLNARYNKHFIG

SEQ ID NO: 5233 - protein, 228 aa, Chromobacterium substugae
MTYAFEAVGVIRSPYREKFGIPRQPSLVNAARVTLELLPPYNHPDCVRGLSEFSHVWISFIFHQTMARGWQPLVRPPRLGGNAKVGVFASRATHRPNPLGLSLVELAGVECDNGVRLHLAGADLLDGTPVVDIKPYIPFVESRPQARGGFVDGPPPQLTVRWSEQALRQLATLAAPPDLALLVEQVLAQDPRPAYQDDPGRVYGVSLYCYNIRFGIREDIATVLEILE

SEQ ID NO: 5234 - protein, 333 aa, Chromobacterium substugae
MTTRAKTIVLAFTMVSVLATPFAEAARLGKGKSAGMQRSAPTRTYQPSTPAPQPMAAPAPRPGAPAQAAPQKSGPGIGTALAAGAVGAAAGYMIGSSGNEKQAAPAQQNAAPVEQPAQQAAQSAPAQQEKGGMPWGMLALLGLALVGGMMFFRRKAGNPAANAPQPAGMPQGMNSQAGGFDAVPKIGSGLDNGNSGFGGGFNSAAPAGGAPARLPDGTETPNFLRQAKATFLHLQSLNTPESLEEVRKYLTPELFEALRGDIADNGAVADFPQLDCQLSDASVENGRYIASVRFSGQVSEEVNAPLAPFGETWHYIKDGNTGGKWLVAGIQQD

SEQ ID NO: 5235 - protein, 400 aa, Chromobacterium substugae
MTAFEHAGLKIGSHFQPIYSLAHRRSIGVEALLRAEQGDVALSPAEAFYTAVSPEKRHQLDLAVCQAHIQRFLQLPSDQPRWLFLNLDAASLSRPDRAMALVNNIRQAGLEPHKVVLEVLEHVLEVDEALIEGVNILKNNGFMIAIDDFGVGHSNLERVCQLEPSLVKFDRQLLRNAIQQPRSRSLLTRLVRLMHEIGAMVVVEGIETERDVLVAMDSGCDLIQGYFIAHPAEQPTSDEIITPKLDERWDELMAHALLKRKLTRRQIELARQCFVQSAISLMQGTPFDLAAKPMLSLPDVIRCFLLDSEGRQIGRNLNSRQSTAATDPRYAPLADTTGAVWSRRSYFQHAVDQPGVLYMSEPYLSMTDPRSCVTMSMAIEIDEYMHVLCADLLVPQASTV

SEQ ID NO: 5236 - protein, 145 aa, Chromobacterium substugae
MKNKLLLPLALLPVLAWADCGAGAKTVFACTTKAGKKVELCDAGKTIRYAFGKPGAPEIALSVERKRASTGQWTGVGSPSYTVNVPNGDTVYTVFWGVDRNVESLPVEAGVHVYVKEKWAATVYCSGKKPILQEMEDIKLPAEVI

SEQ ID NO: 5237 - protein, 195 aa, Chromobacterium substugae
MKRSVFALLLAAGCASVLSGCVGLVAAGAAGGALVASDRRTSGAYVDDQAIELKSGEQIANRLPSSHVNRTSFNRAVLLTGEVPSDEARQQAELIARGIPNVRRVYNYTVVAPVSGFSERSNDTWLTSKVRARLLDGKGVNPNNVKVVSEAGVVYLLGLVTQGEGAEAARVASETAGVQKVVTLFEYIQDVTPAQ

SEQ ID NO: 5238 - protein, 196 aa, Chromobacterium substugae
MDLIDRVNGHFLESIAAKQEAMELLSPGVAAAAERMVACLMNEGKILACGNGGSAADAQHFAAEMVGRFEKERPGLAAISLATDTSALTAIGNDYDFDMVFSKQVRALGHTNDLLLAISTSGNSANVIEAIYAAHERGMSVIALTGKDGGKITEILSPEDIHLNVPSLRTCRIQEVHILLIHALCDAIDCMLLGGE

SEQ ID NO: 5239 - protein, 112 aa, Chromobacterium substugae
MNQAGREAEDRALALLQAQGLKLVARNWHCRGGEIDLIMREGACLVFIEVRHRGGSRFGSAADSITQAKQRKLLLAAEVYLASHKIDASCRFDAVVSVGGAKPQWLKNIFTQ

SEQ ID NO: 5240 - protein, 379 aa, Chromobacterium substugae
MQRLTPLLVGVLLTWLAPAMAQTPDYIIQSNSAPIRALSAPPGQTPRLAPAQPVAAAPLAALASAPAARSAARARVRIGVILPVESSALGEAAAVVRSGVEAAAQVEQNAELVSVDATTDNVVQRYRAAVADGVNVVIGPLSREAIAQLAPAVTVPTIALNSIDRQAAANPKLFSLSLVVEGEARQLARLMRDDGRVNPLLVEGGDALSQRLAKAFADEWRALTGKDAQRRPFDGGNLPALLEASGQADALALALDAAQAAKLKAALTPDMPVYGTSQLNIGGNQPELAGVRFIDMPWFLMPDHPAVKRYPRPAAALTPQTERLYALGIDAYRLAVQMAASRPGAAVRLDGVTGDLKLGRDRVFERQLPAGVMGGNALR

SEQ ID NO: 5241 - protein, 276 aa, Chromobacterium substugae
MVATPIGNLADISARALAVFEAADVVCAEDTRVTGQLLSAYGIRAKRLVSLREHNERGMAEQVVRWLGEGQIVAQVSDAGTPAVSDPGARLVEAVRAAGHPVRPLPGASAVIAALSASGFTAPTFLFHGFLPPKSGERRKTLQQWLDAPHLTICYEAPHRIVDALQDIVAELGGERRVMIARELTKTFETFHALPAAELLEWVKADSNQQRGEIALILDAAPAAAPGADDMPAEALRVLQLLAAELPTKQAATLAAQITGANRKQLYDHALKLKKD

SEQ ID NO: 5242 - protein, 392 aa, Chromobacterium substugae
MALTDLAIRQAKPQDKPYQLADGESLYLEVSPSGGKLWRFRFRFQGKAGILALGKYPAVGLSDARQKAHEARVQLAQGINPSQAKKEAKVVAQIAATNAFELVAREWHEKQLDRWTPDHARRVMDSLEIDAFPDLGKLPVPDLTAPLILNTILKIEKRGAVETAQRVLQRISAIIRFAIQTGRATDNPAVNLVGAIRAKKVEHRPALPRGELREFYRRLATEPLYIPTRIAMHLLMLTFVRPGELRAARWEEFDEERAEWRIPAERMKMREPHLVPLSRQALELLKELRPLTGKSALLFPAVTDLKKPMSENTLGYAMGRMGYKGTATPHGFRALASTVLNEEGFDPDIIEKQLAHAERNKIRAAYHRAEYLEERRKMMQWYAEFLDSHQSR

SEQ ID NO: 5243 - protein, 72 aa, Chromobacterium substugae
MTAIAPSLTAQPLRFLRLPEVISTCGLSRSSVYDAIKRGSFPAPVPLGGKSVAWLSSEIDVWMAGRIAARHA

SEQ ID NO: 5244 - protein, 241 aa, Chromobacterium substugae
MHIQNPNTQETVAFAVAGLTERLATFEQDLNAWQTLADSAARRIQTAEALRNEAEQTRKDCRQAMRATLGIPTKAVRELKSKEMANLELAEETLKIAAEEKIQAEVQQEALFEQRQALAKEREALRHQYWNAVLDDQIAQWGQQLPVLALLLDQAPRACIERLFGRAELRRNQDEFYAAQLPGELQQALQAAPQAEPDELLTLLNHPLPPLAEPASMQHNPLARMRYQAERDAQYQALINR

SEQ ID NO: 5245 - protein, 329 aa, Chromobacterium substugae
MQNTTRQALDHFIGRYFSHMDAHQTQDSCHAAPEPQAAQARINALKTHSRLLSAINILGVANIKGRSQNFDLAGTLAATVDTNRHACQPAQKTWQPAQYFCRQTNFDAAFDYEMLDAWMSETQDQALFEARARHTLERRILLDRVMIGFRGLMRAADSDRAKHPQLQDVNVGWLQQIREQAPKACLERVRVGEGQRFHNLHRLVRHAVNHLLAPAWRDDPLLVALVGADLLPDAVCESNGQAAPVDDLVFHKQRLGGLQAATAAFFPGDSILITRLDNLSLYFNQNAVRYRYQEDPAINSVLFYHSSEDAYVVENLAACALIEDVEIVD

SEQ ID NO: 5246 - protein, 93 aa, Chromobacterium substugae
MAFPCPLCGAVSRVRTSRMLTATAKEIYYNCSNDDCCHQYKTMESEPRTVAQPIKGGALIPPERLRALSSLAKPAPPPALTVTPGRIQHKVLK

SEQ ID NO: 5247 - protein, 80 aa, Chromobacterium substugae
MLMDLIIRSSISSCKQEMKRLKRELESVHEKYEAVLDIAYDNDLTDDEINRQLEMASEISHAGVRGWLAKHREKLKVVSK

SEQ ID NO: 5248 - protein, 58 aa, Chromobacterium substugae
MPNIALRTFRALFPQSTRPVSTLPNEAQARALAALLVAQGQRALIHRTAAGFAVEVIA

SEQ ID NO: 5249 - protein, 108 aa, Chromobacterium substugae
MNALPLIAPLALSAVHHQLAQLQLLANSPEHAALRDPLSQLASLCQGIEHTVSAGVSRLARTGDGLQGLVELLDCAEDQPLPAQRLAGLLAPLQQQVIDASADIGQLL

SEQ ID NO: 5250 - protein, 340 aa, Chromobacterium substugae
MRLDLAQLRLQARDRWPDILMALGIPAEVFTQRRNQPCPACGGSDRFEWIDKGSGRFVCRALDSQGGDGFVLAQHWLGGDFFHAAQAVAQVLNGAKGEPARVSAAPATTHPQRDQRERLAQLWRAARPVKADDPVGRYLLRRGLSLTAYPRALRYHPALAYWITLHGRPQLLGHFPAMLALVTSPQGINVGLHRTWLTLDGHKAALRHPVSGEALPAKKLALGRSGDLSGAAVRLYPPTDGRLALAEGIETALAVREGSGLPCWAALSAWGLSHAVLPDEVSALFVMADNDANQAGQNAARRLARRMQEDGRPVHLLIPERPDSDWLDVLNEQGEPNGQR

SEQ ID NO: 5251 - protein, 604 aa, Chromobacterium substugae
MGSADKQALKMAAKAPALAIGPRYEVNRDGVHYIAVKRDRDTGELLEQPPEWLSDKMELLGCGTDADGNHHRIVKWQRQGNGEVMTTALPSADIGERAGWALLRKGGLTLTTDRGGQARLAHWLQREGSTEWHDIVNMSGWQHGAFVLPNGDIIGRPNRKMHFNGRPKDASAYHPAGSLADWQSTVGALALGNPLAMTTIACALAGPLLALCGARDGIGLHLYTNSSSGKSTCADTAASVWGDPQRTLHTWSGTALGLTNEAEASNDMMIYLDEVGSGDARKIGPAIYSMLNGVSKLQGAKEGGNRAARSWKLTMLSTGEVAMSQYLTEGGQTPRGGQEIRLLDIPADTGPYRAFDHIHGRSNGEVFADELTRHARSHYGTVGRAFVAWLQDNRAAAVQWVEQSQQRMLAAVPEGAAPTVRRATRKFAILSAAAEMASHAGLTGWTVEQAIQGVETTWQRWMQAFGIEDRDDARLIDQAAAVLQASQYARFVLLPMNDSDPLVPNLMGYKRYTLEGEAVFLVTPGAFKGEVIAGYEVRHACEVLYRAGMLQRPKGGAPVGPCMAAKAWARSTACSCIRTTAKRKSKRKISHVRPNPLPTLPTPI

SEQ ID NO: 5252 - protein, 138 aa, Chromobacterium substugae
MPCITRSPSHLALSLKNRHPARSRWLLHNQAPTHPPSLLAMTRLHEAFAALQAQLASQDQSMVREPAARVAHLCHDIEQAVVESICHLSHGQLGLQSVIDLLACLGDDVRLPSSRITELLSPLDKRMNESLTLLTRVL

SEQ ID NO: 5253 - protein, 56 aa, Chromobacterium substugae
MLRDINEQLGYSQPARFDLFSGVQSLIENSKMIGRYDQVRAQAHGLQILKAYQTNQ

SEQ ID NO: 5254 - protein, 496 aa, Chromobacterium substugae
MGANVKSILALACLQLSLALLPLGARAEAPLGAAQQKTNYQAARAYYQQLLADKGRVAELGMLMNMLPKGGDLHHHYTGALYAETYLDWVDRQKYCVYQATLRIETKPEQAQPGAACLSGSQIKDDNALYRKLLTLWSDKDFDNHSHDQPPPDKQFFDTFGYFGGVSGYSPREGLQLLKTRAKAENLQYLETMLRGAPSGNSALAANLDSLAPDAAPAAIEQALGQAASALAADASTAEQVQRYRQDLAGFAQGMDDDDFTLRFQTYVSRNNKPSITFAGLYAGFAAAHDNPLVVGLNIVGPENGIVAMRDYALHMRMIHFLKQRFPDVKLALHAGELVLGMVPPEGLRDHIRLAVELAGAQRIGHGIDVGHESRPDSLLNEMRRRDVAVEINLTSNQFILGVQGAAHPILLYRKYGVPFVISTDDEGVSRSDISNEYLLYVSRYQPSYDELKRTVYNSIRYSFLSPADKARQRQRLDQRFAQFEARAAALRKMGR

SEQ ID NO: 5255 - protein, 67 aa, Chromobacterium substugae
MQAGQSQYRFHIRSHSHFDDGITVTAAQGNRKDGGVAAWPAGQRPSGQTRSVPAVTKNNENSYLGQL

SEQ ID NO: 5256 - protein, 119 aa, Chromobacterium substugae
MLQNYFPILLFILIGLLVGVVPLLLGKLLGPNRPDAEKLSPYECGFAAFEDARMRFDVRYYLVAILFILFDLEVAFMIPWAVTLKDGLGLFGLGAMAVFLAILTVGFVYEWKKGALNWD

SEQ ID NO: 5257 - protein, 455 aa, Chromobacterium substugae
MNQEQLQVSIRAQLRAFDDQAFDRLTRALPLADVVEALAAHPPEAVSRLLQAMRPKLAADVLALLPAEQQDELLQRLPQPAVVAVFERLPSDLRADLYKRLSQNEQSRLLPALGRMVRDDILKLASYGEDTVGSVTSSDYAAISPQLTAAEAMAALRAGDRQQIEVIYIVGHEHQLLGTLPLRELVLAPLETSVAELMQHNPAYAEAGWARHRAADLIRHYELLALPVLDEAQRMIGIVTIDDAMDIEREDDTGRLASFGGAAPLDKGNLDVVHSSVRRMFSVRVFWLLILTVFGAITSTFVAQQEELLSNVVILAAFIAPIVDMGGNAGSQSATLVIRSMALGQLKLNWRDVAFVIRRELPVAAALGVAVALLDMVLSHFSKGVGADILLVVGLSMMLCTLAGGVIGAMLPFLAKRLGTDPATLSSPLITSIMDMLGVFIYFGLAYAFLGHLLA

SEQ ID NO: 5258 - protein, 276 aa, Chromobacterium substugae
MKPIARANLILMAAALLSFACAPLRAADASDAAHAANRPAAVFNHGVAVFEQQRELAPRASLRFRVLHGGGGALTLWLKSPAGQMPLPLTPDSTFNPTALSDGQSIVAAPDNHAGPLAWRPDIRSPGLPPHSRRLGDLRLECLVDQQSGLNPQEPRANCLPPARQADCLEQMGDCLRGASLALLAQWHAMHRLQWARATGQPQPARYLFIAKHPLAAIQLAHGEHRLTLPAGWLHGGGAQNGAPWPYPREYLYSLPLDAVEWPDDTLVTFGDAAKS

SEQ ID NO: 5259 - protein, 305 aa, Chromobacterium substugae
MIVRNTSSWFRLLFVWHGSVLPRILPRLLLVFALAILASSIRHWWLTSLADSALSIPTFTLLGVSLAIFLGFRNSVSYDRFWEARKLWGSLVIASRSLARQMISLTGAGPDSRRVADGCCAFAYALKEQVRGQQDDAPLERLLPADVFQRVRAGRYRPALILLWLGEEAARLQREGALSERQWQALDRSLNTLSEVLGGCERIATTPIPFTYRVLLNRTVTLYCLLLPAGLVSSIGWLTPPIAVFISYTYFALEQIAEELEDPFGFEGNDLPLAALCHGIESSLREMQGLPLLDEPAPRQGIYLQ

SEQ ID NO: 5260 - protein, 568 aa, Chromobacterium substugae
MSAARRDYSVDRRLLLLSGLALLAGAVSTLAAAALLDLIRLCTNLFYYQTLSLADRGPAGHALGAWAIAAPVAGGLLVGLIARYGSDKIRGHGIPEAMEAILFGQSRMSPKVALLKPLSSGIVIGSGGPFGAEGPIIMTGGSLGSLLAQRLHLTAAERKTLLVAGACAGMTAVFGTPVAAVLLLFELRPRSLLPVALACACAGFLRGLCFAAGPLFPLSTPPATLAALGSCLLAGLACGALAALLTWGLYRVEDGFGKLRLHWMWWPALGGLAVGIGGRLQPRALGVGYDVIGDLLHNRLLLGALLALLAVKAVIWLLALGSGTSGGVLAPLLMLGAGLGAALAPALPGGSPELWALACMAGVLGSVLGAPLAAIVFAFGLTGDATALLPLTLTTAVACAVTALALKRSIMTEKIARRGLHIHREYSVDPLERLNVADVMTRAAVAIDGALPAADAWRQFFGPRGHNGYPVLRDGKVVGVLLRRRLQEAAASRQPCVVWAEPLSGDQALLAGMSARHAAGRMAQLGVGRLPVVDGPDSMRLVGIVSLADLLANSHLLLREETVRERLR

SEQ ID NO: 5261 - protein, 148 aa, Chromobacterium substugae
MEHTAAPAVGMGKQQYEALSEFRYQLRRFLHFSEEAAKSEGLTPQQYLLLLHVRGVPGRDWATVGELAERLQILHHGAVALLTRCEELGLVARRKSEHDRRQVEVHLTAAGEGHLARLAARHEAELRSLRDVFRVSRITAFNDGDGGK

SEQ ID NO: 5262 - protein, 359 aa, Chromobacterium substugae
MRHLKRHCGDWLRGFWPQAIAASPRDRLAGSLGAAFGLIAAAWLSRHALGEANPWFIAPMGASAVLLFAVPASPLAQPWSIIGGNLCASLVGVSCARLIGDPALAAGAAAALAIALMFPLRCLHPPSGAVALTAVLGGPAVARLGYGFVWHPVLLNSLLLAAAALLFNRLAGRRYPHNQSAAPTPSERVGVSRADLHAALAERGEVVDVSEDDLEDILQRAEERLHQRRFGALRCADFMAREVLSVGADARCADALALLRAHRFEALPVTASDGRLLGEITLRGLLAEAVRPDARVGQWMDPRPHTSSPDDPIERLIHPFADRGVARSMVVDADGRLLGLVGQGDLIAALFREQLERPV

SEQ ID NO: 5263 - protein, 580 aa, Chromobacterium substugae
MSLPRLLFSFVLRHLRPYCLAALMLAAVAALTVMIPREVGRIVDALVAHRLAGGDLLRELAKLLAMGLAIYFLRVGWRLQLFSTSYQLGVELRTRLYRQLSRQGPAFFQRQRTGDLMARATNDIDSVEMAAGEAILAGFDGLLTLVLVLAMMTLSVDWRLALAALLPFPFMAWAFSRISNHIHREWGEALSRFGRLNDHVQETLSGVRTLRSLGLEARNDAELSRLAAAAADSSFEAQRWEAAFEPAVGVSLVSASVIALSVGGYLVWHGQLTIGALTSFNMYLVQLIWPMFAAGWVLSLLQRGSAAWQRLQPALEAEPDVADAGGRAELVPGALHFDSLTFHYAPEAAAALSQVSIDLPPGRTLGVVGPTGSGKSTLLKLLLRQYPLQQGAIRWDGADIADYRLAALRAAISWVPQEAFLFSASVAENIALARPDASQADIERVARLAAVHDDILRLPQGYATPVGEKGVALSGGQRQRVAIARALLADAPLLLLDDALSAVDTQTETQILQHLREARRGRSVIIVSHRLSAVADADHIVALHHGRIAEQGSHEQLLQRDGWYASQWRYQQLEASLDEI

SEQ ID NO: 5264 - protein, 586 aa, Chromobacterium substugae
MKSDATRTQSREAVALLTDAARPDLRHLWLGGGWLLIAALLEAAAPLLGKIFIDSYLLPHRLEWSPVVGLLAGSLALGVIAAVLRYRQLVRLAGVAMRAVLRLRERVYGHVIRLPMAFFDQAITGQLVSRVTNDTESVKALYVQALFVILNSSIVVLGALAAMAWLDWRLMLVTLLLFPATFFIVWLYQRLSAPSVARARALRSDINAQMAESIAGIAVLQASNAESRFVSRFDDTNQRYYQARLRELNANAWLLRPALDLLNVLLLIAVIYSYGQRELGGVEIGVLYAFVGYIGRVVEPLIQITLQFGQLQQAVVAASRVSHLLRETAAPQSAADGAIAAGAVSFRGLRFGYQPEHPVLHELSLEIPAGGFVGIVGHTGSGKSTLLSLLLRFYRPQQGQILIDGQPLDDIGDAAFRAGVGLVPQDPFLLAASARENIDMGRNLPQSEIEEAARAAGVHELILSLENGYDSDMGESGARLSSGQKQLIAIARALAGKPRILLLDEATSHIDSETERLVQQALAKLAGKITLISIAHRLSTIRDADAIIVLNHGRIAETGDHEQLMQLGGIYQRLYLLQQMQTEDEA

SEQ ID NO: 5265 - protein, 178 aa, Chromobacterium substugae
MSLDACAAIRAEVAAITPLDALEAQHRQAALDWIDSGAELWRRAKPATPLVHLSTYFALKDDAGLLLVDHRIAGLWLPAGGHAEPGEHPRDTVVRELFEELGVKGLPVPAASFLTCTKVAGGHTDVTLWYALPISRSLPLRHGQEEFREARWFDFDQMPPASEPHLARFAAKLAKIDA

SEQ ID NO: 5266 - protein, 227 aa, Chromobacterium substugae
MSRLHFLASLLLLSLASLSCRADDGKDLDLSISTELMTRQTAYGNSSRLQPSVDMQYRTRFGALYIQDGEGGWALPAPAGWVSLGVASEPAWSLGGGVSQSLAIARYGFDLPRDGSLSFGYASRIGDSHPGQLLVASLDAPLGDWRGQKFSVLGWASLANQERRLGLNHHDDGAGWQLEQSNLMLVMSHPLSRHWTLDLGAGSRWAAENTGSHTAGWQTLLGFTWKL

SEQ ID NO: 5267 - protein, 262 aa, Chromobacterium substugae
MRFDPLPPEDCLIDSHCHLDAPELAADVDGVVARARAAGVGQLLVPAVTAGTFADVLAMRERYGCWIAFGLHPIYLDQHLDEHLALLDAALAEHAPVAVGEIGLDFYLPELEPARQEKLLVEQLKLARKHGLPVVLHVRRSVDRVLKHLREQKVECGIAHAFNGSEQQAQAFIRQGFKLGFGGAMTYSGSRRIRALAATLPLSSLALETDAPDIRPEYAQDTPNEPFQLARFVEVLAELRGMAAAPLRRALRENTLAALALR

SEQ ID NO: 5268 - protein, 543 aa, Chromobacterium substugae
MRNLSIAARITLGFGLLLAALILTGCLTQLGLNKISKRVEEVSSHDLLFYTDIVELQRNMGNLRRFEKDYFINIADDAKRAEYLGKWKSAQAGAQKAIQQAGGHPLNDDAAQQLNKLSTLLAGYADGVGKVSGMVEGKQVTATADANKQLDQYKDNIHQMESVSEALGKVAADAVGQLDDQIDATAASVRNQLLVEIAVALAAGALVAWIIIASIRQPLLQMRDSSHELADQRNLRLQLPDFGQNELGNVAGSLTKLVDTVRAVVVESQGHSTSLAQAAGQLSQVSEHVSSASARQSEAAASGAAAIEQMSVSINLVADSTQDVERQARLTMEQASAGNELAQKAAGEIRQIASSITETAAVMEGLNQRSADIGDIVRVIHDIADQTNLLALNAAIEAARAGEMGRGFAVVADEVRKLAERTSQATTEISSHIDGVLADTQRAYQSMQQANSRIETGVVSASSVADALGQIRELAEHSVERITDIASAITEQSHASQEVARNVEQIAQMNGQTNQAAGEASTLASRLQTLSHELDGCLQRFRT

SEQ ID NO: 5269 - protein, 114 aa, Chromobacterium substugae
MSRDFFRRGASAALIALILLTLAWELSLAPLRPGGSFLAFKALLLLLPLRGILAGRLYTYQWSSMFILAFFSEGVMRGWADPGLAGRFALGEVLLSTLFFICVLGFARSFKRRA

SEQ ID NO: 5270 - protein, 247 aa, Chromobacterium substugae
MNEQPLLAHLIELRTRLVRALLGIALVFLGLFHWSSDIYHLLAKPLLDALPQGGSMIATEVTSTFFVPMKVTMLVAFLVSLPNTLYQVWAFVAPGLYSHEKKLVLPLVLASLLLFLLGMSFAYFLVFPVVFHFMSAVTPAGVSMMTDIDKYLSFVLGMFLAFGTTFEVPVIVILLTRMGVVTVAKLREARPYVIVGAFVVAAIVTPPDVLSQTMLAVPLWLLFEVGVLAAALMERKARAREQAESAP

SEQ ID NO: 5271 - protein, 164 aa, Chromobacterium substugae
MLDISFGEFVLIGVVALVVLGPERLPTVARTVGALVARAQRFVATVKADIHQQANLSGLDSLRQDLQDAAHTFRGQLEAEVNEVRQAVDGHAAEARALADEAAGPLFEAERTIHQSLHPEAEAAEAPAAAEAAAPRDENQLDLFDDLPPHHPPASQPSASQARE

SEQ ID NO: 5272 - protein, 68 aa, Chromobacterium substugae
MGSLSIWHWLIVLLIVVLVFGTKKLPNIGKDLGNAVKGFKEGMNEGKGGAQQPPEQTGRIIDGEADKK

SEQ ID NO: 5273 - protein, 107 aa, Chromobacterium substugae
MSDCLFCKIVAGQIPANKVYEDDDVLAFHDIRPIAPVHFMIIPKLHVDSLAHCGPEHEAVLGRILTLAPKLAKEQGLESGFKTGINTGRGGGQEVFHLHVHVFGHKG

SEQ ID NO: 5274 - protein, 108 aa, Chromobacterium substugae
MTPDVLKNIADTLEARREAAPQSSYVASLFHKGEDAILKKVAEEAAETLMASKDKDKLHLVREVADLWFHTMVLLTYHGLRPEDVVMELHRREGISGLDEKASRKPSA

SEQ ID NO: 5275 - protein, 127 aa, Chromobacterium substugae
MSWLDEVKWDDKGLVTAIAQDAASGRVLMVAWMNRESLQLTADTGIAHYFSRSRQKLWKKGEESGHRQTVKELRLDCDGDVIVMQIEQIGGIACHTGRESCFYRRFENGGWTIVDAVLKDPHSIYHG

SEQ ID NO: 5276 - protein, 254 aa, Chromobacterium substugae
MLAKRIIPCLDVTAGRVVKGVNFVGLRDAGDPVEIARRYNEQGADELTFLDITASSDQRDIILHVIEAVADQVFIPLTVGGGVRTLADIRRLLNAGADKVSINTAAVTHPEFVQEAADHFGNQCIVVALDAKAVTPENDRWEVFTHGGRNRTGLDAVEWARKMQELGAGEILLTSMDRDGTKSGFNLPLTRAVSDAVGIPVIASGGVGNLQHLVDGVKEGHADAVLAASIFHFGEYTVAQAKEAMRAAGIEVRL

SEQ ID NO: 5277 - protein, 246 aa, Chromobacterium substugae
MLLIPAIDLKDGQCVRLRQGAMDDATIFSDDPVKVAAHWRDQGARRLHLVDLNGAFAGKPKNLAVIRDILGEVGEDMPVQLGGGIRDLDTIEAYLDMGLSYVIIGTAAVKTPGFLHDACDAFPGQVIVGLDAKDGMVAIDGWAKITNHNVIDLAKRFQDYGVNSVIYTDIGRDGMMNGVNIEATVKLAQALTIPVIASGGLTNLDDIRALCAVEEEGIEGAITGRAIYEGSIDFAAAQTLADELAE

SEQ ID NO: 5278 - protein, 212 aa, Chromobacterium substugae
MKVAVIDYGMGNLHSVLKSLQAVNETGADIFLTRDPEAVVKADKVVFPGQGAMPDCMRELNRHGLADAVRETTQSKPFFGICVGAQLLFDHSEEGDTAGLGLFAGKVVRFADGLVAGGERLKVPHMGWNQVYQRRAHPMFAGIADGERFYFVHSYHFAPGDASLSLAESDYPERFSCIVGRGNIFATQFHTEKSHRAGLQMMKNFLAWDGNV

SEQ ID NO: 5279 - protein, 197 aa, Chromobacterium substugae
MRTATVTRNTLETQITVMLNLDGTGQGRFETGVPFLDHMMDQIARHGLIDLDVKAVGDLHIDAHHTVEDIGITLGQAFARAIGDKKGIRRYGHAYVPLDEALSRVVIDLSGRPGLVYHVDYTRASIGQFDVDLFSEFFHGFVNHSMVTLHIDNLRGHNSHHQAETIFKAFGRALRMACEHDERMAGITPSTKGTLSI

SEQ ID NO: 5280 - protein, 358 aa, Chromobacterium substugae
MTTKLTAKQLVRDEIAAIGAYHVAPAAGLIKLDAMENPWPLPIELQHALAAELAQVALNRYPDANGGGLKDDLRAAFAIPAGADIVLGNGSDELITLVTQALARPGAKLLALEPSFVMYKMNALFSGLQYVGVPLNGDFTLNLPATLAAIEREQPAVVFVSYPNNPTGPRYARDEVLAICRAAPGLVVVDEAYQSFASDSFMDLACELDNLLVMRTLSKLGLAGIRLGYAAASPAWIEQLNKVRPPYNVNVLTLAAAKFALKHLDVFNRQAAELRAERARLSDALSALPQLAVFASEANFLTVRAPDAPALFQHLKASGILIKQLHGSHPLLDHCLRLTVGSPDENAALLSAIQRFFA

SEQ ID NO: 5281 - protein, 430 aa, Chromobacterium substugae
MLKLSSSQPDFAARLQALLAFETAQDPAVDAAVAAICADVHHRGDAALVEYTNRFDRMQAASMADLTLSREQLEAAFARLPADVRDALTAAAERVRRYHEKQLAHSWSYEDEDGTLLGQQVTPLDRVGIYVPGGKAAYPSSVLMNALPAKVAGVGEIIMVVPTPGGERNDLVLAAAYIAGVDKVFTCGGAQAVAALAYGTETIPQVDKITGPGNAYVAAAKRRVFGVVGIDMVAGPSEILVICDGDTDPDWVAMDLFSQAEHDEIAQAILLCPSADYIARVEASIQKLMPAMPRRAIIEASLGNRGALIQVADLAEACEISNYIAPEHLELSVADPDALLPQLRHAGAIFMGRFTSESLGDYCAGPNHVLPTSRTARFASPLGVYDFQKRSSLIRVSQAGAQKLGRIASLLAHGEGLTAHARAAELRLDK

SEQ ID NO: 5282 - protein, 213 aa, Chromobacterium substugae
MKLTIALSKGRIFEETLPLLAAAGIVPAENPESSRKLIIGTNHPDVQLVIVRASDVPTYVQYGAADLGIAGRDVLIEHGGAGLYQPLDLNIAKCKMMVAVQEGFDYDAAVRQGARLKIATKYPQIAREHFAKKGVHVDIIKLYGSMELAPLVGLADAIVDLVSTGGTLRANKLAAVEHIIDISSRLVVNQAALKLKYDAIQPVLDAFAGAVPA

SEQ ID NO: 5283 - protein, 254 aa, Chromobacterium substugae
MSNDTSPGSPTGSHQPLDLAKFTLATPAEIAQHLASIAKHGHMVTVFANKGKSFILTRLLDVDFQTGLFTFDWGAEEDTNAQVLNSERNVFVCSPEGVKTQFVTGQVSKVMLEGRPAFLSKLPEQVIKLQRREFFRIQTPLGTPVFCHIADFGQRAIDLALFDISLGGMSLWLPGVSTTGFEIGQQYRQCTIDLKPFGTLNLGIEVRHRLTARMRNGNEAMRIGCSYLNLTPQMETLIQRYVGFLERERRALVG

SEQ ID NO: 5284 - protein, 192 aa, Chromobacterium substugae
MSKFLQLLLGLLTAFALSACAPAVNFKGTAIDDDSMGGNFTLTDFHGKPLGLEAFHGKVVALFFGYTNCPDVCPTTMLEYASVMKQLGADADKVQVLFVSVDPERDTPKVLAGYVPHFDKRFIGLTGTPEQIEKVKKQYKVVAQKVPTPGGGYSVDHSAGSYLLDQKGKLRVFQAYGTPAANLAYDIQQLLR

SEQ ID NO: 5285 - protein, 299 aa, Chromobacterium substugae
MSELSLPLWRQHAQALWQLSKPRVVALIVFCAVIGMFLASPGLPDPAVLAAATLGIALVAAAAAMINCLVERGVDARMRRTAWRATVTGEIGGLETLLAALALGGMGLLLLFAGCNALTAWLTLATFVGYAIVYTLLLKPNTPQNIVIGGASGAMPPVLGWAAVSGEISAFALVLFLIIYAWTPPHFWALALYRRDDYARANLPMLPVTHGQRYTTLSIVLYTLLLSAITLLPVALGESGRIYMAAVLLLDARLLFLAVSLHRQYADALARRTFRWSIWYLTWLFAALLIDHYCLIPLT

SEQ ID NO: 5286 - protein, 341 aa, Chromobacterium substugae
MRKLVWLALLLAAVVVPFGAYVRLSHAGLGCPDWPGCYGQLSPSHAALAIQQAQALAPDGPVSLDKAWKEMLHRYLAGSLGALIVLIAWQAWRTGRQRLPAALLLGVVLTQGLLGMLTVTLLLKPAIVTSHLLGGMGVLQILAWMAASPRLAAVTAPPLLGRLSGLLASALALQLALGGWVSSNYAALACQGFPGCNGDAWPALRFDHAFHLLRELGEAPDGSLLDFASLVTIHWLHRLGALLVSLLLLSVLALGWRLPPLRRHLAWLAAAWLLQVGLGIANVLLQLPLPLAVAHNAGAALLLMAALLLLSRLRPRAAELRPAARVTPAVMTGVTRPGEGR

SEQ ID NO: 5287 - protein, 170 aa, Chromobacterium substugae
MKSIKRGQRALIAMALLCLAPVVAAWLAYALLPPGGGRSYGQLLPTHPFAASGQPEWPRGKWVLASVLGADCHNRCRQRWYAMRQIERAQGEAASRLTRVALLVSPRAAAMDDVPHRLPHISAQALPAGNQGFYLVDPLGNQVMFYQDGADPRRIIDEVAKVLKVNNGLG

SEQ ID NO: 5288 - protein, 240 aa, Chromobacterium substugae
MTVSSTHSDSEKKQRRPGWQRTLWLLLLLITLLPYALAVWQWQRGQDKEVLMRSLTSAMSTAPVGLVYREAEPPPAFTRVRLAQGEPAGPVIELRNSYLGGQSGRRILQPWRQGPDRSLVLLDLGWLVDGAKMPDFPPEQIQPQGYRMPTPHHFVLSGAAKGTAGPVDEVDEAALRRRYPGHWFQGVVVLENSPDPLLHWPVVPEFMPDRHYAYAIQWLLLGFCLTGLSWLMWRRRHEVH

SEQ ID NO: 5289 - protein, 65 aa, Chromobacterium substugae
MKLVILFLLVCIVLALFWGLTGLLKAEHGSQRLVRSLTLRVGLSIGLFLLLLLGALFGWWRPHQV

SEQ ID NO: 5290 - protein, 290 aa, Chromobacterium substugae
MSTEQMASVAEQDRYFVPPPSRWPMVGAVALFFIGLGAAFAVNGLLLGKLSLGLGFLILVFMLVGWFGDVIRESRHGVYLGREDMSFRWGMGWFIFSEVMFFGAFFGALFWVRTVSVPLLGSLDYKMLYPDFQASWPLATGPGITEAYQAMEAWGLPAFNTLILLSSGATVTWAHWGLLQGKREQFKLGLLLTVLLGFSFLTLQLHEYGHAFSTLHLTLASGAYGMTFFMLTGFHGLHVLLGSIILLVVWLRALNGHFDASQHFAFEAASWYWHFVDVVWLLLFIFVYWL

SEQ ID NO: 5291 - protein, 58 aa, Chromobacterium substugae
MSWVQGVRAVLGAFIGVRKGSAARVDQILKPWQLIATALLLMAGLIALLLLVVSWVTS

SEQ ID NO: 5292 - protein, 182 aa, Chromobacterium substugae
MDTAARTQRRNFRLMGRLMVIAALMFGFAWGMIPLYRIVCEQTGLNDVVKADELSSGDLAAGGAEVDMTFDATVQAGLPWQVRPLTRHLKVKPGTFVQVQYQITNASPHEVVGQALPRYLPGEAAQYVKKLECFCFTQQRFLPGQTRTFPVVFVIDRKLPASIASITLAYTVFDVPGQGGKS

SEQ ID NO: 5293 - protein, 544 aa, Chromobacterium substugae
MAIAETTHAGGAHHGKPHGIARWLMATNHKDIGTMYLWFSFTMFLSGGVLALCIRAELFSPGLRFFQPELFNQLTTLHGLIMVFGAIMPAFTGMANWMLPLMIGAPDMAFARMNNWSFWLLPPAALLLLLSFAVPGGAAAAGWTLYAPLSTQMGVGMDMTIFAIHILGISSIMGSINIIVTILNLRAPGMTMMKMPMFAWASLITAYLIIAVMPVLAGVVTMVLADRHFGSHFFNAAGGGDPILYQHVFWFFGHPEVYIMALPAFGIVSQVIPTFARKPLFGYTSMVYATSSIGVLSFMVWAHHMFATGMPATAQLFFMYATMLIAVPTGVKVFNWIATMWEGSMTFETPMLFSIGFILLFTIGGLSGITLSVAAVDIQLHASYYVVAHFHYVLVAGALFSLFSAIYYWFPKMSGRMYSERLGKLHFWWSMIWFNVTFFPMHFLGLAGMPRRIPDYALQFTEFNQIASVGAFMFGLGQLIFLYNILHSLRHGAVAPQRPWEGANTLEWELPTPAPYHSFEQAPKLEVGENGVILSHLPGEPRAH

SEQ ID NO: 5294 - protein, 368 aa, Chromobacterium substugae
MRILCCLLLAAQSAAAAEFNLQAPVTPLARTEYHLHTLLLIITGVIFAVVFLVMLYSIIRHRKSAGHQAKQFHENTTVEIIWTVVPLLILVLIALPATRAVLAQKGTRNEDMTIKVTGYQWKWRYDYLDDNFGFVSHLSTPREAIEGKIPRPANYLLEVDEPLVVPTNRKIRLLLTANDVIHSWWVPQLGVKQDAVPGFLRDSWMLIEQPGTYRGQCSELCGKDHGFMPIVVVAKSPDDYAKWREAKIKQMAASADDPNKVWKLEDLKARGEKIYTQNCIPCHQANGKGIPGTFPALDGSPIATGDKAAHIEIVLFGGKKNPAMAAWGKQLSDTDIAAVITYERNSWGNHTGQAVQPKEVKAARGKAA

SEQ ID NO: 5295 - protein, 275 aa, Chromobacterium substugae
MKHPIALAAGWLAAVCALAPAQAKTICTAVADGHSGAILLQQGDCRDRVSPASTFKIPLAVMGYDAGFLKSEHAPALPYRQGYVDWGGEAWRQDTDPTRWLKYSVVWYSQQITHRLGAEALGRYVRAFGYGNADFSGDPGKNNGLERAWIGSSLKVSPLEQVAFLDNLLHDRLPASPEAQRLARSIVEQTALPGGWNVRGKTGMAYPWLRNGKQDLAHPYGWFVGWAEQGERRLIFARLIQDDGKLPGTPGVRSREAFLKELPALADGLADGKRR

SEQ ID NO: 5296 - protein, 208 aa, Chromobacterium substugae
MSQGYFITGTDTEIGKTHSAVELIRHYRGQGRSVLAMKPVASGCEILPDGRWHNDDVARLTAATGQTDLELMNPYRFLPPVSPHIAARQAGVEIDLARIRQHYEQLAAQADIVLVEGAGGWLAPLTDALFMEDLARDLALPVILVVGMRLGCINHALLTARAIQGSGLALAGWVANCPQPRQAAYDENLETLKRHIPAPMLLEIPYQP

SEQ ID NO: 5297 - protein, 332 aa, Chromobacterium substugae
MRHLQPGDMLACFSPSFPITARQPARYRRAVEFVGRQGLRFLPGALTGADDGYRSGSARERAAEFNALLRNPEVRCIMSTIGGSNSNAMLPYLDYDAFRRDPKIVVGYSDATAILLALYAKTGVPTFYGPALVASLGEFPPLVEETWRAFAALAMGEPSYPYALRMPAHWSDERLPWESQDRPKTLQANQWRCIQPGRAEGRLIGGNLNTLYGFLASEYFPPIRQGDILLLEDGLKDAATVEKNLAMLKLAGIFDKAGAVLLGKHEGFDDCGTGRRPSYILLEVLDGLPLPILADFDCCHTHPMLTLPLGVNVRVDAGESMVEILEDWRALV

SEQ ID NO: 5298 - protein, 147 aa, Chromobacterium substugae
MNENEAFATLAGMGIMMLVVAGALALAVSIFYYLTLHQTMNAISEVNRPLAGGLVWLALIPFVGVIWYMVYIILLSNALKREAAQRGLPGDGAAGVSLALAILLALCFVPYANLIAVIPAIALWVIHWARMAGYRKLLQAAQPALAT

SEQ ID NO: 5299 - protein, 595 aa, Chromobacterium substugae
MQVDIERLVADFGGPGRLADELNRLFPDEQVSRAAIYKWRERGSLPLAQLSRLAQLAAGQGRRFDFNDYLVGEPAQGAGRAINMGDRLYIFDTTLRDGEQSPGASMTKEEKIRIARQLERLGVDIIEAGFAAASPGDFDAIHAIAEVIKESTVCSLARANERDVRAAGEAIKPAARGRIHTFIATSPIHMEKKLRMSPDEVVDAAVKAVKIAREYTDDVEFSAEDALRSDIDFLARIFGEVIKAGATTLNVPDTVGYAVPRLTEAFFRELIARTPGGDRVVWSAHCHNDLGMAVANSLAAVLGGARQVECTINGLGERAGNASLEEIVMAVKTRRDVFGVDSAVDATQIVPASKLVSTVTGYPVQPNKAIVGANAFAHESGIHQDGVLKHRETYEIMSAESVGWSANRLTLGKLSGRNAFKTKLAELGIVLDSEEALNAAFARFKELADKKREIFDEDLHALVSDEMVAIEQEHYKFVSLRIATETGEAPQASIVFAESGQERHAESSGSGPVDAAFKAIESIAHSGAELQLYSVNAITKGTESQGEVTVRLQQDGRIVNGQGADTDIIVASAKAYLSALNKLSSEVKVHAQAIV

SEQ ID NO: 5300 - protein, 321 aa, Chromobacterium substugae
MPLMACAEGNDGQTGGGFSGSLGLGVGYYRVETNFFKTPSDDQRSISSLNSSPATQHYVTGVPSANLRYALPGSGTQLFLSVEPLATLGEGGGLQAGVRQTLPGAGTLSAALKYDQASVWRDPYALNTERSDDKLKTYGFAFGWHGIMETPFSASFSYGKVKMNQEQSGQNLGLSAANQALLDRNGKQYGAQLAYTLKLDPAGQQSLSPALIYVRNDLDGKAMSTTRSGLQLAYAYKGDLNELSAALAIARTGYQAGNPIFAGRKADSDDYLLTATYTRKQLFGAKAWSAFVSGVYGQSNSDISFFDAQARALNVGIGYRF

SEQ ID NO: 5301 - protein, 299 aa, Chromobacterium substugae
MRNAMRYNPPFTLNILRTPVSERLFVLSQHVMPKLALTRFAGCVAGWKGGSLTTALIRRFIARYNVDMSEAQNSDPASYASFNDFFTRALKPGVRPLADARQVCPVDGAVSQLGAIDNGRIFQAKGRDYSATALLAGDAELAARFADGHFATIYLSPRDYHRIHMPCAGRLLEMTYVPGELYSVNPATARGVDRLFARNERVVCLFEDEQGQPFVMVLVGATIVGSMATVWHGVVNPPRRPALEKWDYRSQDIRLAKGEEMGRFLLGSTVVLLYPAGPLRFNPQWQPASPVRLGEKMAD

SEQ ID NO: 5302 - protein, 353 aa, Chromobacterium substugae
MHITDVLRKTIHNPATWSQQELYDNLQAAVDVELWTIPLYLTTLYSMQGLNADDQQAYPGVAKLIESVVIQEMLHLELISNLCNALGYAPRYPFPSNEETEGIPFLKPDVPPQYAGYQVKLGPLDINQLKLFCVIELPEPPGKPDWNKQTRYNSIGELYQALEIAVKVQWKDLYVGAAANTKQQANFTDYAQKNQHGAGFSQTINSLEQALAAMQAIVKQGEGNRATAEIPLRDQPPAENPANYDPSDFDPAQSHFLKFNEILDILRLGLTPWIPAVYPLIPRPDKQQLAEQEMAQRQLQAGFRAFMAQLQTGFNTAQPNQQMPGSFYNSMFNLQNLITAVWQTGAVPAFPSE

SEQ ID NO: 5303 - protein, 338 aa, Chromobacterium substugae
MKVYYDKDADLSIIKGKKVAIIGYGSQGHAHAQNLKESGVDVIVGLRKDGASWKKAEAAGHKVKEVAEAVKKADVVMILLPDESQPDVYHKDIAPNLKKGAALAFAHGFNIHYNQIVPPADVDVIMVAPKGPGHTVRSEYLKGGGVPTLIAVYQDKSGKARDVALSYAAANGGTKGGVIETNFREETETDLFGEQAVLCGGAVELVKAGFETLVEAGYAPEMAYFECLHELKLIVDLMYEGGIANMNYSISNNAEYGEYVTGPEVVTSATKEAMKKALYRIQSGEYAKMFILEGKTNYPSMTARRRLTAAHPIEKVGAELRAMMPWIANNKLVDQSKN

SEQ ID NO: 5304 - protein, 163 aa, Chromobacterium substugae
MRHILSILLENEAGALSRVVGLFSARAYNIDSLTVSTTEDPTLSRMTIVTHGSDEVIEQITKQLNKLIEVVKVIDLNESEHIEREMMLIKVRAVGKDREEMKRMADIFRGRIIDVTEKTYTIELTGTSDKLGAFIEAVDRTVILETVRTGASGIGRGERVLKI

SEQ ID NO: 5305 - protein, 460 aa, Chromobacterium substugae
MSTTSSRTTRSPPPSRRRSTSPRAAGLARWWWTSRRTSPSSARNSITSVHIRSYVPATRGHSGQIKKAVNLLLEAKRPFIYVGGGAVQGRAEAEVTELVRSLNLPCTNTLMGLGAYPGSDRQFLGMLGMHGTYEANMAMQHCDVLVAIGARFDDRVISVPSHFLGRPKKIIHIDVDPSSISKRVRADIPIVGDVKLVLKEMLEQLKQSGQKPDGSALNQWWKQIEEWRGHDCLLYTPSSELIKPQMVVQQLYEITGGQAIITSDVGQHQMWAAQYYKFDRPKQWLNSGGLGTMGFGLPAAIGAQLANPNAQVACITGEGSIQMNIQELSTAKQYHTPVKVVALNNRYLGMVRQWQEFFYGTRYSESYMDALPDFVKIAEAYGHVGFKVENPADVEPVLREAFSDKLKERLVFLDFRTDQSENVFPMIQNGKGLDEMDLPPHMRDIQQVPFENNRDYGNMC

SEQ ID NO: 5306 - protein, 188 aa, Chromobacterium substugae
MASRKEMADFLQSVEKRAFKQALYAVRQEDNALDIVQDSMMKLADRYAHAPADELPLIFQRILQNTIRDHYRRSKVRSFVSTLLSSLIPTHAEDDSPDPLETLDVAADEAHTNPEQWYQRKEVAQMIDASLQLLPARQREAFLLRYWEGLDVAETAQVMGCSEGSVKTHCSRANHTLAAILAQKGVLL

SEQ ID NO: 5307 - protein, 126 aa, Chromobacterium substugae
MNHANDSQGDHLPSHITRILDTPTAEPTHAQMERLKVARARALQRFDQRAAEHISLQERLAIWAQRHTLLLKRGGAALGFAVVTGAGLMLLDGLLVESEAVDAAVLSQDLPLNSLLEPNFSRGLHE

SEQ ID NO: 5308 - protein, 130 aa, Chromobacterium substugae
MSKTRRLACSLGLASLFAAALAQASPLADPRWDQLNSEQQQVLSPLAAEWNRYAPNKKQNLLAIVPRFIDLPPKQQQRVRQRLKAWSELSQPQRDEIRANWKKLQQLPPEQRERVMRRLREGGAKPETPQ

SEQ ID NO: 5309 - protein, 171 aa, Chromobacterium substugae
MNDFPVPSLLRCLASLCYETLVLVAIMLLVGAALTPLQLVLGQDSALLHALIQLGVAAALFAYFGYCWTRSGQTVAMKTWHIRLVAADGRLLGWQQALMRFAIAAMLFVGLPVVSYLGWQRSYGDHPAVKWLALIWWLLPFLARYYDKDKRHLHDRLAGTRLLVLPKPPRR

SEQ ID NO: 5310 - protein, 315 aa, Chromobacterium substugae
MDYENRIKKSISNSVFAIMLDDLELFVAIVDAGSLNAAAKRLGMPAPTLTRRLQALEAGLDCKLLNRSARRLAPTNEGWQYYERCKPLLAALRRETAALDGMLNRVEGVVRLLAPLSMANDMLLPVWTRLLREHPRLKLELKLNNSLDDLYSGMADLALRVGEQSDAALRQRKVGMVRTMLVAAPDYQAAHGKLERPADLAAHRLLLAEPFERWRLRHAETGEEAAWPAEPDLQANDMLLTRRLAEAGAGIAVSPLSICHRQLAEGRLVRVLEQWEIAARPVYAVWPQRRALPARVRAVLDALLDFAADAPQLRG

SEQ ID NO: 5311 - protein, 142 aa, Chromobacterium substugae
MRVDYTQLSPKAYQGLLACKNALAESPLGLPLIELAYLRIAQLNGCVFCLKLHSHALRRRGESQEKLDALAGWDVAEEKLFTPRERAAITWTEAVTRIGESRAPDSVYLPLREHFSDAEISDLTLAIALMNAFTRVAVAVRQ

SEQ ID NO: 5312 - protein, 96 aa, Chromobacterium substugae
MPFPWFWIFAPQINLPFSGNVLQDIDPATYWLNLFAPWQGGRWQWHDLGDCRKALDLLALSPAAAEDAARQQALLTLRAWLPAANRVLVWHPAHSG

SEQ ID NO: 5313 - protein, 435 aa, Chromobacterium substugae
MKTAVRGDVLTFRGNPFREAEQDSLAFQRDALVVMENGRIAACGPAAKLLPTLTPDVRLTHYPEHLILPGFIDCHVHYPQTEMMAAFGEQLLDWLHHYTFVTEQGFADEVHAREVAQVFLSEQLRNGVTTGCVFGTVHSASVEILLQEAARIDLRILAGKVCMDRHAPDALLDTPLTAYEDSRALIQRWHGRGRAEYVITPRFAPTSSHGQLEMLGALAAEFPDVPIQSHISENLDEIAWVKALFPGCRDYASVYQRYGLLRPRAVYGHGIHLSDAELEMFHASGASLAHCPTSNFFLGSGSLDLRRCVLGDRPVAVGLGTDLGAGTSFSMLQTMNAAYMAAQSHGKPLSAAQAFYLATRGGAEALGIADKVGSVAVGMEADLAVLNLRSTPLLDFRMRYARDLSEALFVQMMLGDDRAVAATYVAGREVYRRAA

SEQ ID NO: 5314 - protein, 165 aa, Chromobacterium substugae
MQQVPDQIDRIVALWNEVRPDLDTSSTQVIGRIVRMEYFITRRVLQDLSRHNLNVGEFDVLAALRRGGEPYQLSPNQLQGMVLISSGALTNRINRLEEAALVSRSPDPDDRRGVIVTLTAKGLQVIEDAAGHHLAAEAELMEMLDADERDTLARLLKKMLQAQED

SEQ ID NO: 5315 - protein, 434 aa, Chromobacterium substugae
MFSLPTTATAPFCPAEVNGSIRIDARASFSQRLRRFAGPGLLVAVGYMDPGNWATDIEAGSRFGYQLLWVVMLSGIAAMLLQMLAAGLGLVTGMDLAQASAARYGRAGRLLHWLSAEVSIVACDVAEVLGCALAFKLLFGVPLLWGVALTAFDTLIVLGLKGRGFRQLEAIVLGLIATITLCFLAQLALLDTHWPAVAAGLAPSLPAHDMDKAVVLALGIVGATIMPHNLYLHSSVVQTRRVEGGDGALRQTLLLCRIDTIASLLLAMLVNGAILVLAGSAFHAAGHTAVADIADAHELIRPLAGSLAALLFGVALLAAGQSATLTGTVAGQVIMDGFLKIRIPCYQRRLITRALALLPAAGGIGWWGESAVGPLLVWSQVVLSLQLPLAMWPLLRMTGDRALMGAHAALRWVVVCGWGLFWLILAANCALLLG

SEQ ID NO: 5316 - protein, 213 aa, Chromobacterium substugae
MKTSLLLPLFCCLALLHAPARAGAQKEEALSANVASAMSRSISDVNAPRLVFDDPRVGQAWLAEMSARLQKRIPDAWMRERLLTAVQYEATRAGLDPQMVLGLIQVESGFNKYALSSPGARGLMQVMPFWVRHIGDPRHNLFDLTTNLRYGCTILRHYLDIEHGNLYRALGRYNGSLGKPEYPGQVMGAWKRQWSWSAPPALQAVGDNLPRAR

SEQ ID NO: 5317 - protein, 568 aa, Chromobacterium substugae
MRASQFFISTLKEAPADADITSQKLMMRAGFIRKQAAGIYSWMPMGLRVVRKVEAIIREEMNRAGGIEVSLPVVQPAELWQETGRWDAMGAELLRFQDRHERDFALQPTAEEVITDIARRELRSYRALPKNFYQIQTKFRDERRPRFGVMRGREFTMKDAYSFDRSAEDAGKSYDNMYAAYRRIFDRFGLTYRAVAADTGAIGGDRSHEFQVIADTGEDAIVYCPASEYAANIELAEAVAPAGERAAAAAALAKVHTPKVKTIAELVDFLKIDIEQTVKAVVVEGEEDEAVLMLVRGDHELNEVKAQKIAGIKNPLAFASPAAIRDAFGANPGSLGPVGFKGRVIADRTVAKMADFVIGANEDDQHYTGANFGRDCAEPEVFDIRNVVEGDPSPDGQGVLAIQRGIEVGHVFYLGTKYSVAMNATFLDEDGKPKPFEMGCYGIGVTRILGAAIEQNYDDKGMIWPDAIAPFAVVICPVGYDRSEAVKEAADKLLADLLARGVDAILDDRGERPGAMFADWELIGAPHRVTIGDRGLSAGKVEYQHRRDSEATAVAADAILEHVLSKLA

SEQ ID NO: 5318 - protein, 621 aa, Chromobacterium substugae
MQDHNKQAMAGLTLAALGVVYGDIGTSPLYTLRECFVSQSIPTTPDNIFGILSLIFWSLIFVVSIKYVAFVLRADNRGEGGIMALMALARHYTTHAARWKIVMLGLFGAALFYGDAIITPAVSVLSAAEGMEVISSGMEAYVLPVAVGVLVGLFLLQKHGTASVGLLFGPVMMVWFAILGILGLNQILQQPAVLQALNPWHAFAFLHQHGFHAFLTLGSVVLALTGAEALYADMGHFGKTPIRRAWFALVLPGLALNYFGQGALLMRDPAAIKNPFFLLAPDWALLPMIVLATLATVIASQAVISGAYSLTRQAILLGYCPRLEVNHTSEKEIGQIYMPFINWALLIAVLVVVLTFKSSSSLAAAYGIAVTGTMLITTMLFFVVARVNWRWPLPLALGITLLFGVIDTAFFAANIHKVADGGWLPLVMGMAIFTLMSTWKLGRELLFKRLREQALPLDGFIQNLEAYPPARVEGTAVFLTSTLHGVPHALLHNLKHNKVLHERVVLMTVRTEDVPYVAEDERLEVVQMSASFWRVVARYGFKEDPNVLQVMEMCAKEGFELELMDTSFFLSRETIVPTERPGMARWREKLFVWMSKNAMRATDFFQVPTNRVVELGAQVEL

SEQ ID NO: 5319 - protein, 188 aa, Chromobacterium substugae
MRNAFIQTVSGRYLNVLDPRPDDIDIADIAHHLAHLCRFGGACRQFYSEAEHAIRMAEILPPRLQLAGLLYGAAKAYAGEVVRADTYERSPLQGRVGAAVEARFGLSLSGEDRAMLAMADARLLATERRDLMPPDNVEWPILMGVQPLPERIWPMTIAQVLAAFCTAYEQYLCWGARRESPLRRVARR

SEQ ID NO: 5320 - protein, 60 aa, Chromobacterium substugae
MTRPAGRQACFTPIPAPGRAADARMSAIPPRPATRRGDEIYFDLIIEIINSNRIESVRPK

SEQ ID NO: 5321 - protein, 177 aa, Chromobacterium substugae
MHAKDLPKNNTSLNEFKLKAIKKIHDQKLTISALARMTGIKQSTLHKGLFEERELSFSNAHAIGNALDISLSGHGAAPGRMAPVLTHLSQLPSLRGPGLPIWDEYVLLQHAPGEAVLAIDRSLFRPALFPARAVVLVQTGERDGANLVYPHHDALCLGDNGKPPLGRIIGITFRKNQ

SEQ ID NO: 5322 - protein, 247 aa, Chromobacterium substugae
MRTIRELAGKSLAAVDPIVILSFLILISAIVSNLTSYKVIQIFGTEASLGTFTMPIILMLLNPIAEVYGKNRSNQILFATCLAEIVFAVSFTALSQSQRDCGLLPLAERDHCAALNQSYVLISEHIVRGSISFALGCLIGSQFNTRFLLYLKRLWSSRFYFVRDVFSSVIGEVVYTAICFMIAFYGVFPFATIVKIFAFSLMFKFSSTVLLSWISQYIVQLLYRYQAWLEPAPSSKKIKFSSRYLQV

SEQ ID NO: 5323 - protein, 442 aa, Chromobacterium substugae
MKPIVLHHRPRAGQTAAAPLFALESNYDYTRKYRRQSRRVERASLTLLFFADRVMLLPRSANGLAMLRALAERLPLRRDGDGDAFSLALDASAPLRRRLAQLLGLLQPFQADACFGLYGFFTYELLHAELGLPCDLLGLFHLPEQLSVDGQPHGYFVDPEADDGPAPPPDLARFIDLDRFAAGRNAEHGPMYRAASQQIADGQVRSVNPSFAIRRPTARNAYQIYQALQAKNLAPYNLFFDAGPFQLAGASPAMFLRIRGGRVETSPICGTVARGRDETEDRAQIAKLLASEKDDFELAECVRADLAAKQASCRDATLLAAKEIEKFANVFHTSAHVAATLREGCTAADAIADHLWPATILGTPTAAAARLLAEHESRHWYGGAFGYLTAAGEVDLGTIIRSALLRDGVATTRVGSTLTRHSSAPAEQRELEAKAALILGVL

SEQ ID NO: 5324 - protein, 151 aa, Chromobacterium substugae
MKALTIEDISGEAITIRLVNTAKTYRVGLDRPVRLQDIRGLAKDEILLAGVVAGKVARGNAALLAQYDFSQVAIAGDFRLQSVIFDQNVAFVADENARIAIPYRDLPSNLDVIGKLSDELAFYIGFLYAAFTLPDEELTFQDHPRPYLTLK

SEQ ID NO: 5325 - protein, 339 aa, Chromobacterium substugae
MDLPFEVKELDRGDAELAQRALRLQLAAHRVEVEWLDYPALPLLWPDLAALLSCRDRILAAFEGGELRGLVVASRRLDGGLHIERTVVDPAHFGCGWGYRLLNRALHGETRASVDTAEVNQAAIALYHKAGFVLERRWSVPDGLALWRMDYRPAAPPVLSLAPDGWMRGALQQASPNCDERSPGCAPELLVIHNISLPPYRYGGPGVQQLFGNSLDPDEDPYYRGIHQLRVSSHFFIRRDGQLLQFVPVGQRAWHAGVSCWRGREKCNDFSIGVELEGCDFEPFSEAQYRTLAALGAELRRHLPLSALAGHEHIAPGRKTDPGPWFDWARAQADCGLAL

SEQ ID NO: 5326 - protein, 176 aa, Chromobacterium substugae
MLTLDTLGGAAAPSFEQPLEMLQACHDKIRRFCDTLDKLPPYIEEHGVDEAARNAINDVVRYFDVAGPAHHTDEEEELFPLIEARVPAAASRLEQLAAEHGYLHSCWNAIRDDLLSLRDGRIRQISKNELQEFARQYREHAAAEEAWLFPAAASALSAEELRAAGARMAQRRQTGG

SEQ ID NO: 5327 - protein, 353 aa, Chromobacterium substugae
MNRLQAIRPFGQRIWLDNLSRELIASGELARLLADDGIAGVTSNPAIFYKAISSDASYQGELAVLKQDAALSAEARYETLVVADIQAACDLLLAQYEASQGNDGYVSLEVSPELSRDEAGTLAAARRLWAEIGRANAMIKIPATAEGIRAFQTLTREGVNVNITLLFSLPQVEAVWDAYIAGLSARLADGQPVAGVKAVASFFLSRVDSLLDPQVAEQHKGKVAIALSKAAYARYQQRFHGEEFAKLRAAGARPQFLLWASTGTKNPAYRDVLYVESLIGDETVNTVPDATMAAFRDHGDAALTLPQGMDAAQALLAEVEAAGVDLAAVGEKLQQDGLKLFEDAFAQLLKLTA

SEQ ID NO: 5328 - protein, 435 aa, Chromobacterium substugae
MREFLQRTLLWLTGIVVVSGGFWALSSATDALLALAITLGAWLAFNLYHIALLLRWLRHPVPERVPDGFGVWHSVFMTLYRTMRNQSQSKKKLTHVLERFINAGEAMPDGVVVLDEHDRIEWVNPMAVEHLGLDRKRDVGNQILNLIRQPSFHSYMKNASFSQPLVLNFVQPRELVISLQLVPFDSTRKLLLTRDITQLERVQTVHRDFVANVSHELRTPLTVVGGFLETLGDMPEVDDRTFRQFLPMMLEQSRRMQSLVEDLLALSRLENSPKAASSEKVDMRDMLDTLMVEAEGLSQGRHQVKLSGCCDAGLWGSGQELHSAFGNLVSNAVRYTPEGGSITLAWQEEGEQLRFSVSDTGIGIPREHIPRLTERFYRVDRGRSRGSGGTGLGLAIVKHVLARHHARLEIKSEPDKGSTFSVVFPRERRNDSQAA

SEQ ID NO: 5329 - protein, 229 aa, Chromobacterium substugae
MAANILLVEDEPAIQELIAFNLAQAGHHVLRAGTAEAALTLVRNALPDLVLLDWMLPGASGVDVAKRLRADERTRHIPIIMLTARSDEQDKIVGLETGADDYITKPFSPRELLARIKAVLRRRAPQMTDDAVDVQGLRLDPVTHRVTGNGSVIDLGPTEFRLLHFFMTHPERVHSRAQLLDQVWGDHVFVEERTVDVHIRRLRSALEGTQHDGLIQTVRGTGYRFSVQQ

SEQ ID NO: 5330 - protein, 147 aa, Chromobacterium substugae
MDRFDRKILAALHENARISFAELARRVNLSAPAVADRVAKLEQAGVITGYRAQIDPGRVGLPISCLIELTVKHLEYYLVIEQIRNTPEVIECASITGTSGLMIKVAVDTMASLQALIARLMQFGDTKTSIIIDMPVAPRMPALQQDD

SEQ ID NO: 5331 - protein, 332 aa, Chromobacterium substugae
MTIKVGINGFGRIGRMAFRAIAKDFPEIEVVGINDLLDPEYLAYMLKYDSVHGRFNGEVKVEGNSLIVNGKTIRLTAEKDPANLKWNEIGADIVIECTGFFLTQESCQKHIEAGARKVVQSAPSKDDTPMFVYGVNHEKYAGEAIVSAASCTTNCLAPVAKVLHDNWGIKRGLMSTVHAATATQKTVDGPSSKDWRGGRGILENIIPSSTGAAKAVGKVIPELNKKLTGMAFRVPTSDVSVVDLTVELEKEADYADICKAMKEASQGALKGVLGYTDEKVVSTDFVGNTAPSTFDADAGIALDKTFIKVVAWYDNEYGYTCNMLRFVRHVAG

SEQ ID NO: 5332 - protein, 558 aa, Chromobacterium substugae
MSTLNKFAGIQQLGRALMLPIAVLPVAGLLLRLGQPDLLDIKMMAQAGDAIFGNLALIFAIGVAVGFAKDNNGTSGLAGAIGYLVITAVLKTIDAKINMGVLSGILSGLVAGALYNRYKDIALPSYLAFFGGKRFVPIATGFAALILGAALGYIWMPVQNAIDNTGHWMIGLGEVGAFVFGVLNRLLIVTGLHHILNNIFWFQLGDFTDATGKVVHGDLTRFFAGDKTAGMFMAGFFPVMMFGLPAACLAMYRTAKPENKAAVGGLLFSLALTAMLTGVTEPVEFAFMFLAPALYAIHALLTGLSMAIMHALDVKLGFGFSAGLFDYVLGFGISTHPWYLLPVGAVYFVVYYGLFVFFIKKFDLKTPGREDGAVAVAAGVKGTERARGFITALGGAANLKNVDACTTRLRLLVVSNDKVDEAALKALGSRGLIRPAAGSVQVVLGPEADLIADEIRNALGAAAAAPQAAAETLVSTAAANGASIDKVRWLAALGGADNVRKVEAVAGSRLRVEVADSGRVDQDALRQLGASGVTAVSATLLHIILQGDASPYAAVLQG

SEQ ID NO: 5333 - protein, 836 aa, Chromobacterium substugae
MEQGIAMTTTLDLLAPFTGPAVPLSQVPDPVFAGLMAGDGLALEPLSSTLLAPCSGTVSQLARTGHALTLTADNGAEVLIHIGIDTVKLEGQGFQPLVRAGERVVQGQPLIEVDLDAVARRAPSLQTMVVIANSEQFDFPLRAEGLVEAGRTRFLTLAARGDVSPRGAAGGPERRGEAVVRHEGGLHARPSARVQQAAKAFAADIVIEFNGKQANARSVVALMSLGVAENDVVAVAASGADADAALAAVVGVLQTHSGAGHAPAASAAVVQVAGRIAGVAAAPGLAIGQAVRLDAFDMPLPERGAGAQAERAALLDAQAAVRADIQRGIDEALRRGATAESDIFAAHLALLDDPELLAAAGRGIDAGLSAGLAARQSIRAQCEVLAGLGNQLLAERVADLKDIERQLLRALYGDAGSAPELFDASILVADDLAPSELTRLPRGKVAGIVTAAGGASGHVAILARAMGIPALVACGPAALTLRHGQQLILDARAGLANPQPDAAELAAARAQIEQLAARLRSMQASASAPAITQDGVAIEVAVNIANADDAREGVAHGADAVGLLRTEFLFIDRRDAPTEAEQTAAYQAVLDALDGRNAIIRTLDVGGDKDVPYLQLPPEPNPALGLRGIRAGFAYPEMLDTQLRALLAVKPLARLRILVPMIADVGELIRLRERIEQLAVEMQLAERPQLGVMVEVPSAALLADQLAKHADFLSIGSNDLTQYTLAMDRCNATLAARIDSLHPGLLRLIAIAVEGAKRHGKWVGVCGAMASDPQAVPVLLGLGVAELSVSPRLVPEVKSLVRGLSQRQCQSEAERLLGLSSAQEVRGRIVELWPAA

SEQ ID NO: 5334 - protein, 340 aa, Chromobacterium substugae
MASLMLEEALYAAEAVSAQHMYADEGLAALGRELARIAPKLALTVARGSSDHAANYFAYLVMQRLGIPVVSLPMSLVTLHRAPLAVEGQLAVAVSQSGQSPDLVDTVKALSAAGAHTVALVNKQQSPLAEASDWAVPLCAGEEKSVAATKSYITALSAVARLVAHWHADEALLAALENLPQRLTEAAVQDWSAAIEVLQPAERIMVVGRGLGFAVALEAALKFKETCAIQAEAFSGAEIKHGPMALIDDGYPLLIFAPRGPEQQGLIDLAAEMRGRGAKVLLAAPAEVASRDLTLALADDEALDPLLAIQSFYLMAARLSEARGLNPDLPRHLSKVTCTR

SEQ ID NO: 5335 - protein, 373 aa, Chromobacterium substugae
MTQNLTLQGRILTASGWMDGVVRLAADGRIAEIDAKLASGRQPERYILPGFIDLHVHGGGGVDIMEGGNAISHVARLHARFGTTSLLATTMTAPPEEISRVLADLGRNCKERAPAGSRVLGVHLEGPYINPGKLGAQPDDACQAAMAQIDAYRALAPISLITLAPEIPGHLDIIRTLSAQGVRVQMGHTLGSYEQAVEALEQGASGFTHLFNAMTGLHHREPGVVGAALAHAEYAELIPDLLHVHPGAIRTALRAIPRLYCVTDSTAAAGMPDGEYKLGSHSVTKCMGGVRLADGTLAGSTLTMDQALRNLVKIGLPLADASHRLSLYPADYLGLSERGRLAPGAWADIVALDADLNLQQVYVEGEEIGLVDA

SEQ ID NO: 5336 - protein, 244 aa, Chromobacterium substugae
MENRWLALKPDENLSTPLYLQLSRKLADAINAGWWQADEALPSERTFSEELGISRVTARKAMDVLLEQGMIRRRQGSGTFITPRLEQPLSRLTGFTEQLRLRGFVPSSVWLERGVFPPSNEEVIRLGLSPTSMVARLKRQRLADGVVMAIEMSTMPVAYLPDPQAVGTSLYAHLDAAGHSVVRALQHIRAVNASGDVATLAGIRPGEAMLLITRIGFNADNVAIELTDTYCRNDYYDFVAELKR

SEQ ID NO: 5337 - protein, 379 aa, Chromobacterium substugae
MKLHWQLPAVMTLSCLSAPLWAHGTMEVPINRTYSCFLEGPEAPKTAACQAARQVGGTQAMYDWNGINQNPQGDNHQAAVPDGTLCGGGKAEFKGFNLARRDWRATSIVPDANGNYEFIYKATAPHATKYFKFYITKNGWNPDLPLKWSDLELFGTVNGNPQQDAAKRYHMTLKLPQGKTGQHIIFNVWKRSDSEEAFYSCSDVSFGDAAPPAANPWKEIGNVAARENLPAGSSATLRVFDSQGRDAEKHTVALNAASGQAANWPYALALKVNAASPAIRIGVLKSQQRAVSIVPVKDATANRVYLNDSYKGYSFAVDLKKGDGGATPPAANAWQEGGKYATGQVVSYQGRQYRCLQAHTAWAGAGWTPSTQATLWQAL

SEQ ID NO: 5338 - protein, 287 aa, Chromobacterium substugae
MPFSRLAPLTLAAFLALYLVWGSTYLVIRIGVESWPPLLMAGIRFLLAGSLVLGYLAWKRTPWPDARQLGGAALLGVLMPAIGNGLVTVAEREVSSGVAALVIATVPLFTLLFARLFGHRSRPLEWAGMGLGVCGIVLLNLGSSLSASPRGAALLILASAGWALGSAWSKKLPQPAGAMGSAWTMIFGGLALLASSCAVGERLAAWPGVEGWGALLYLTVFGSMIAYSAYLYLLKTVSAAAATSYAYVNPVIAVLLGALFLGERVGVHEMLAMVVIVTAVVLISWRK

SEQ ID NO: 5339 - protein, 222 aa, Chromobacterium substugae
MQQISFISLILNASLMVQLVMAGLALTSLLSWALIFSKIAALSAAKRHSEEFERNFWSGADLNRLYEDVCRRSDTAGMERIFQSGFAEFLKQRGRGGAELSDIMDGSRRAMRAAAQRELDTLDSHTSFLATVGSVSPYVGLFGTVWGIMHAFIGLGNAGQATLSTVAPGIAEALVATAIGLFAAIPAVVAYNRFATDVDRLATRFDTYMEEFSNILQRLATR

SEQ ID NO: 5340 - protein, 193 aa, Chromobacterium substugae
MKSGSSPLPRLPGRRLQQRARAQLRHGGVIAYSTESCYGLGCHPLDVRAIRRVLAIKARPNHKGLIVIAADFEQIRHLVKPLNAAQRAELERHWPGPYTFLLPASRRVPPALRGRHDKIAVRVTAHGEAAALCRSLGTALVSTSANRAGQKSLKRARACRMAFKDRVLTLPGRIGKRRKPSTIIDLESGRVLR

SEQ ID NO: 5341 - protein, 52 aa, Chromobacterium substugae
MMHFLTHERRCWRRLAYWLKQFNTEAGPPPRCYAWRAAPEDVPEDHEDLLLH

SEQ ID NO: 5342 - protein, 421 aa, Chromobacterium substugae
MIGSGGREHALAWRIAKSRRVSKVFVAPGNAGTALDPNLTNVDLNSVDAWLAFAKQEKVDLTVVGPEAPLAAGVVDAFRSEGLKIFGPSQYCAQLESSKDFAKAFMQRHGIPTAAYRTFASATEAHAYVNDKGAPIVIKADGLAAGKGVVVAMTLDEAHAAIDDMLLGNKMGSAGSRVVIEDFLQGEEASFIVMVDGEHVLPMATSQDHKRLLDHDMGPNTGGMGAYSPAPVVTPAVHNRVMREIINPTVLGMKKDGHPYTGFLYAGLMIDADGKPHTIEFNCRFGDPETQPIMARLKTDFTMLLEAGVNGRLDKVEAEWDRRVALGVVLAAAGYPDAPRKGDAIHGIPHETDDGVVFHAGTALDGEQQLRSHGGRVLCAVGLGDSVKMAQGKAYLLADAIDFAGKQYRRDIGARAIGRKV

SEQ ID NO: 5343 - protein, 525 aa, Chromobacterium substugae
MTKIERALISVSDKSGVLEFARELASLGVHILSTGGTAKLLLDAGLPVTEVSDYTGFPEMLDGRVKTLHPKVHGGILGRRDLPEHVSTMAEHGIGNIDLVCVNLYPFEATIANPDCSLEDAIENIDIGGPTMVRSAAKNWAHVAIVTDSADYPALAAEMKANDGRLAKATRFELAKKAFTHTAAYDGAISNYLTSLADGVVAGKPERVAFPNRLNAQFIKVQDMRYGENPHQAAAFYRDLDPAAGSIAHYRQLQGKELSYNNIADADAAWEAVKTFDDTACVIVKHANPCGVAVAPDTLAAYKLAFATDTTSAFGGIIAFNRPVDAATVEAVTGQFLEVLIAPSFTAEAKAIIAAKKNVRVLEIPLETGANRFELKRVGGGVLVQTPDIRNVTPEELRVVSKRQPTPQEMSDLLFAWRVAKYVKSNAIVFCKNGQTAGIGAGQMSRVDSTRIAARKAQDAGLSLAGAVAASDAFFPFRDGIDVIAEQGIKAIIQPGGSMRDDEVFAAADEHGIALVLTGVRHFRH

SEQ ID NO: 5344 - protein, 78 aa, Chromobacterium substugae
MQNNEHIAQSVRIAMEQYFRDLDGEAPSAIYDMVLACVEKPLLEVVLIHTQGNQTRAAELLGLNRNTLRKKMKSYDLI

SEQ ID NO: 5345 - protein, 354 aa, Chromobacterium substugae
MQIGPYQLKNRLIVAPMAGVTDRPFRMLCKRLGAGMAVSEMITANKALWTTAKTLRRADHEGEVEPIVVQIAGGDPQMLAEAARLNVEHGAQIIDINMGCPAKKVCNVAAGSALLRDLDNVGRILEAVVKAVDVPVTLKTRTGWSREAKTALQVARMAENAGIAALALHGRTREDMYRGDAEYDTIRAVKQAVSIPVVANGDIDSPEKARRVLDYTGADAIMIGRAAQGRPWIFREIQHYLDTGATLPAPEVEEIRHLLLGHLDELYRFYGEYSGCRIARKHIAWYTKGLAGSNEFRQQMYRLESTDEQRLAVADYFARLGEQSDRLVYLAEDADRMDHDREAGVEGEACGYAD

SEQ ID NO: 5346 - protein, 1052 aa, Chromobacterium substugae
MELNQARLSRLQLFGTLAIVFALALTLTSYFLMMSWHDFQSGRQNIEQEASARARDNLRAYTDHAALLLSALRERTNDTVRHQLQEQVDQAWSLADAIWRREHGRRGEQDAQRLIVEALRPLRYFNGRGYFFIDTLDGRCVLLPTAPAREGTSLLANRDDRGRYIMRGLIDSVANPDGRGFSAYRWYLPGGNRMDDKITYARRFPPYNWLIGSGEYISNVEAALQQQGLDTLARMRFGQDGGELMIIDRQGVIRLYPTRPSLVGKSYQTLPAAERDRALQLIQRGKHGGFLEYSRQDEAGAAAESYLAYTRQLPGWDWTLVTSLRVQTIQDDGLRAAQRLKSRLAERIIATLGMTLVAMLCAGLLCWYFVRWVSALVRRYQHDLAQSHLSLKEQARELKLSHFMIDNATDLVALQSSQGEVVYCNLALRRLPQLVDDLFRHPPGAFPLTFETRHDGDDGELFLEITVNQLRYQGDSYLCATARDISGRRQTERQLRLAAQVFESSNEAILISDPDNRILTVNRAFCHITGYSEDEVLGRKPSLLFSGRHEPAFFQQLWQTLRQRGQWAGEIWNQRKNGEHFPCWVNISVLQDAQGAISHFVALFTDISERKEQEARVQHMAEYDALTDLPNRVLVNDRLHQAIRQAELQHNQLAVLFVDLDHFKNINDTLGHSAGDELLKEVARRLAGAVRGLDTVGRTGGDEFVLILPAINQPSEAAQIAERILRTLQQPFQIGEHSLVVSCSIGISLMPDDGSDIQNLLMNADLAMYHAKAHGRNTFRFYTREMNTQVAERLLMENRLRRAMEQQQLYLVYQPQYDMAGNRLLGCEALLRWRDPDEGLIMPGRFIPVAEDTGLIVPLGRWVLNEACRQASQWLRDGLGPIRVAVNVSAHQLMRHDFIDDVRDALQKNSLPGHCLELEVTESTLMADADLASRQLAVIKAMGVRLSVDDFGTGYSSLAYLKRFAPDTVKIDRSFITDLPGDEENAAIVSAIIHLAGALGMETLAEGVENETQQHFLETLGCEAMQGYLLGTPLAEELMTRRLEAQQPLQPA

SEQ ID NO: 5347 - protein, 190 aa, Chromobacterium substugae
MKTALLTLDYIIDIMHPTGKTARCAGHAAERGVIAAANCAIALARRQGWPIIHVKVGFSPNYAEMPEGSAIFSRAQALQALNLAGPGTDFHPELDVALEDAVVVKHRISPFYATGLEAVLRAQRVERLVIAGVSSTWAVQAAARDAHDRDYRVLVLEPACAAANEDEHQMSMKQLAAIAGIIDQAQLEAL

SEQ ID NO: 5348 - protein, 146 aa, Chromobacterium substugae
MMKDNSAHIAAATRLRMQLMTMTRRLRQQASQDVLPFGLLAVLGAIDRAGGEATPTELARGESLRSSNLAGLLRELEGGGLIRRLPDPEDGRRVRVQLSAAGAAALQRNRQLRDGWLQARLDGLGDADRALLLRAGALLERLARED

SEQ ID NO: 5349 - protein, 69 aa, Chromobacterium substugae
MDTIQGKRVLVTCPSILGEKGSDWEGAAIFGRDYLVELLALGLAYRVLNFADVKIAMLKAGEHVATQRA

SEQ ID NO: 5350 - protein, 300 aa, Chromobacterium substugae
MIDDFKSYFLGRLAQLLESRGIAERERTLWLKTLLGIDLSSANRKLKGGIAFNIEELAKVSRAVSCSSDYLLGLKDEASATRPPGHAFDGLGVRATLDCDRLPAQDTMTVAARHLGDPDEKALIAWISRNESALNAQVVAWKPVGGSGWKMAERADAPSDATLHRVYARLALDPAISAYRIAVLDDRAETAEVMQGFLEQAGYIADTYTRTDELAKALRQTRYDAFVLDWSMGRGETTESLMEDIRQNHAADTPIILITGEASELEIERAIDRHGVRYFQKTGLFKPIIAQLKKDLRELA

SEQ ID NO: 5351 - protein, 452 aa, Chromobacterium substugae
MQQGRQWLMFFCLAVLLPMLCFFYVQSTLFSKQALEQAAGPGEGYYWAASQYRYAVQRLYGEINAYALHIETFEDLQVAYDVLESKYLVLNRSVSPQLRKNADYAALLEQIAGFMRRGKILFPATRSDAAALAALQQELNDMSPVIADLVIAAHHEEVRLRDASIEQTLRLRNFALVSLIIWAVLVVFLARELWKAIRRQEIIELQREMIAAAKQAQEEAVQTALARSTMLSTVSHEILTPLHTIQGGVELLSDMEREPRVLRTIANVRTAADYLSKLMQDLLDMGRLDAGRMILRPTRFEPGQLLGSVVGEFRQVAAAKGVALSFAAAGVAGVEAHADMTRIRQVASNLISNALRYTDAGEVRVALELEGVAPRACLTLTVSDTGIGIPESEQACLFEAFTQAKGANRGGAGMGLAIVRKIAVLMQGEVFLAGSEVGKGSTFIARLPVELV

SEQ ID NO: 5352 - protein, 164 aa, Chromobacterium substugae
MRDGMKRLLAGMLLAWSGAAMASPADVMLTVRGGAGMFNDAGRSEYRFTESELLRLPQRTITTRTTWTPRSVFSGPGLSDILRAVGARGSKIELVTYDEYKVILPLSDLDKYHPIMARFINGKPLERRDFGPLWMMYPVSDFAELQKVKADAKLAWQIKTIVVR

SEQ ID NO: 5353 - protein, 287 aa, Chromobacterium substugae
MIAKSITRYLITLLLLAAAVWAGKTLWDHYMLSPWTRDGRVKADVVTIAADVSGIVTQVAVKDNQPVRRGDVLFVIDPSRYRAALAQAEATLAGHQADKSRRGKEAARRASLDSAIVSTESRESADFAAAAAVSQYQAAVAARELAALNLQRTVVRAPTDGYVTNLNVHVGDFAATGAPRLALIDGGSFYVDGYFEETKLPMLKVGAKAEVTLMSSGQRLRGHIASIARGITDRDAGTGRELLADVNPTFNWVRLAQRVPVRIQLDEQPQGQPLIAGQTCTVVIVGK

SEQ ID NO: 5354 - protein, 66 aa, Chromobacterium substugae
MPHEIAVFGILMPTLLPLFVLGMLLQIGLDWALGRLGVYEKVWHPALFRWCLLIVIFSALALPLYR

SEQ ID NO: 5355 - protein, 712 aa, Chromobacterium substugae
MSAGLLAAGRRVGRDWLASEGENWSFVAKTLLAAFASLWIAFRLGFDSPSSAMTTVFIVTFPRSGAVLEKSAYRILGTLVGSAAALGFVGLFDGQAALLLISLALWVGVCTGGATLYRDSRSYAFVLSGYTACMIALPALNHPLAVFNLAVTRVSEISLGIFCCAVINDFIFPRHQADLVVRTVRGRYHGFVLLCQEALTQRLDAATLEATQLRFASDIAALEAGRAAAFFEAGNVRARSNQLHAFNATFMAALTTFHTLHRQMERLRRDPASPLPSLFYPLFQRAAAALSNDDGPARTALEAGPTLARLDAVRPGLRQDLAAAREQLLAQPHDESLRIEFDTASELLLRFVEEMHTFTAVYHGFRQRNPLQVEALAYSARTPAAIALASGARAALTLLTLSVAWYWLAWPSALGAVLLATIFCGLASSSPRPLLMVKQILVGFALATPLAYVCTFKLLNQADSFALLALAMSPFLVLGCYLKCWPKTAGVGTGITLLMAQAVNPENMMSYDVVAFLNDGIARLLGLALAGMFFVLVLPEHTMGSRRHIAAALWREALNACRAGLPHLKQRYGNRVRDLLNQLNAAPGEAGDPARQATISQAITLLELGLAIIDLRQLARDAGQEPVRRALDASVAALADYFAAPQPPQLRRAMAALLAAGPPIRAQLAVALPEAAASLNRALATLHLIHTSLLDAMPQPEAGAPAGDGHAA

SEQ ID NO: 5356 - protein, 482 aa, Chromobacterium substugae
MQRFYTVWIAGLALLAAGCADPGAGGPQSRLLDADSLSAGKRIQEAAAKAGWPQADWWHQLHDAQLDQLVTAALAGNPGLRAAAARLRQAQALAGVAESATRPQAAGEASFTRQRYSEQDFIPPPEAGNYSWYNHAALNASYDLDLWGRQRAALSAALDEAQVLAAEAQLARLNLSAAVVRAYVQLALQYAEKDLLQDNLAQRERSWQLAKKRKAAGLAAEAEVVLLESRLPAARNQIEQVDEAIELLRNQLAALCGQGPAAGEALRRPTLKLDDAAPRLPSALPAELVGRRPDVSAQRWKVEAEARKIDAAKAAFYPNINLMAFAGFQAIGFDNFPSASTAVRGIGPAISLPIFEGGRLRSALSAQTAAYDAAVDSYNASVVRALNEVAGAIAKVESQAGQQKQTELALASAQKAFRLAQQGYRAGLSDQDNVIAARLALLAAKQQLARIRSERLDSFAALMSALGGGVAVSQPPAEGKPQ

SEQ ID NO: 5357 - protein, 1271 aa, Chromobacterium substugae
MSEHHDLPPETPQAPPAAPPRPRRWRLAFSCLALTLALLLAGLGWISASPAGFAWALGKLDWLSGQRLSVGATQGTLWRGFALRDIRLRGGADDVDIESLRLDWQPAALSRGELRISRLDVGHVRVLSRPAPEQKSAPLAAPRTLALPLRLKVDQLNLASLTLEPAHFSLYRLQAAYDYDGARHRLQLQRLDSPWGEARAGLTLSAASPFALSGQLSAKGELEQVPVKARLDLSGDLLKPAFSGEMDGKGVSVDIAGALRPFDANPFNRLVRLDARVGNINPQAILPDWPKARLSFAVFAEPDAGQRVKGGLTLVNTEPGALSAQRLPLSLLAGEFRADEQALELFNSHAELGGGKLGLVGEVKPDRMKLALDLSQLSLRQLHASAPDDVISGRLTAEGAFAAPRFAAQLKGKWLQASALAELSGGQQPALLLKKLELGAGSGAASVNGKLGLSGKRLFELNGKLVHADPARLRDGLPSGDLNATLKMAGQLAEPMEVGAKLQLAPSRLSGAPLSGNASVLLGEARLKQLLLDLKLADNRLQASGSYGVLGDKLKLAVNAPNLSLLGPGFAGVVQGQGELAGVPKIPVLSAKLQAQRLRLPGGVALQSMQFAGNIKADQASPFQLSLDVAALQAGGVSAEQLRARASGTRARHSLQLDGRFQLEQQNYALQLAAAGGLSLDNRWQGSLQKLELAGKPGLSLQAPADLTLGADGQARLGAARLALLGGSLNLAELTRQANGALSGGGSARGLRLSELGPWLKLPLEQNLQFDADWSLSPAGIGKLALWRSGGDVQLPLDKGRHVALGLKTARAELDLDGRQLAFNVSVDSRFAQAQGQGSLPWNGGRIDGHTPLSGNLRASLPSLAALAELSGPGLELGGQLAANLDLGGPLQMPQAQGQIRGDKLKLADRRTGVSLSDGSLLARVDGRQLTLQQLRFVSGKGEVNASGSLDFSDAQPDARVKVSLQKFSVFDRPNRRLVVSGQSELAFVGGRLSLSGRIRADQGRVGLPKLGAPDLGADVVVVGRPAAEPSAFATMPLTVALDLDLGERFRFSGQGLDVELSGLVHVSANPGEAPAARGQVKVDKGRYKAYGQDLDITFGAITFNGPLDNPLLNVQAKRRLSPVGAGVEVTGSVAAPKVRLITDDPMADKDKLAWLVLGRAASGDRDNNDLAASAGMMLAGSINDHIGLFDDLGVSSRKEKTLSNGTVSPAEQVVTVGRQLTRELYLGYEYGISSADQAVKLAYQLSKGWSVVLRAGTAMSAESRYTLRFD

SEQ ID NO: 5358 - protein, 569 aa, Chromobacterium substugae
MAAILLAGQAQAALDYMVEIDAPSNLAQLLRDNLELVENQRDPDIDQSWLEALVKSTPDDAKKLLETEGYFGAKVEAALEGGNRVKVKVSPGEPVLIDDVVIRLDGAVRQESDYQQRFAQVLEAWTLPMGAPYRQADWDAGKRAVLRRVQADRFPKARIVKSEARIDPATRRATLDVAVDSGPLIRFGAIKVNGLKRYPEKLATGMADFNPGSPYHQDKVLAFQSALEQSPQFSSVIVSADFDHIVDNQVPVTVDVVELPKKKLELGLTYDSDVGPGVRVGYDHYNLFQQGWTGSALVDWKREQQSLSFGLGFPRESDGYSHSLTSAFKSENVQGVKTNTMDAGAWRLRSRGNIEARLGVEFLKESAEAGGVTSSDTHVTQLVYGWTQRAVDDLMRPRSGYLLDGQLSGSLGALASSTSMVRAYGRAVGYWSPFPKYGTFVARLELGQVWAKEGAQVPSALLFRAGGANSVRGYDYQSLGLPGPNGSVLGGRVVATGSVEYQIPVKPDWYLALFSDAGNAADSWKGFQTMRANGVGVRWMSPVAPLSFDIAKAEGDGKIRWNLSLGLAF

SEQ ID NO: 5359 - protein, 75 aa, Chromobacterium substugae
MAASSVRANALPAGVQVSCLVRAERDGEPAQARNVHLLFRRDGKAGDFHAPAFQPDADDVQALFALVGSVSVTDR

SEQ ID NO: 5360 - protein, 56 aa, Chromobacterium substugae
MKSLIWLACLLSPFAATAQPIAIAAPDAGWQVRFDAPEWKPLRSQTALFTRPQRAS

SEQ ID NO: 5361 - protein, 209 aa, Chromobacterium substugae
MSIRISGPRLAMRKAPRQARSRATVDVIVEAGARVLGARGWGGFTTSEVAGVAGVSIGSLYQYFPNKIVLVDAIRRRHFDEVLAALQRVCDGLGRPECPLERLVDGMIAVHGGCPALHRALLDVPVPDEMRAAGDAFQAEYLRRYRAIVAGCRGVARDEDDELAAQTISSAIEGVVHNAARRGRLAEAGVRRELVRLLRAYLGDCREGR

SEQ ID NO: 5362 - protein, 202 aa, Chromobacterium substugae
MPASSANNINDAASYYSHGKVSIMSASRLLARLFRYQAWANDDMLRALAALDPGRHAEERQLGLRLMNHCLVVNQIFAAHLAGRSHGFAADNTPDTPAPEALRRELAAVDRWYLDYAEAATPDLLAQPLPFTFTDGDPGFMSHEDILAHVVTHNGYHRGEAGRLLRQANDRAPLRGELPWDTYAVHLHRAEPERRRQGRAAP

SEQ ID NO: 5363 - protein, 397 aa, Chromobacterium substugae
MFDKSDKSIILKTIMVAAPILICMGLLPVLSFYIEKLEENGRAEIVDYIAIAQAAMEVKFDAADLNGWQTGYAFDIIRHVDGASRNDAVSRAEFLRSAGNFRRDIQALRAMPLAADQRNLLDEVQQDFDSFMALDARIIAMYRGGAPATRDKASNLVMGEEIQIFNHISQNTNALAVSITLDLMKKVAQSNSYGIVARWMMLVMWIIASAMGILLVRLLHKWLGQMRSLMQKLESLAGTDELTQLPNRRTWDIQIEMMLAAAKRYRQPIAVALFDLDHFKQFNDSHGHPEGDRLLREVSILIKSRMRQSDLFARFGGEEFVLALMDCDLPQAVTRIDSLRRNLPDNQTFSVGVTLWAEGERIHNTLARADKALYQAKDGGRDRVVGVEPPGGRIEGR

SEQ ID NO: 5364 - protein, 231 aa, Chromobacterium substugae
MTLPQAVFFDLDNTLVHRNDSIDLYALQFWRDFGHAIGSGGAERVAEVIKRCDNGGYLPAGSPHGSIKQAVSHGLKTQIVWRQAVEQEALLDHWERYNAVCTAAMPGAAEAVAALLARGVRIGVISNGSHRTRLEKVARLPFASAIELTVSSESAGVGKPDAAIFRLAAEALGVAPAECWYVGDHPLNDVIGAAGAGMAPVWLSGFHAWPAERPRPARGIFALGQLAEGLV

SEQ ID NO: 5365 - protein, 40 aa, Chromobacterium substugae
MDELWGQFEAYFADFVSGARDGRYVYSAEYGGLASAEDVA

SEQ ID NO: 5366 - protein, 222 aa, Chromobacterium substugae
MNHHLDLSVNLPLRLDYAKNFPLRVLRREEGFWFVAAEIAASMKQEVEDLLHTLEQPAGRLLLLAGEDEPVLCLSEGELDEVVRRIKKPGARRLRRWWQEETRPALLHEGGPATTAESLHLALALAAEAAQQVGRAVMEAVLRGPRPWQHSRWVVALDYERHNKQRWPHGKLIGLTSSVATLEGLAELIAEPGRMPVNNTDLVKLASACHLRLAERMGRIAG

SEQ ID NO: 5367 - protein, 597 aa, Chromobacterium substugae
MKSINKVKQDLTVKGETIERLYINYVEDKYTVNRRYQRKLVWGIEEKKAFIDSISKKFPVPIILLAENIKSQSIEIIDGMQRLNAIFSFIEGEITLDNRYFDLESIASTKQLLDAGVLKQNLPKLDRAECVKITAYEVPMSIFEYSSDTDVDEVFRRINSGGRKLSRQELRAAGSLDDFSTATRKISASIRGDSSHSDILPLNKMKLISVASRDLGYGIDVDSVFWVSQGVLSKEEVRQSLDEQIIADILAYVISHEKPGSRSEYLDDYFGLRDTEASIKRFNEVNLLTRKIGIENLNDNFLKIIDTIIEASKKSGLALTTILFGQDAQPKAPRVFQIVFLALYEIIINNNMRVKSIDGLIEKLKKHGPKIQPQEGGRWGAEHRKDQVERLKKLIIKEFIHNEESDPIESHWESKLNNLLTQSKTEQASYDFKQGFLELESPYKFDVKSLEKILKTCAGIANLDINAKGYVIVGISDSEETTKRIRSIHGIESYEQNGFYISGIDHEATKTNKTIDQYYQNIVEKIRQSPLDKTLKDHICRNIKCINYKEKSLIIFEVTAQEDPSLYNDELYIREGASVRKLAQNELPNIYKRFARQ

SEQ ID NO: 5368 - protein, 122 aa, Chromobacterium substugae
MVVLPDHFHAVWALPQGDADYATRMALIKAAFSRSLPKVERIRESRERKRERGIWQRRYWEHQIRDEADLQAHVDYIHYNPVKHGDAERVADWPYSSFHRYVRLGWLPADWAGEGVVVQLQE

SEQ ID NO: 5369 - protein, 148 aa, Chromobacterium substugae
MAANEQLQDEHQRYGRSGEPYAVLLLDIDHFKRVNDSCGHDAGDRVLAHLAQVIRQAARATDFVARYGGEEFLLLLPATDAEGAAVLAEKIRAVVEQSQAPDVGRITVSIGLAVAGRADEQPEAVVKRADQALYQAKAGGRNRVEGGA

SEQ ID NO: 5370 - protein, 248 aa, Chromobacterium substugae; identical to SEQ ID NO: 5061

SEQ ID NO: 5371 - protein, 309 aa, Chromobacterium substugae
MQTVDRVIRARLHSDVVLIRQVAEYIISAGGKRLRPALTLLSGRALGYQGEHLFELAAMIEFIHTATLLHDDVVDESDLRRGRKTANALFGNAASVLVGDFLYTRAFQMMVTTRNMTILEVMAEATNIIAEGEVLQLLNIGNTDVSEDEYLKVIQYKTAKLFEAAARVGALIADAAPEQVQAMADYGMYLGTAFQIIDDVLDYSGDAETIGKSLGDDLAEGKPTLPLIYTMRHGSPEASSTVRAALENASRDGFQDVLAAVQSCGALDYAKNEATKMAEKAIAALQAIPDTETRQALTELARLSVDRSA

SEQ ID NO: 5372 - protein, 103 aa, Chromobacterium substugae
MYAVIKTGGKQYKVVVGEKLKVEQIPADVDSQIVLEEVLMIADGEQVVVGAPMIAGATVKATVVSHGRGDKIRIFKMRRRKHYQKHQGHRQNFTEIRIDAISK

SEQ ID NO: 5373 - protein, 91 aa, Chromobacterium substugae
MAHKKAGGSSRNGRDSEAKRLGVKVYGSELIPAGSIIVRQRGTRFHAGENVGQGKDHTLFAKVDGYVEFTVKGAQQRKTVNVIPYTGVDGE

SEQ ID NO: 5374 - protein, 387 aa, Chromobacterium substugae
MKFIDEARIEVMAGRGGNGVASFRREKYIPFGGPDGGDGGKGGSVFAVADENVNTLVEFRFVKKYLAEHGERGRGADCYGKGGDDIELKMPVGTVITDHDTGELVADLTHHGQRIMIAKGGKGGLGNIHFKSSTNRSPRQCTPGEQGEQRTLKLELKVLADVGLLGMPNAGKSTFIRSVSAARPKVADYPFTTLHPNLGVVRMDDSRSFVIADIPGLIEGAAEGAGLGHRFLKHLQRTGLLLHVVDIAPFDPDVDPVREARAIVEELKKYDEELHEKPRWLVLNKVDMLPPDERELTVSAFLNAYGWPADKPDDSDGFDIKAPRVFSISALNHEGTRELTFAIMAYLDVVRAAARKQAEKEREAAAAARQTVIAPEAPSSATEGDQA

SEQ ID NO: 5375 - protein, 259 aa, Chromobacterium substugae
MKKALAALAVGLVAASMGAYAKDWKEVRFGVDASYAPFESKAANGQIVGFDIDLGTEICKRMKAKCVWVENDFDGMIPALKAKKFDGVLSSMSMTEARMKEIAFSAKLFNTPTRMIAKTGAGLMPTPASLKGKRVGVEQGTIQEAYAKKHWAPAGVEVVPYQNQTLVLADLTAGRLDASLQDAVQADMGFLKKPEGKGFAFAGKDLVDPQTLGEGAGIGLRKEDTDLKAAIDKAIAGMLKDGTYKKIEKKYFSFDVYGN

SEQ ID NO: 5376 - protein, 229 aa, Chromobacterium substugae
MFLDGFGPIIWQGTLVTLELSVLSLLLAFVIGLAGAGAKLSSNPVLGGLSTIYTTLVRGVPDLVLMLLIFYSLQIGMNKLTDALHIDQIDLDPFVSGIVTLGFIYGAYFTETLRGAFLSVPKGQIEAGIAYGMSHWQVFSRVQFPQMMRFALPGISNNWQVMLKATALVSIIGLADVVKASVDAGKSTYKVFFFTLVAGAIYLLLTTLSNFVLMKLERRYSMGVREAEL

SEQ ID NO: 5377 - protein, 237 aa, Chromobacterium substugae
MIDIIQQYWRAFLWSDGYHLSGLAVTMWLLVLSIAFGFVVSVPLAVARVSKVKWLARSVWLYTYVFRGTPLYVQLLFFYSGMYSLDVVREVGFLNHFFREGYNCTILAFALNTCAYTTEIFAGAIKATPYGEIEAGRAYGMSTFTLYRRVIIPSALRRALPAYSNEVILMLHATTVAFTATVPDILKVARDANAATYDSFNAFGLAALLYLSITFILVGLFRKAESRWLAYLRPIKS

SEQ ID NO: 5378 - protein, 261 aa, Chromobacterium substugae
MTGEFKMDKLNISNIHKSYGDHEVLKGISLKAKAGDVISIIGSSGSGKSTFLRCINFLEKPNQGSIALNGEEIRLAKDKRGELIPADQKQLQTMRTKLAMVFQHFNLWGHMTVLENVIEAPVHVLGLPRDEAVARAKKYLEKVGLDERAQAKYPAHLSGGQQQRVAIARALAMEPEVMLFDEPTSALDPELVGEVLKVMQALAEEGRTMIVVTHEMGFARNVSNHVMFLHKGLVEEEGHPDEVFGNTKSERLKAFLSGSLK

SEQ ID NO: 5379 - protein, 79 aa, Chromobacterium substugae
MKILAIAAILALGLAACAQTPSAPPRAVGMANPASVFCVQQGGTLLPQKDANGGEYALCRLADGREVEEWTYFREMHPH

SEQ ID NO: 5380 - protein, 154 aa, Chromobacterium substugae
MKPSLPALLPLLLLPLLSPAPARAGDAATAVFAELPAQPAYHAAWQTMLAGEKKVPRWVSRARATSSPYQAASIDGQNYLAGEMCKPHDCSANRFYGVFRADKRQAWGLLVTVADVPDAVEHPARHARYRWFGKPGAKIKAYLNDQLKADPNWK

SEQ ID NO: 5381 - protein, 375 aa, Chromobacterium substugae
MLTRHHPLLSPSLGSQRALTSFHFGQAGRGEKVHIQASLHADELPGMLVAWHLKQRLLQLESEGAILGEIAVLPAANPIGLNQNQHNRLLGRFEMMSGQNFNRHYHAMAQPVFAAVRGQLGPDPRANTRLIRAAMKEELARQQPQSELQSLRHALHSLAFDADIMLDLHCDSRAELHVYTGTPLWDQCEPLSRYLGACASLLAEDSGDQPFDEACSQPWWQLRELAVQAGIDAPIEMACLAVTIELRGENDVNHEYAAKDAEAIIHFLQHRGAIAGDAPPLPPLRHPATPLAGSEDLLAPHAGVVVYRAAPGSLLSPGDLVADVIDPLNDTVSQVCTQRGGVLYATSDRPYATAGLGLARVAGSTAFKSGKLLTA

SEQ ID NO: 5382 - protein, 422 aa, Chromobacterium substugae
MDSLSDFFQPGIEPGSLQAVSRLQGAWSYLSVFVTLFRGGDEEVLMRLLVLRELGGRAEAPLWTPQEIARRFSYLNDTKLATILGRLREGELLVYDSDGGVYQLSEGARVALAALATLIDFSGDDVELGYLASQVAAGQAVGQVSDEALRHLLARLNELYAEFEEALESQSEFRIRAAQHRLEAVWRWVAKSTEVVKGLTQDDTLSLTVLNQAQAIALAQSRMLALAGTFERRLAQLAAQRVHLGNSGLTSTDIADWLRRQGAATLAGKLAGAWSICPEPAFLSTPELADVAEFELLARERAKAGAQVLPGSEAAPVADAPEMERLLEAEEMYDLLLQLGMSGAADAHISQAVLADSYNETAYRLSLLSLIGDPETSNDQSIVAALAKLPFSLQGGDAVIEMDHPEVATLSDARLVAAQPKS

SEQ ID NO: 5383 - protein, 252 aa, Chromobacterium substugae
MEHEIKTLTARLLAQRVVPRADALARKALLDDIFRAELDKSLAAVGLRLVENPYAEHIAAALLPEMTEPVFGSGDAWLNNNLGLPRDGVALLVILWALIILPKRERQIARVEAGKENQSDMFGAQKPLETGETVSTGISEDALYADFGKALGGRTRFSANLGRLVNLGFIVRRNRWLDEGPMLDLMIDYAQLAPRIIEGALADVLLRREGRDMLVDKRVDDEIEEEGADDDMASAGPLFELPPDDAADGEAR

SEQ ID NO: 5384 - protein, 936 aa, Chromobacterium substugae
MFQMKSVEMVHWDFWQRLSVPLDAQIVTIIGPNGSGKTTLLDAMRTLLAIKCSGKRDYKRYVRNNKEAFAYLRGVVDNPRRPSGGLYPTPFFPIVSESVTLLCRIKKQGGDWVRHYAILDGDIALEHAEGQAQWLGVQEYRRRLEAAGLTPAVAEVLALEQGDTDKLTEYSPRQLLDLVFQVFGDKDVLDNYQRARDEQRATELELEALSRQEEALQVRVEAMKNRANRYLEWKQLQTGIARLRDEALPVLAYLDAKSSFGKQWHDYRGGYHVLNQARAEHADTLALVAKLKAAEVSASEARGAAETVRLAAQEAFMKAKGEHAGVAGQLKERDRLQALAGKEYGADAAQLADKLSALRAEAEQLKDGLRGLKKQRQDSSEHLQALEVGRGRSPEDVRQFKAALDEAGIAHAMLSDIVEVMDSNWQGAVEALLRGYRHVVLLDKESDRREAWKIGEKLRYRHFVVPERAAPPRAAKGSLLEVVRFSADAPEWLYRQMNSVTRVENALEGASAEGDWITRDGYFRERRGARHIGVPAHEYAFGEAARQSRLLAVRDELKALNVRILGDEERLVAATREAAGLAEYLGGMDAIRQLDSRADEFSALESRKAELEAEIARQGAALADAGAEKDAADQRHGDARLAHDRVCQREMESLSKYKQKLQDVEQARRQLRRLIGELREWAERLPDAALAADNVAALENEFDTAADARHQLSYLEERLQNGDWEQDEAVLMLKDKLVDDLTQLDRERQRRQGEVDRSRELTEEARAAYMGKLRATVRAYGQNVKRLGELAGIQVEVELPQLSNDDAVLAQAGLVLKFNFDQKGMMGMNDGEASGGQQVMKSLILLIGLMMDESNPSGFVFIDEPFAHLDIFNIDRVAGFLKATEAQYLITTPNTHNINIFAPSELTLATRKKRPGETWAPPILQTRRRVDGGEQA

SEQ ID NO: 5385 - protein, 417 aa, Chromobacterium substugae
MSRSEAQSWSLDIALAQGGFDALHPEGKNTLLQLGHDPADFDAVFAQVKSGAMLPKAWAEVAARAERRAAHYERDGYRRTAADLYLRAAVMWGRAQYSIFDAADPRKLALRARCNHCVERIGELRGGRVRRVEIPFEGGVIHALLHLPDGEVRQAAAVILGPGMDMIKEDYLYAAERYYTSRGMVALSIEGPGQGESRAGGLTVTLDNYERALEAYAGYLAGLPEVDAGRIGMFGISMSGYWGLRAAAGRTRLAALAAYEPVCGDFLTIFERAQPSFKKNYMYMSGYQEEARFDRDLRDQMPLGALAADIRIPVLLGIGEFDELTPLEQALACYQRIRAPKEMRVYENEFHPLGGVAAEVFRYGAEWLERALNGDPALREAGRDIRHYLRRDGHIGDGSAAPDWWQGADPTRLSGNG

SEQ ID NO: 5386 - protein, 160 aa, Chromobacterium substugae
MSTKPQGDAASSAAEDARRQALARLSRAAYSLSAADARLRGRATRQAGALSLSHARVLRILAEEGALPVARLAELTETTGAGVTQLVNGLSEQGYVEKAKSLLDKRSVLVQLTELGLARHRERERLLAEVLERALRDMDERSLDAAAAVLRALGGVYDQL

SEQ ID NO: 5387 - protein, 239 aa, Chromobacterium substugae
MQDSPIVRAQPELDRRGFLLAAAGSLAAIALPAWSPRARASSAHALPPLPYADNALEPVISARTIGFHYGKHHKAYLDNLAKLTAGRDYADLSLEDIIARSAKQAGDAAIFNNASQLWNHTFYWNSMRPKAGGAPPQALRERIEASFGSVDACKQQLAGAAISQFGSGWAWLVQDGDKLRVVKTANADTPATAGLTPLLNVDVWEHAYYLDYQNRRADYVNAVLDKLVNWEFAQQNLKA

SEQ ID NO: 5388 - protein, 156 aa, Chromobacterium substugae
MANQLDRDQKAGLFIVSYNVFKPGVDGGYKLQLKLSVYPPSRRVSGEAVITHATAQPLVFKSPVQGHYEENGSNIELFLFGHQLPQAQGQHPQQQAHAPLGEDFHFDGQLKGGWQADAGSKARYAFLQNGHWTEVSGQDIHLSDELRHAAKSLNLR

SEQ ID NO: 5389 - protein, 165 aa, Chromobacterium substugae
MATVTLRGNPVEVAGALPAKGAAAPALQLTGGDLAEVTLDTYAGKRKILNIFPSVDTPTCAMSVRKFNEKAAGLADAVVLCISADLPFAQKRFCGAEGIEGVVNLSTFRNPAFAEAYGVKLASGPLAGLTARAVVVLDADNKVLHSQLVGEIADEPDYAAALAAL

SEQ ID NO: 5390 - protein, 544 aa, Chromobacterium substugae
MQQQHSRHIGPVALMLTGLGSIIGSGWLFGAAHAAQIAGPAAIVAWIVGMVIILSIALSYAELGAMFPESGGMVRYARYSHGSLLGFIAAWANWIAIVSVIPIEAEASVQYMSTWPYEWAHNLYRNGELSTIGLSFAAVLVIAYFLLNYWGVKLFAKANSAITIFKVIVPAVTVGALVYSGFHSENLNNPALGGFAPFGWASVMTAVATSGIVFSFNGFQSPINLAGEARNPGKSVPFGVVGSILLAAVIYVALQVAFLGALSPAELVHGWKGLDFSSPFAQLAMALGLNWLMMTLYFDAFVSPSGTGATYMASTSRMIYGMQRNGTMPAIFGRIHPLYRIPRPAMWFNLAVSFVFLFFFRGWGTLAAVISVATVISYLTGPISAAALRRCAPDLPRPLRLAGLNIVAPFAFVCASLVLYWARWPLTGQILFLIVAALPVYIWYQAKAGWPEFSRELKGAMWMVLYLPTMALLSWIGSTDFGGLGILPYGVDMAVVAAASLGFYFWGVNSGWYTRYLRDEHDPKLVEAMQAENQPSGKPAVQRG

SEQ ID NO: 5391 - protein, 101 aa, Chromobacterium substugae
MLLLQGRISCHLNDDGQRLCRGGAHAPDVSGGGCPHSRVGPVLCKSRLPAGQADRVGGSAAAAWGNGRQRPTTEIMMLPPTAGVSLNFVRHIDPNFRVRGL

SEQ ID NO: 5392 - protein, 546 aa, Chromobacterium substugae
MSLIKRLWLTIAFTLASLALVISVTGQQLYAFTRHVDNYNRLQQLASDLQQLKAIALSFARADPLLPETGLRLQAAQRQVADLQRDIQSNLPAADGQALGAALRGHWQAYVRNLASAIHIAETAPQDALSIPEQAYQQDLAPLAAQIDSQVARRDGELRREKAELAAALSWLAPLILGPLALASALVVLIQLTLARRLKRHLGAMARAADALSEGNLGVRLPDSGGDELAHAAARINRFLDRLAGLLDEVRRHAGDNLRDSQRLQLLTRQSADASRQQTQKSRLSNEAAGEIAGHAERVAQHVEAAQDSSRSAAAVTGGARELGGRNVATMQRLAERIDTATREMRELGRAVGAIGQISALIREVADQTNLLALNAAIEAARAGEAGRGFAVVADEVRKLSERTAAATSGIFDSLRQMERAQGALGEAIAAAGSASRDSQDAQLALEQALDTVDGALSGLAGLMEDISDARERQSRAGGSIRQHGHELASLAHDIESQMGQAEPLMLQLAASASGLNQALAWFRLPAAARGADTQVRFAAPAPAPR

SEQ ID NO: 5393 - protein, 170 aa, Chromobacterium substugae
MHPTPQAHDAEELEYVGFWLRALASLVDTALLLIASLPLWWLLEPKAAPEPAAGTLDFSTLLGIGGLGDILTNYLLPALAVILFWLYKSATPGKMMLGARVVDADSGQALKPGQAVLRYLGYFAAAIPFCVGLIWVGLDPRKQGWHDKLARTVVVRPKRRVEAVSFQPPR

SEQ ID NO: 5394 - protein, 181 aa, Chromobacterium substugae
MKSNIRPYDGHHPDIAAGCYIDPAAVVIGEVALEKGASVWPCAVLRGDVNHIRVGENSNVQDHAMLHVSHKTASDPAGAPLIIGKHVTIGHHVTLHGCTIGDEVLIGIGSIVLDRAVIEDRVLIGAGSLVPPGKRLASGYLYLGNPVKQARPLTDKELAYFKYSAEHYLRVADKHKANLED

SEQ ID NO: 5395 - protein, 705 aa, Chromobacterium substugae
MTELCRRRPAARKFPYHISLTKQDVEAMSQNPLLDFSGLPRFAEIRPEHIGPAIETLLEEARAAVARLTAEPGEPGWDSFVSPLTDATERLSRAWGVVGHLNAVVNTPELREAYNANIPRISEFWTEMGQNLDLFARFKALAGGGEYASYGAARKKIVENDLRDFRLSGAELDDAAKERFAAIQTRLAELSAKFEQNVLDATDAFTLYLDDKAELAGVPEDALELFAAAAEGDGKPGYKITLQFPFYFPVLQYADNRALREKLYQAYVQRASEFGPAERDNGPIIREKLQLAREEAQLLGFANFAELSLFTKMAESPEQVIAFLRDLAAKAKPFAVKDRQELEAFAKSELGLDTLQAWDLAYAAEKLRVARYAFSEQEVKQYFPEAKVVQGLFGVVNKLFGVEVRDSGAPVWHPDVRFYDILKDGELLGSFYFDLYARDGKRSGAWMDDARGRRLKGDALQTPVAYLTCNFTRPVGDKPALFTHDEVITLFHEFGHGLHHMLTRVDELGVSGINGVEWDAVELPSQFLENFAWEWDVLQGMTAHAETGATLPRALFDKMLAAKNFQSGMATVRQLEFALFDLTLYSNFDAERGDWLQLLAEVRAEVAVNIPPAYNRFPNSFSHIFAGGYAAGYYSYKWAEVLSADAYAAFEEVGGADAETGKRFWNEILAVGGSRPALESFRAFRGRDPEIDALLRHSGMVADAA

SEQ ID NO: 5396 - protein, 257 aa, Chromobacterium substugae
MRFATWNVNSLKVRLPQVIQWLADTGVEVLCLQELKMDQDVFPLAEIEAAGYRAVWFGQKTYNGVAILAKAPLEIEDVVSGIPGYGDEQRRVITATIAGVRTICAYFVNGEAVDSPKYPYKLEWLSKLEGHVAAELAAHPQLLLLGDYNIAPEDRDVYDPEGWHEQVLCSTPEREAFRRLIGLGLSDSFRLFNQEEKQYSWWDYRQMMFRRNKGVRIDHILVSDALKPRAASCEIDKAPRKWERPSDHTPVVLTLAD

SEQ ID NO: 5397 - protein, 235 aa, Chromobacterium substugae
MTTLHTRASAGDPYYQDVPAYMTEVYDWAYVNPRKARLLDHKLVVRTLLFGNDQRLMRAYLDEIRPGERVWQVAHVYGDLVQRAAARVGEAGRFTLTDVTPIQVELAAGKLAGLPQAEVVRADAARYHTDGKQDLVCSFFLLHEVPEEMKAAIVDNMLAQVAPGGRALFVDYHRPQPWQPIGWLLKWVNRALEPFAEALWNQEIRAYAREAERFDWSKRTVFGGVYQIALARRKD

SEQ ID NO: 5398 - protein, 308 aa, Chromobacterium substugae
MKKLTLLALSAVFGLSSAAGFAAQAVPASAPAAKVAPAAKKVEKKTPAKIHHAKKAEKVTASAQKAQAAKADASVPAKKVVKKKVGVKKHASAPAAQKAQAAKADASAPKAKKAHKHAAKKHAAKKEASAAQKAQAAKADASAPVAKKAHKHHAKKHAAKKEASAAQKAQAAKADASAPVAKKAHKHAAKKHAVKKEASAQKAQAAKADASAPVAKKAHKHHAKKHAAKKEASAAQKAQAAKADASAPVAKKAHKHHAKKHAAKKEASAAQKAQAAKADASAPVAKKAHKHHAKKHHVAKKAAASAAK

SEQ ID NO: 5399 - protein, 260 aa, Chromobacterium substugae
MSSPNLSAEKVLSVHHWNDTLFSFTCTRDAGLRFINGQFVMIGLEVNGKPLMRAYSIVSSNYEEHMEFYSIKVQDGPLTSRLQHLKVGDTVMISKKPTGTLVQDNLLPGKNLYLLSTGTGLAPFMSIIKDPEVYERYDKVILTHGVRWVSELGYHDYITQELPENEFFGDMVKEKLIYYPTVTREPFRNEGRLTDLITSGKLCADIGLPQLNPEHDRVLICGSPSMLHDLCEILNGMGFKESPRMGEPADYAIERAFVEK

SEQ ID NO: 5400 - protein, 345 aa, Chromobacterium substugae
MRIMIVTDAWKPQVNGVVRSLTETVRELDGFGHQVNMITPLEFRTVPCPTYPDIRLSLLPYRQVAQRLAGFAPDAVHIATEGPLGLAARRYCLRHGLAFTTAYHTRFPEYIQARCRLPLAISYAWMRRFHNASQAVMVPTRSIADDLEQRGFRNVRLWSRGVDTALFTPGERQRLDDTEPPRFVYIGRVAVEKNIEAFLKLDLPGCKWVVGDGPLLPRLKQQYPEVHFAGVFPQHELARFYRAADVFVFPSLTDTFGLVLLEAMACGTPVAAFPVAGPLDVVGDSGAGALDWDLRAACLQALEIDRGHVRQVAERYSWQAASRQFESHLKPNPPEAAPAPQAAAD

SEQ ID NO: 5401 - protein, 275 aa, Chromobacterium substugae
MQPDSASAVSRRLRSIWISDVHLGTAGCRADHLLDFLREHESDYLYLVGDIVDGWQLRKSWYWKQSHNDVVQKLLRKARKGCQVIYIPGNHDEAARQYCGLDFGGISIRHEAEHLTADGKRLLVLHGDEFDGVIQYAKWLAYVGDNLYTLILQLNRGFNWVRTHLGLPYWSLSQYLKHKVKNAVNFISQFEAILAGEARRRGFDGVVCGHIHKPEVRMIDGILYGNSGDWVESLSALVEHLDGRLEVLHWTALTIGSSIEESPEPIPSEESTCAS

SEQ ID NO: 5402 - protein, 113 aa, Chromobacterium substugae
MIECPAELAQAPQIMPLMQAVHQAAVASGLFETPDIKVRVLPSAHYLVGGQPDAFVHVTTHILAGRSEQQKKQLADAVARAACAQLPQVAMITSEVRDIQREAYSNRRQAMAG

SEQ ID NO: 5403 - protein, 137 aa, Chromobacterium substugae
MKTPYLKILACGLTLFILLGPLVALLASGVVPMMAYLMGAVPALIFGLMLCLLRIILAAPIARWQSLWPAWLLALAAFAPGAFSGSLITLLYARVAEPLLYNDWMTMYLGAMAGGVCNALFWRMRFGAGKPLPPHEN

SEQ ID NO: 5404 - protein, 375 aa, Chromobacterium substugae
MRPFAALLLAALLAACGREAPPPAPVGDWHWRLPPSVSPPPVPADNPMSQAKFELGRRLFYDKRLSGNGSISCASCHPQAKAFSDGVALSLGATGERTLRNAQPLANAAWRKSYTWANYSLTTLERQMDGPLFRTEPVEMGINDGNLPTVLARLGSDPRYASEFARVFPGEEKPLSLANIVKAIATFERGIVSFDSRYDRYQAGKAELSAAELRGLNLFRADKSQCLRCHGSPDFDDQMAGHGDGLPFHNIGLYNADGKGSYPFPNRGALELSGKPADMGRFRSPSLRNVALTAPYMHDGSVATLEDAVRIHADGGRDNGKLGDGRRNPWKDPAIGRIRLTPAEQADIVAFLKTLSDETLTRDPRLSDPFAAARR

SEQ ID NO: 5405 - protein, 357 aa, Chromobacterium substugae
MGHPPYGLHNNKWRTVMNKRWILVPGLCLGLSACLGGGVSSSDSPPQNQNQTPPPGYGGGNTTVRFALKSGSQPVSCNSQLSGMGVGQANATLAEGMVYVHDVALVNSRGQEVPLQLDQGNKWQYLNLALLDFAGGSCKDPARDDGDTPVGKPLPGSNSEVTGSVPADTYTGLSFKVGVPISAKNAKGEEVALNHQPAHSPPHPILGVYWLMWEWQSGHRFMRIDLAPSGGVKRADGSSADRWAFHLGSTDCQADSAIVGGYRCGKPNRFKVRFDRFDPQADRVVLDVQSLFAGNDISRDDSADFGCKSNATDAECQPIFDRLGLRLNESRPGAGDGGQPLGDGRNPRVFRLEKAAS

SEQ ID NO: 5406 - protein, 687 aa, Chromobacterium substugae
MPPLYHQAPAEPLRQYAAFLARMVCTSIAANLKQIHTFPMTLKTSLLPLPLALAVCHAFAADLPTFQGDRIVVTAVQTDQPLRVETDPRAPRQPVPAGDGADLLKTIPGFDVVRKGGSSGDPLLRGLGGSRLNILANGGFVYGGCPGRMDPPTAYLFPDAYDKLVVIKGPQSVKYGGALISGAVSFERKTKPFDEPGLRFGGSLLAGSAGRQDAYADLTAGGKLGYLRLIDSHNQAGDYRDGDGRKVHSAYRRDSQSVIAGFTPTRDTTLEISGDFSNGRAAYADRMMDGSQFDRRAWGFKAEQRNLAPWLDAVRLTANRSYADHVMDNYTLRPLAAGKPPRASNPDRKTDAAKLEADLAFAGIELTAGVDWQNDRHTSRVGGLDYASLPRVPDQHIERAGFYLEGDTPLGGGKLVAGWRHDRARAYYDAAAGRGEQLQDYRLFSGFARYEYRLGSWTPYAGVGVAERAPDYWERSYVAASRPVLQPERNTQLDIGALYKSERIQGSLSGYLSRIDDFLLVDDSAAQTTRNIQAYRYGVEADASWQFAPQWQLSGSAAYSWGANTTDGKPLAQTPPLSASVSLAWDNQTWAAAAVWRVAAGQDRYAIGQGNIASQDIGPTPGFATLSLNGGWRVNKALKLTAGVDNLFNRAYAEHISSGGADVAGYARTTRVNEPGRTLWLKLQAHW

SEQ ID NO: 5407 - protein, 418 aa, Chromobacterium substugae
MMRNPIFRPGQADDAGQAGLRVRRLRWLMLLLGLAVLAGCALQQVELPWLLAGQALATLAAVNLLLPRLPAWGLAAEHALRLGLLADVLVLTELLAFSGGAANPLASLYLPPVLLAALLSPGWFAWLLAWLSVAAYGLLFEWHLDWPLNGGNAAYAFNLHLSGMWLTFALSALLICGFVSRLARQLRKRDSALAEARETQLRDEQLLAVGMQAAGAAHSLSTPLNTLTLLVDELISERAQDEALSQDLRLMRAQLTSCSATLARLKHGSEPQSGPRPLFAALAERLEGWRSLRPDVRLEWQAPQGEDPEVWLDPAFWPALFNLINNAAEAGGGEVAVAARLRGGRLSLDIVNRQGCLSEAQLARAGLTPLDSAKPAGLGLGMMLSHATLARLGGTLSLDNRAEGGVHARIELPLKERA

SEQ ID NO: 5408 - protein, 174 aa, Chromobacterium substugae
MSDFLLIDDDEAFCMVLARSLARRGHAVQCARDADEALRLAAQGPARILLDLNLAGDSGLRLLPALRAASPGSAIVVLTGYASIATAVEATKLGAVQYLAKPAGAAEILAAFEQQAANPELSVAPQPMSLRRVTWEHLQRVLAENDGNISATARALNMHRRTLQRMLAKKPVKS

SEQ ID NO: 5409 - protein, 42 aa, Chromobacterium substugae
MQHLASPCCRYGIRKLRRIGAPAPIIFSDGRPLPDLYIRHGN

SEQ ID NO: 5410 - protein, 543 aa, Chromobacterium substugae
MLHGQMMDQPLLISDLLAHAERFHADTEIVSRTVEGPIHRYTYRDAARRARQLANALQALGVRGGDRVGTLAWNGYRHFEIYYAVSGSGAVCHTVNPRLFAEQIAWIINHAEDKALLFDLSFLPLVEQLAGQLRSVEHFVLLADHAHLPADSAIPNLQSYEDLVNSHSDVYSWPRFDENTASSLCYTSGTTGNPKGVLYSHRSTVLHAFGSSLPDSFDISARAVVMPVVPMFHANAWGLPYSCAMNGSKLVLPGPKLDGASLQQLIATEGVTTTIGVPTVWMQLLQHCQREKLPLSPLKRVIAGGSAVPESMVEQLAEHGVEMRQLWGMTELSPCGTTCTPKLKHAALAPAEARSLLTKQGRPIYGVDIRIVDDAGLPLPHDGVSFGNLQVRGPWVLSQYYKRELDANHSADGWFHTGDVVTIDADGFMRITDRTKDVIKSGGEWISSIDLENILVGHPAVAEAAAIAVPHPKWDERPLMVVTLKPGARASRDELLAFFDGKIAKWWTPNDVAFVDELPHTATGKLLKMKLREQFRDHAWPEK

SEQ ID NO: 5411 - protein, 646 aa, Chromobacterium substugae
MNPSGDGDARLGRAGRTKGNDMKSLRSRLIALNALLMALFGLVLVTIVFTQMRSEILEGLDNEFAASLKGQSSVVTTWLGEKKQQIVAQTAVAGEADALRFLKVGTKAGGFNVNYAGYADGRTLFSDDWVAPADYKVADRDWYKQAQAAGQPIVTDPYVDEATKKLTVTIAAPFNHNGAFAGVVGGDVMVDALVKSVLSLKVRGNGYAFIVDKKGTVIAHPQADLTLKPITSVVPALSADKLAQLVQNDKASDVDIGGKSMLISAQAIPGTSWVLALVADRDEILAPLHTLLYTIGGLTLLVFALMIPFASLVIGKMLAGLTRLKAAMEDIARGQGDLTLRLKDDGQDEIAATARAFNTFVAQLGHLFRGLKGDAAGVVGGVQDASQLVADVAQSSRHISDVSSSNAATLEQITVSISHIADSARQADELASATGHNLASSADNMQRLSSGMENTVQSVRGLEEMLSSLDKRSQEISGITNVIRDIADQTNLLALNAAIEAARAGEQGRGFAVVADEVRKLAERTAQATLEISNMVGAIREETGRAVGDVNSTVQAVDEGVGLTREAVDNIAAIRASMLEVVAKMSEISNSTQEQHKATTLIAQSSEAINGHVLENDDVLQNVSSTLQGLAGNAGKMDAEFNKFRL

SEQ ID NO: 5412 - protein, 608 aa, Chromobacterium substugae
MPPLSADTLRAARLLAEGELAAALQAAQQGLQAEPANAPLWNLLGVCAVRLDQPQLAEQCWRQALQHDAATPDAHYNLGCLQAERGHAAEADAHYRAELARDAGHASSLGNLGTLLLEQGRAAEAEACFRQALALRPQSALAHYNLGRLLRQLERREEAADYLRRGLALEPDDAEAQQLLGQLLVELGRADEAEALLRAALRRQPNHVAALNNLGLLLMERRRWAEAEDCLRRAHALQPDAVLGNLAALLSATSRPAEAEALLRAALLAAPGNVDWLCLLGVAQLEQGRGAEAERAWRSGLALSPRHRRLRQNLGYLQLARGEYQAGWRNHEARLQSGHYPQPGSPRWQGEALAGRHLLLVFEQGYGDAIQFFRYLPLLRQLGPARLTLMCREALLPLFAAQGLADACLPIRRVNPDFPPHDCHVFSMSLPGLLQAEPLSLPSYLRADPALAEDWGRRLPRGGRRIGLLWRGHAAHPFDHCRSLPGPERLEALCRRDAVWISVQPDPTPEEKEWAGRHGALELGSGLSDFAASAALLTQLDLLIAVDTAMAHLAGALGVPCRLLLSCEHTDWRWGEQGDATPWYPSLRLVRQRRGEDWAAAIARLDVG

SEQ ID NO: 5413 - protein, 460 aa, Chromobacterium substugae
MNDFLQQLAAIIGPQYILTAAADTAPFTLDWRRRYQGAPLAVALPGSTAEVAELVKLCRARKVAIVPQGGNTSTCGAATPDGSGRQLIVGMRRLRAIRALDGDNNTLTVDAGVTLQEAQQAAEAAGRLFPLALASQGSCQIGGNLSTNAGGVAVLRYGTMRELALGLEVVLPDGRVLDQLQGLRKDTTGLDLKQLFIGAEGQLGLITAATLKLFPLPSAHATAMVGVEDIETAIAWLNRLRHRFGDRLTAFEVMDANCQQVLQRHHPSLMPFSAPWLALIELSDGGDPAELNDALVAWLSAQHMLDGVVAQNETERRKLWTLREEISESQRKDGPSIKHDIAVPTSALPRLVRDCAADLERAFPGVRIVAFGHAGDGNLHYNVSYTRPGNAELFDDEPAVNAIVYDHVYRLDGTLAAEHGVGQLKKDWLVRYKDPLALELMRGIKRALDPDGLMNPGKWL

SEQ ID NO: 5414 - protein, 225 aa, Chromobacterium substugae
MDKMLTLADPSLLDIPVAGHAEPFVDLAAYPDWAVDRSRSQISSRSPHFLKARQAVAERLRDAAGRLPDGLRLYVKEAYRPLARQRRSYDEHLVRLRGLQPELDEAALLREASLYVAPPAVAPHPTGAALDVTLIDAAGAELDMGCPFNADAEESRGACYTDSPGLCAQARANRRILILAMRDAGFVNYPSEWWHWSYGDRYWAAVSGAPAALYAAVDESFLESA

SEQ ID NO: 5415 - protein, 158 aa, Chromobacterium substugae
MEKTEPSRYPDSQEDLARGAPLGRHFGFARLGIHHERLEPGQRTSWPHAESTEDEFIHVLEGEPDLWLDGALHRLQPGDSVGFKAGDGQAHTVINNTEQAVRLLVVGDATRADNQVHYPRHPARNAAIGKLHWAAAPARPDGGHDGLPDKLRDSDGPF

SEQ ID NO: 5416 - protein, 207 aa, Chromobacterium substugae
MSNLILYGNRYSGHSYKVRLALMLADISHDYVHVDISQPRAERLEDFRAASRFGEVPVLVADGVPLCQSNAILQWLADSYGALGGALGERQRVREWLNWETNRLGLSLPNLRYSRLIAHYEPAVEAWLETRLRADLAVLETELAERRYLAGDQISIADVSLCGYLWWLADTGLAIADWPHVQAWLARIAAQPGWQHPDELMSPDIPE

SEQ ID NO: 5417 - protein, 492 aa, Chromobacterium substugae
MSHAQLLFTALILLTLAITAAARRRTASLNDFYTAGGHLPAWQNGLALAGDYLSAAAFLGAAGMYLGQGYDSLAYAVGTLAGWPLLLLLLAEPLRRRGRYTVAGVLSQRFDHAGVRLVSIAGSLTVTLCYLVVQLVGAGKLIELLFGLPYLAAVGLVGALMMVYVALGGMLATTWVQISKASLLFICALLLAGGVLARFGGSPAALFDAAEKLRGAAAFLPSQALADPVEMLSLGLGLSLGLLGLPHVLMRFFTVADARAARRSVGIATWLVAAFFALNIVIGYGAMMLVGPDARFHGADGKLLGGGNMAALHLARLLGGETASALVAAVAFATILAVVSGLALAGASAVSHDLYAVWLKRGQAEPRRELRVSRLATLALGLFGIVLSTLFQQLNIAVMMGLAFAIAASANFPLLLLALRWQDLTARGVVWGGAAGIASSLALIVCGPAVWVAALGHAKPLFPYANPALFSVPLAFAAAWLGSRNGAASTNT

SEQ ID NO: 5418 - protein, 69 aa, Chromobacterium substugae
MKPAPCQRLLVLLTIAACLGYYLILAARPGWLACRLAGLPVSILLALALLLLFCLIAALHGGSRDEDAS

SEQ ID NO: 5419 - protein, 149 aa, Chromobacterium substugae
MRLRQARRADLDAIFAIEQAVFGSHVYPDFFFRQALDLWPDWFWLAEDERGAPIGYALGAPSQEPDQLWLLSLALLPACRGNGTGKALMQAALAAMRPRARSIRLTVDPANPAAALYQRLGFAAVGHEPDYFGPGEARWLMQWQAAASA

SEQ ID NO: 5420 - protein, 261 aa, Chromobacterium substugae
MNVSGFGGKCRVGRKWPAYAALALGMAGHAAAALAADEPATPLSAELKDRYEQMQDDVPNRVPMLSLTPAASGRAGQMEALVRQCMNEQLQKRNDYSLELQRAGAAVLLDMKRIREDNAVEESRTIVENLRAAAQRHRYDMDAVPGCLEDNLGKLKLSKAAKKDFMRGVSAGMAKSRYQAERIWTLEFALIDQMAAATQYLTANKNYWSIDDSGRMAYASPQVKAQAESMLAVLGKLRDQQRELGRQGVANGLANMRKAGM

SEQ ID NO: 5421 - protein, 656 aa, Chromobacterium substugae
MSELSRREFLKLSAAGVAAGAIPPGLAAAMAIRPAGRSLSAVKHVVVFMQENRSFDHYFGMLRGVRGFGDRSALQLRNGSSVFRQPHLLSSEFPFHLDSSRTNAQYLTDLDHSWTGTHAAWNQGKYDGWVAAKTGLTMGYFNRADIPYHYALADAFTICDGYFCSQQGPTNPNRLYLWSGTVDAAGKNGGPVTDNSEKGYSWTTYPERLQAAGVSWKVYQVVGDNFDDNALAWFTQYRNAKPGNPLHDRGMSSVPKVSGNSVKDLVAAIRSDAVNGTLPQVSWIVAPQDYSEHPSAPPAAGAYLVDQVLQALTANPDVWASTVMLLNYDENDGLFDHVPPPVPPSGTAGEFVSGAPIGLGPRVPLLVLSPWSRGGYVCSQVFDHTSVLRFLETWSGVQEPNISAWRRQVCGDLTAALDFGSSNTSLPAFPDTAALLTQAQQSKGWPAPTAPVPGQMPQPEAGRRPARALPYQCNAYASTDVAGGMVWIHMQNSGSQGAHYAIYANQYRLDGPWQYDVAAGGNIQDYFHVQTYGGGWYDLTLYGPNGFLRRFAGNIHSAAGVLEAVSGVSVVQGVPQLTLQLNNGGKVAATFQVSANGYGGGAPQQVSVNGGGSQLLSWNLSGVYGWYDFTVTCSNDTSFIRRLVGHVENGAASVSG

SEQ ID NO: 5422 - protein, 70 aa, Chromobacterium substugae
MSNRQSGTVKWFNDEKGFGFITPQGGGDDLFVHFKAIESDGFKSLKEGQTVSFVVEKGQKGLQAVQVRVE

SEQ ID NO: 5423 - protein, 1146 aa, Chromobacterium substugae
MNAPRFVHLRLHSEFSITDGVVRLDDAVKRAVKDGMPALGMSDLMNLFGMVKFYKSCRNKGIKPIVSADIWLENEEDRDKPYRLLLTAKNREGYRRLCELLTEAFSHNQYRGRAEIKRAWLESGDNSNLLCLSGAHLGDVGMALAMAQREEAQRRAAYWEKLFPGSFYLEVQRVDSAQVENVVQATLWLAGEMGLPVVATHPIQFMDPDDFKAHEARVCIAEGYTLGDKRRPRAFSECQYFLSADEMLARFADIPEALANTVEIAKRCNISVVLGKNYLPLFPTPDGMSLDDFLVHEAKRGLEARLAQLYPDEAVRRERRPEYDERLKFECDTIIQMGFPGYFLIVADFIQWGKANGCPVGPGRGSGAGSLVAYSLSITDLDPLKYALLFERFLNPERVSMPDFDVDFCQENRWRVIEYTRQKYGEEAVSQIATFGTMSSKSVIRDVGRVLDLPFGLCDRLSKLIPLEANKPLSLTKAMEMEAQIGEIIENEGAGELIELAMKLEDLTRGIGMHAGGVLIAPGRLTDFCPLYIASGEGASPVSQFDKDDVEQIGLVKFDFLGLRNLTIIELAQKYIKQVSGEDVDVAHLPLDDRDAYKVFASANTTGVFQFESSGMKKMLVEAKPSKFEEIIAFVALYRPGPMDLIPDFIQRMHGAKFEYLHPLLEPVLAPTYGIMVYQEQVMQSAQVIGGYSLGGADLLRRAMGKKKVEEMVAQRAMFVEGAGKQDIPEAKANEIFDYMEKFAGYGFNKSHAAAYALVAYHTAWLKAHHCAAYMAATMSTELDNTDQLKIFYDDATDHKNGLVFLPPDVNHSHYRFVPVSRKEIRYALGAVKGSGESAVDHIVAMREAGGPFANLFDFCKRTDKKLVNKRVIEALIRAGAFDSIEPNRALLFANVGLAMEAAEQEHANANQGGLFDMFGDDVAPAVEMVATRPWSDAVKLAEEKLAIGFYLSGHPFSAYEKEVRAFIKTPLSRLIPNKSPQLLAGFVTGIRVKVGNRGKMAFVELDDGSTKLEVSLFAESFETNRDKLKEDVVLVVEGKVSEDSFAGAGRLRIIVDKLYSLGEARSRYARSLALQLSGQVDVARLKSELHPFKSQDAGCPVRLHYNNGEAKGDLMLPPEWGVRLDDGLLLALSDWLGENRVKVMW

SEQ ID NO: 5424 - protein, 47 aa, Chromobacterium substugae
MEAKMDKAGCVHPGILPAGAVANQLNRRRRAAGVRHAMHIRMMASWY

SEQ ID NO: 5425 - protein, 200 aa, Chromobacterium substugae
MEFNVQQLERTNLYQLLVGCVLPRPIAWVSTQDLKGVCNLAPFSFFNVMSINPPLLGISILKQASERDKDTLANIRLTGELVVNIVSQALAEAMNVSCGGYPADVDEFELASVAKVDSVTVKPPGVAEAPVRLECTLHQCLTFGHGTGAGNLVLAEVRHIHVADRVWNEGAIDDVALQAVGKLGGDRYSLGQPAFSLTRP

SEQ ID NO: 5426 - protein, 300 aa, Chromobacterium substugae
MTVINSVDLFWSLASGEFSQRDGFDEGKNRFKFVLRGMLTLPWTLRWLETFRSQALLTYLRRNPRLACKLHRPYLYRSLNARGKLQALQAHYQLLEQRFCEPARGLLLSNQPVALAALTGKNDGALHVLLTQQHTFDKEGEMSLQVCNAERVALATLTFTLTRRGEDLVVMVGGLQGPTKPHGAESVQLATKLAHGLFPKRLAMEALTALARKIGADEILAVGKAEHIYSSWRYRRNFFADYDSFWETLDAEPMEGGRFFRIPLTLARKAMADIASKKRAEYQRRYALLDALSAQTQAVL

SEQ ID NO: 5427 - protein, 81 aa, Chromobacterium substugae
MSQDNDPFALFRQFWQQATPPGMQAFLPPMSEEEIDRKLAELKVVEGWMTMNLGVLSMQIKTLEMQKSALHSMRPKEPPAG

SEQ ID NO: 5428 - protein, 756 aa, Chromobacterium substugae
MDEQLRQSALEFHQFPTPGKIQVAPTKPLTTQRDLALAYSPGVAAPCDAIVEDPLNAYKYTARGNLVAVISNGTAVLGLGNIGALASKPVMEGKGVLFKKFAGIDVFDIEVNELDPDKLVDIICSLEPTFGGINLEDIKAPECFYIEKKCRERMGIPVFHDDQHGTAIVAAAAVLNGLRLVKKEIGEVRVVASGAGAAAIACLDLLVALGVKRENITICDSKGVVFVGRDEKLDESKLRYAIKDNGWRKLADAMVGSDIFMGLSGPRLVSQDMVKSMARDPLILAMANPEPEILPPLVKEVRPDAIIGTGRSDFPNQVNNVLCFPFIFRGALDVGATTINEEMKLATVRAIADLAMAEQNDVVATAYGDQELSFGPEYVIPKPFDPRLIVKIAPAVAKAAMESGVATRPIQDFDAYADQLAQFVYKTNLFMKPVFSQAKKDPKRVVLTEGEDERVLHATQEIVTQGLAKPILVGRPSVIEKRIEKLGLKMRPGVDFELVNNESDPRFTEYWKDYYQLTKRKGVSQEQARRRVIGNTTLIGAMMVRRGDADALICGTYGPYRQHFDILENVLGYANEDKVAGAMNALILPTGNIFITDTYVNAEPSAEQLASITKMASESIKRFGIQPKAALLSNSSFGALNTPSAQKMRAAFDLIREAQPELEIDGEMQGDAALVESIRQQALPDSTLKGSANLLIMPNVEAANISYNLLRVSASDGVTIGPILMGMAKPVHILTPIASVRRIVNMVALASVDAQC

SEQ ID NO: 5429 - protein, 442 aa, Chromobacterium substugae
MSALIIFGLLMALMLTGMPISISLGLTVLTFLFTMTEVPITSVALKLFTGIEKFEIMAIPFFILAGNFLMHGGVARRMIRFATTLVGHWYGGLGLAGVVSCALFAAITGSSVATVVAVGSIILPAMLKQGYPARFGAGVITTSGALGILFPPSINLVMFSIATAGMDVTGPNGMSVSTASVGQLFMAGVLPGLCLSALLGLTTWYRAKKFDYPRLPRASWKERWEAFRDCVWGLLLMVLVIGGIYTGIFTPTEAAAMAAVYAFVIAVFVYKDMGLKDVPKVLVNAASMSSMLLYIITNAVLFSFLMASEQIPQSMAAWMASQGFGVVAFLLLTNILLLAAGNFMDPSAIVLIMAPILYPVAVKLGVNPVHFGILIAVNMEVGMCHPPVGLNLYVASGITKMGITELTVAVWPWLLTMLGFLLAVTFIPEISLWLPRALGMMN

SEQ ID NO: 5430 - protein, 195 aa, Chromobacterium substugae
MLKFLDHLEEWMIACLMGAATLITFVAVLHRYGSGIPTLQPYLAHINLSWAQELTVYLFVWMAKFGAAYGVRTGIHVGVDVLINRLPDKTRGRFIVFGLLAGALFTGTVAVMGGNFVWEIGHTDQTSPDLEAPMWLVYLAIPAGSSLMCFRFLQVAWNFVKTGALPKHDHGHVDGIEGDPALDNLHPHDKQGGRP

SEQ ID NO: 5431 - protein, 334 aa, Chromobacterium substugae
MKRKYTALAICASLTLSGFAQAAGEIVIKFSHVVSPDTPKGKAAEYFKKLAEQRTHGRVKVQVYPNSQLYKDKEELEALQLGAVQMLAPSLAKFGPLGVKEFEVFDLPYLFDSYDEVNKVMHGPIGKQLLGKLESKGIKGLAYWDNGFKNFSANKPIKSPADLKGMKIRIQSSKVLEEEMRTLGALPQVMAFSEVYQALQTGVVDGTELEASNLYTSKAYEVQKNLTLTQHGFLGYALIVNKKFWDGLPADVRGQLDSAVQDATVYANQIAKQENEKAVAAIKASGKTKVYVPTPQEREAFKKALAPVHQKMAARIGPDLLKQIYKETGFNPNK

SEQ ID NO: 5432 - protein, 764 aa, Chromobacterium substugae
MSAPDSRIRRAPRLLWLSVSLALIALLLALCSLSYLVYRDWRDEQQDNLIQEVLWLEQSLRMHLEGHQEWADGLARDIAAGKVDSQRFAHLAAFYMRENPELLTIERVGASNQVQWDQHGIRRDRRSLGPAEFDGLWRASRLLRSSYGAPYQGADGKYRFDLAVPVVRDGQLLGGLRFSYQLDGLLYHQVPWWIASKNYISILDLGGKTLAQKFDAAERPGNISHQTSFDPPGYGLYLRAVAYRSGLGLTLPVLTCVIVLLLLTLWYAVWRIRRHMRERATAEQKLAQEVSLRQAIEDSMKSGLVAIGLEGEIVRVNRAFCDMLGFAPEELVGSYPPHPFWPADQHGVLADAMDAVRDNRQPEQGFELALMRKRGDTLVVRLFATPLVREDGSQHGWIASMFDITERQRQRKEMDAAHRRFLTVLNGLAAGVCVVAESSGQLLYANPGFAELWLVGDADAPCCVLLPGLRAGPENEEYGQEFIVAGECCLLIRRRRIEWVNGEAAWLAILSDVSEDRRREAREQAQQDRFQNTARLIAMGEMASTLAHELNQPLTAIHTYAAGVSRRLPEQLELPAGVRDAIHAIAEQSRRAAQIVSSIRAFVKKHEPQLERVDPARAVARALSLAEPLAAKHGVSLQLEPDRRACLLDMDPVLIEQVLLNLMKNAVEALVEADTPQPSVQLHTCVGEGKWRVEVVDNGPGLAAGMQDNLFTPFYSTKPEGMGIGLNICRSIVEFHRGEFGAVSSPAGGCVFWFTLPLAGRVVE

SEQ ID NO: 5433 - skipped

SEQ ID NO: 5434 - protein, 538 aa, Chromobacterium substugae
MAAKEVRFHDNARERIVNGVNVLANAVKVTLGPKGRNVLLARSFGAPHITKDGVSVAKEIELKDPFENMGAQMVKEVASKTADVAGDGTTTATVLAQAIVQEGMKYVASGMNPMDLKRGIDKAVHAVVKELQTLSKPVTNSKETAQVAALSANSDEAIGKIIADAMDKVGKEGVITVEDGKSLDNELAVVEGMQFDRGYLSPYFITDPEKQTAVLEDPLVLLYDKKISNIRDLLPVLEQVAKAGKPLLIVAEDVEGEALATLVVNSMRGILKVAAVKAPGFGDRRKAMLEDIAILTGGTVISEETGLTLEKAGLAELGSAKRVEIGKENTTVIDGAGDKAKIDARVQTIRAQIDAATSDYDREKLQERVAKLSGGVAVIRIGAATEVEMKEKKDRVDDALHATRAAVEEGIVAGGGVALLRARAHIGELKGDNADQDAGIQIVLRALEAPLRAIAANAGDEPSVIVNKVLEGKGSHGYNAASGQFGDLVEMGVIDPTKVTRTALQNAASIASLILTTDATVAEAAQDSKAKAPAELDY

SEQ ID NO: 5435 - protein, 105 aa, Chromobacterium substugae
MQIRPLHDRIIVKRVEKVRQTASGIVIPDSAAEKPEQGEVLAAGPGKRLPDGTLLPMQVQVGDLVLFGKYGGQTVKLDDQEYLVLREEDVFGVIEGASESGRKAA

SEQ ID NO: 5436 - protein, 208 aa, Chromobacterium substugae
MELFDTLSAQIRHMRLPLFAVSLSAVPCPDTPLLLMLHWHGFGKAAADRAPAGQASLRQVPASALQLTRRWSALSRVEEEILDAAWQLGAWSLLRDERRGCNTMGAAAGEELACRQAFGDLPAIDGQESVVAEAPDGPELMRLAARRGYVCWQFRPVHGGLWRELAEDDTLGEDGLRQPPCPLAPRVCRGGKAARTEYRFGRIERVIF

SEQ ID NO: 5437 - protein, 75 aa, Chromobacterium substugae
MAATRRLNPEKLLLSKWTAAAPRDKEKHFLVVALGRPAPDAAVETVTLEAVYTRRRQTMAWQALRDADQWLQGWK

SEQ ID NO: 5438 - protein, 178 aa, Chromobacterium substugae
MLKKPLALIALILLPLTGCDTAPPPGIAPARGFQLERYQGRWYEIARLDHRFERGLQAVSADYSRNADGSIRVVNRGFDEATASWREAVGKAWFNGPADVASLKVSFFGPFYGGYHVAALDPGYRWAVVVGPDKDYLWLLSRDKQAAPAAKPALLAVAAKLGVPADKLIWVRQDRGGN

SEQ ID NO: 5439 - protein, 508 aa, Chromobacterium substugae
MTTLRLLLGDQLNPCHSWFAEPDANVVHVMMEIRQETDYVRHHAQKILAIFAAMRDFAAQLKAQGHRVRYVAINDASNRQSLTGNLDALIAHYRAAAVEYQAPDEWRLDRQLAEWAAGLPMPCRMADSEHFYTARGEVAALFGGRQWRQETLYRHLRRQHGILMDENAEPAGGRWNFDADNRQRWPGDPPEPGDARPEHDHSRLWQTIVGAGVASFGQPQADALRWPLNRAEALAQLRAFVEHGLPHFGAYQDAMSPRARRLFHSLLSFALNVKMLNPREVVDAAVSAWQEGRAPLAAVEGFTRQILGWREYVRGVYWAKMPGYRDSNALAHQLPLPRWFWDGDTGMRCLAHAIGQSLEDAYAHHIQRLMVIGNFGLIAGLSPQALHQWYLGVYIDAFEWVELPNTLGMSQFADGGLLGSKPYAGSAAYIGRMGDYCAGCRYRPKQRVGADACPFNALYWDFFQRHRAELAGNPRLALVYRQLDKLPETERAAITARAGWLQTNLDSL

SEQ ID NO: 5440 - protein, 54 aa, Chromobacterium substugae
MMAARTFKGNKAALPSKPCAGCGRAMSWRKKWRASWDAVQYCSERCRRQKGKAA

SEQ ID NO: 5441 - protein, 144 aa, Chromobacterium substugae
MKRIPSQADWQALLDWYQTLTPDTLPDIGHFYAEDARFKDPFNDARGITDIQAVFRHMFKTLEQPRFTVIHALRDGDQAFITWDFDFVYAGRKVNIHGGSHLQFDAGGKIALHRDYWDAAEELFEKIPVLGLPVAWLRKKLKVV

SEQ ID NO: 5442 - protein, 437 aa, Chromobacterium substugae
MRDAARRSRLLAGLADGLRRTVGGRLRRQPSRAGPRPVFPRQNRGLGHVPGTGPTAEAFYRGHGRRAPGRRVGVDRALPLQRRQPPAARVAAQAAGRRTLARPGRRCGGRGRGRDCRQRAALALHAEAAGGRQGIPGAVRRLDVPAGRAQPAQPRRDEQVRFPPGRSHAVFPQAGAAAVSLRLNPAIADWHARRVWVIGASSGIGAALATELLDAGAEVILSARRAEPMQALAAGRAGARVETLDVTDPAAWSRVWERLERNGARPDLVVFCAADYRPQTCLDLHADETRRLLDTNLLGVYHGLEVVLPALAREGRGGVALIASVAGYAGLPGAAVYGPGKAALINLAEILYTELKPRGVAVYLINPGFVATPLTAKNDFSMPALLTPRQAAQSIMRGLSRGAFEIHFPLRFTAWLKLLRLLPYRLRLPLLARLARP

SEQ ID NO: 5443 - protein, 401 aa, Chromobacterium substugae
MSASQPIALSRPDIPAAGRALLALLSKLRHGSLKIVTPDGEELWYGALKPQADAELTLADWRACRRMLSGNDIGFAEAYRDGWLDSPDLTALLRLALRNEDAMQLGELGRWAARAWHRLRHLLRVNSRRGSRRNIHAHYDIGNDFYQLWLDPGWTYSSAWFDGDYRLSLADAQARKYQRICDQLQLRPGMRVLEIGCGWGGFAEHAARLGVAVHGITISDAQLDFARRRLANEPLAILEHRDYRDLSGQYDAIVSIEMFEAVGERYWRGYFDTLRRCLKPGGQALAQSITIEESRFETYRANADFIQTFIFPGGMLPSRERFLRAARQGGLACRGRLDFGPDYAETLRRWRDAFEANLAAIRSQGFDEAFIRLWRLYLCYCEAGFDEGRIGVSQFLLQRHA

SEQ ID NO: 5444 - protein, 258 aa, Chromobacterium substugae
MSGAYLLTGQVMHRRLRPAPNRFVYPVFCLRLNLAKLESLRGFWFGVDRWRPLSLRTRDYGPRDGSPLLPWIRARLEEAGLPANGEVWLQTFPRVFGYVFNPVSFWHCHNASGQLIAVLAEVNNTFGERHGYLLSQTGGGPISAASQLSCRKLLHVSPFCRIEGHYRFRFHQSGDHALVRIDYHNDAGPLLHTAISGRLSPLTPGTAARALLRQPLLTLGVIARIHWQALRLWLKRVPFFRKPHPPAAALSRGQELKP

SEQ ID NO: 5445 - protein, 428 aa, Chromobacterium substugae
MVNASSPQRIAVIGGGIAGLATAYFLSRRHAVTLFEAADYLGGHTHTVDVTVDGRDFAVDTGFLVFNDRTYPNLIALFQELGIPSHPSDMSFSVSLGQGRLEWAGRDLDSVFVQRRNLLSPGFWGMLSDILRFNREAERNLRRAIEAPQSLGRLLDADGYGARFRHHYLLPMAAAIWSSPCRDILSFPAETFLRFCLNHGLLQLRDRPQWRTVPGGARQYVEKIAASLADVRLSTPVLRVSRVDGRVRLLAASSEETFDSVVFATHAPQTLAMLADADDLERKMLSAVRYQANEAVLHTDASLLPRREAAWSAWNFLSDDDDDSRAVGVSYLLNQLQPLPVATPVAVTLNPPRAPDPAKVLGRYHYQHPLFDAAAIAAQKALSGLQGRHGCWFAGAWTGYGFHEDGLNSALRVARDFGLAPAWARLEK

SEQ ID NO: 5446 - protein, 214 aa, Chromobacterium substugae
MLPMGILGRLSFKDQAFKLREQAVLDATTRMLASKGFDLMTMDDVAGEAGISKPSLYKHFKSKDELATEVMIRLLDDAQDFLARQAPELSPLARLRDLLAWALGMRLAGGLPFLPSTSPQVRAMLTRSLRYVSRAIKLHKMLQGIVEQAKRQGELRADMPTDVILYSYYSRTCDPAVEYLRVYGKYQDEDIVRHMLRVCFDGMADDHRRDDGES

SEQ ID NO: 5447 - protein, 37 aa, Chromobacterium substugae
MPQSNKNGTAQMVTRPCAPQRGRKLTFDAGDSEMAGM

SEQ ID NO: 5448 - protein, 555 aa, Chromobacterium substugae
MIILKNVALRRGTKVLLDNASVTLNPGEKVGLVGRNGAGKSSLFAVLNGSLHEDGGDVSIPSQWRMSQVAQDMPETAQMATEFVVEGDTTLLAAQQEVAEAEAGEDYMRMAHAYTALNDAGAHDAPARAQALILGLGFSVAELQQPVNSFSGGWRMRLQLARALMCPSDLLLLDEPTNHLDLDALVWLEAWLKQYAGTMVVISHDREFLDAVTNVTLHVDNAKLVRYGGNYSKFEDMRAEQLVLQQAAQAKQQEKMAHLQKFIDRFKAKASKAKQAQSRVKALERMEKIAPVLADAEFQFEFKEPQSLPNSMLSMTGAAFGYPAPEGAPEGTPPTVIVRNVNRTVLAGQRIGILGANGQGKSTLVKTVAEALQAVGGEIIRGKGLNIGYFSQQELDVLRPEDDPLQHMFRLARDTPAAMRPPANDCREQGLRNFLGTFNFSGDMVKQPVGSMSGGEKARLVLCMIVWQRPNLLLLDEPTNHLDLATREALSVALNEFEGSVMLVSHDRALLRAVCDEFWMVSRGGVSDFSGDLDDYQVYLLEEAKRRREEAAGKR

SEQ ID NO: 5449 - protein, 568 aa, Chromobacterium substugae
MIEVTELSIAELRAALESGRTTAVELVKAYLARIAAYDGPATETRLNAVVVRNPDAIQEAEASDARRARGETLSPLDGIPYTAKDSYLVKGLTAASGSPAFKDLVAQHDAFTIARLRAAGAICLGKTNMPPMANGGMQRGCYGRAESPYNADYLTAPFASGSSNGAGTATAASFAAFGMAEETWSSGRGPASNNGLCAYTPSRGVISVRGNWPLTPTMDVVVPYARTMADLLEVLDVIVADDPISRGDLWRLQPWVKIPKASEVRPDSYSGLLAQPDMLKGKRFGIPRMYINKDELAGTSEKPGIGGPTGQRIHTRASVIDLWEAARQALEAAGAEVIEVDFPLVSNCEGDRPGAPTVFNRGIVSPEFLNDELWELSGWAFDEFLRANGDPKLNKLADVDGPKIFPHDPGTLPNREGDLAAGMDEYVNMAKRGLKPYDQIASVPDGLRGLEKTRKLDLEDWMDALKLDAVLFPTVADVGPADADVNPRSADIAWSNGIWVANGNLAIRHLGVPTVTVPMGVMADIGMPVGLTFAGRAYDDNALLRFAGAFEATGNKRMIPPRTPPLAQ

SEQ ID NO: 5450 - protein, 324 aa, Chromobacterium substugae
MNNTNTFINTVNGVKLHQLDLNLLLALDALISLRSVTRAAEKLFVSQPAMSHSLNRLRTFFDDPLLVRSPHGMLPTQKALYLQQGVHQALSLLQSHFSQPEAFDPATSARRFTLCTTDYVECVLIPPLVKKLAEVAPNVHIDITILREDIPELALADGEIDFLLGFDEYMSIPSYLCRETWLNEPLIGILRHGHPLQSDRLTLSDLIALPHVFHAPLGNRGSPMDDFLAARGLQRKISVHSQSYMAAAAIVSNTDHLFILPKKVAAMMAGYWPLKMVALPEELPGYHLNCIWHPVQDSHPALHWLRDLMRKLIESDDAAPVFAV

SEQ ID NO: 5451 - protein, 46 aa, Chromobacterium substugae
MNRAFADDRLGASPDLRDAAARPMHIRRAEPPAGTADFLCDERRSD

SEQ ID NO: 5452 - protein, 378 aa, Chromobacterium substugae
MAFIKPMVINMNNKTHNSLPAADGFHMPAEWAEHQAVWMIWPQRPDNWRHAGREAQQVFAAIAKAISAATPVFMAVPEPFMSQARAVMPAEVTLVEMNSDDCWMRDSGPTMVIDQAGHLRGVDWKFNAWGGFNGGLYHPWDQDSEVASQVLVHHGFDRYAAPLVLEGGSIHVDGEGTLLTTAECLLNPNRNPDLSQAQIEALLSEYLDVTHFIWLPEGVFMDETDGHIDNMCCFARPGEVVLHWVDDEQDPQYPRSQAAYEVLSQARDAKGRQLKIHKMLAPGPLFYEQDETAGVVASGQAVPREVGERMAASYVNFLISNGQIIFPLLDERTDAAAASRLQEIFPEYRIVGVPAREVLLGGGNIHCITQQIPAGKAG

SEQ ID NO: 5453 - protein, 320 aa, Chromobacterium substugae
MTATQRIDVHQHVVPPFWADALPAHGGDPSGWKSPEWSPQSAIAFMDSQGIATGMLSLTAPGVQGWSGQAKLDMARRVNEYTAGLVARHPDRFGNFATVPLPDIEGSLREIEYAFDTLQADGVVLLSNYGGQYLGDPAFEPVWAELNRRRATVFIHPGKPAIDAIAGMPGPLVDYPFDTTRTAVQMVLNGTLARHPDVNVILSHAGGFLPYASHRFAELAQGVRDDVPATAELLRLFQRFHFDTALSSGPAALPSLTAFAGVGRILYGSDYPYAPAEVGASFTAKLDACAELSAAEHAAINHRNALELFPRLAKVRGLAA

SEQ ID NO: 5454 - protein, 292 aa, Chromobacterium substugae
MELRHLRYFLAVADEGHFGRAAEKLHIVQPALSAQIRALEDELGVTLFDRSTRKVELSDAGRILLIEARRTVEQAERAKNVMRRAARGETGVVRIGFVGNAVAAGRLPDDLLAFHAAWPDVAVDLHEMAPAAQLEALLAGRLDVGYCPQLGHPLPAGLQARPAGSWHWEVAMGGQHPLAARRTLRVDDLREQSFIVYAADGDDEGQLPMLRQLLGAEPRIAYKVGSTMSVLALAAAGLGLALVPAPVRKMAAPNLVYRRLAERSPLVSELSAISRAGEEWGAARRYLDMLKG

SEQ ID NO: 5455 - protein, 426 aa, Chromobacterium substugae
MACAAWLWSAAASALPSYARQTGEACIACHVSFPELTPYGRLFKLSGYTLGAAKLFPLAAMAQASISHVGNTQGNDGAYPRQNDGVIEGGSLFVAGKIGDHVGMFSQWTFNALNQNPGAQDFSGHTVADNNDWRLSDHIANSDLDLIYGLSLNNNPTVQDAWNTMPAFGYPYQSSHLTGAWGIAPPATLIEGGLAQQTAGLSAYAFLNKAWYFELGGYRVAKGGASLFKSGVALSNRLDGTNPYGRFAYSHDWREHSIEAGVFGLDARVHTDPSDPGSPTNHYRDTGLDAQYQYLSEPHVFTAQAAYIHERTVWDASQVGSAVQNPGSQLNAFRIKGSYWYQRRYGLTLAYFSETGSADNIVYPITGSPNTNGCIAELNYMIQPNWRVGLQYTGFLKYQGASANYDGNGRNARNNNVTYLYTWIAF

SEQ ID NO: 5456 - protein, 200 aa, Chromobacterium substugae
MKTLWMIGWCGALLSAGVALADKDPESLARGWCANCHGADGNSVSPLFPRLAGQQAMYLQQQLQLFREQSRSDQAAHDYMWGVAGGLKGAEIAGVAGYFAAQTPKPNPAPPAAAAELAAGKEIFLRGKGDSVPACFACHGARGEGSEQAPRLAGQHAAYLIKQLRVFSTRQRPAAAAMQAIVHDLSEDDLHNLAIYLQSL

SEQ ID NO: 5457 - protein, 412 aa, Chromobacterium substugae
MNPFASLTLPNGSLLPNRLAKAAMEENMADRDHAPSEALIRLYRAWAEGGTGLILTGNVMVDRRAMTGPGGVVLESERFGVRFEQWSAAARARGAQIWMQINHPGRQMPAALGQPTLAPSAVAMELGNFSKQFAAPRAMSEADIADVKARFVNTARLAERFGFNGVQIHAAHGYLISQFLSPITNQRADRWGGSLENRARLLTDIVREVRAAVRPGFAVSVKLNSADFQRGGFSADDAKQVTAMLNPLGVDLIELSGGSYEAPAMHGQTRDGRTLAREAYFLEFAQDIAAVARMPVMVTGGIRRYPVVEQVLGSGVAVAGMATALAINPNLPNAWRSDATAAPRLRAIPWKNKVLASVGYMAMVKYQLRRLSQGKRARPDVAPVLALLQQQWDAKIRTGRYRRWIQRQSAAA

SEQ ID NO: 5458 - protein, 48 aa, Chromobacterium substugae
MASAILPWRRRGAMSCHPEAPPMSTVQQAVPAAVAVSQSLAWAGRGRA

SEQ ID NO: 5459 - protein, 137 aa, Chromobacterium substugae
MKIGELAKRSGMAASAIRFYESKGLLKMASRQVNGYRDYPPEALAVLSIIRDAQQAGFTLDEIRQLLPGDFQSWRHEELLSALRRKVADIEALQARLAQSKAHLQALIQMIAAKPDDMDCKENAARVLANLGVAGDS

SEQ ID NO: 5460 - protein, 772 aa, Chromobacterium substugae
MSKPLIAGCTALSILSCLPASARADAGYQALVQRTSFGIPHITASNEGNLGYGAGYAYAQDNFCQLAEEMATARGQRSRYFGTAGSYASPDGGQIPNAASDFYYAFLNSDANIRASFARQPEAVRSLLDGYVAGVNRYLRETGVGGLPAACRNQPWARPLERLDMIRMMRRYAVTSSGAQYIGALQAAVPPTAGAARKQRLPVGQEPLRGLYGKRRPVGSNAIALGREATHSGAGMLYANPHFPWNGAYRFYEQHLTIPGKVDAMGVSLGGLPVVNIGFNRAVAWTHTVNTSLHSTLFALRLAPGDPTRYIVDGVAKPLRPVTVSIVGRDANGAPERLQHTFYLSEWGPVVAFPGQLDWDAASAYALADANQDNDRMLDAWWRMNRAGSLAELRSAVESTLGLPWVHTLAADRAGNVYFGDVTVVPNVGAAKQQACMPAATRPLLAQGVMVLDGARAACRWDNAAGTPQPGIFAARDLPTLARRDFVQNSNDSAWLTNPARPLTGYPDIVSAAGGVQGARTRYGLQQILGRLGEQRFTLDALQEMGLSNRSYYASLLLDDLKRLCRTSGSGQVPADACRILARWDGKAELDSVGWPLFQAWRGRLNGSGVAYWGQPFDPARPLQTPRGLRIGDAAVASAARAALFDAVKDLQAAGIAYSRPWGEIQRAARGGKRIPIHGGGGEDVYNVIESGPGGNGELNPESGTSFLMAVSFESGLPQAEAFLTYSQSSDPDSPHSGDQTERFSRKQWIRLPYTQTDIRRDPAYAWRWLRE

SEQ ID NO: 5461 - protein, 369 aa, Chromobacterium substugae
MKNASARQLSTILKTCLPLLAALALANQAAAQGSHAGAPARQAAHLQACGAAWDAAAPYPAGSLASRGGVNYTAAYWTQGNAPSADSAGAGQPWIAGASCRPAAKTAAKAADHDANFSPATLQFLKANTGLDGEQWDNIMKLINKPEQDSLDWTKFYGYCEDIGDKRGFTIGIFGATTGGPNDGGPDAPALFKAFDAASGAANPSIIGGLNRAGAHGAMQGAILKISDDKKTFCNKIGALQNNAAWREAMWRTFYAVYIQFSVQQARQRGFNSALTIGSFVDTALNQGASGDSGTLAGVLSRSGNSADEKTFLTRFYAERSKIVDSNDYNQPPNGKNRVKQWSTLLGMGETDLKNADAAVLKVTGWQMK

SEQ ID NO: 5462 - protein, 288 aa, Chromobacterium substugae
MAERMRAPALHPAMSPRQAGRVVTAACLRHFQANLAGAKAGVDHECLHQARVALRRLRCARKIFSARDADGDAAAADLKWLAGQLGQARDLDVLLVEALPAAEAAAGGGAGLGKLRQALAQRSERCRREAQAALESACCERLLSSCRHPQLEDADAKLRRFARRILRRRRRGLRRLAERWRTLDPEQLHQLRKQAKALRYAAEFFAPLFDAGAAARYLFRLQRVQDLLGAIHDAAAGRALLAQCGPAEDGELARAAGFVDGWLAQAAAQAGQRLGRALARLERAKRFW

SEQ ID NO: 5463 - protein, 254 aa, Chromobacterium substugae
MGLLDRKTAIITGASSGIGREAALLFAREGAKVVVVARRGHLLDSLVDEIAAAGGQAAALAADASDERAAQAMVELALGRFGALDIAFNNAGALGAPGSLPDLALDDWRRTLDANLTSAFLCAKYQIPAMLKQGKASLIFTSSFVGHAVGLPGMAAYAAAKSALVGLTRSLAAEYGAQGLRVNALLPGGTDTEMGQAATPTAEQRAWVENLHALKRLASPAEIAGAALYLASDLSGFTSGAALFADGGASSARG

SEQ ID NO: 5464 - protein, 432 aa, Chromobacterium substugae
MPYTQLIRRLAPLPHLGKWLLLSGIVAALAGCASAFFLLALDWASRWRLAHPAAIWLLPVAGFAVGWLYLRFGREVEAGNNLLLDEIHDPRRIIPLRMAPLVLAGTIATHLCGGSAGREGTAVQMGGALADQLNRWLPLRPADRGILLSAGISAGFASVFGTPLAGAVFGLEVLAIGQLRYDAILPCLLAAVAADRLGLALGIQHSHYAIPFVPPLNAWNMLAAVLAGVAFGLVARLFSSATHAVGGAFKRFIRYAPLRPLAGGAMVAAAASLLPADAYLGLGLPTLAAAFQQPLPSYDFAGKLAFTALTLGAGFKGGEVTPLFYIGATLGNALAPLLQLPFPLLAGMGLAAVFAGAANTPLASTVMAMELFGPEAGVYAALACVVSYLCSGHAGIYRAQRVAQAKHGALPAQIRLADLPAWRAARSSARPD

SEQ ID NO: 5465 - protein, 63 aa, Chromobacterium substugae
MGQRGEPADELGVRHGSPSSDRIEQTWTGENRGAPTASLARERCRHHQPLWAVGGGMPSPSEA

SEQ ID NO: 5466 - protein, 665 aa, Chromobacterium substugae
MHPMQVVQPFLFKAVPCVQGADMSYLQFPRLAFAGSFQADVSTVNNDPRHYDIDNFEPAFQDFQTKQSYNGWWHPTGTAIMRFADCQVTSLRGPDGVLITESGLDPLLSCTVGNAIGKPSGKMVDLDPDWQLASNLYGLAVSLLRPDGTPIMTADYESNPFRDLWFTRGSGGGDSGASAMFQSVLTNVEWHLDDFDSPLLDQLIRVSEQGRLSVRLSTYGYNMDASNPRFGYGTVLGAIGPVHAGQPRSFILGRRFMPTTQQGADLVSSNGIGCFSSYIDSASGSLQVDLSNALPLGPDNQVKYLGVLQYAILKNALTAQDAEIGPGDYIYLGTVDTSQALQNVQAGIQSLPLSGDALRQTEGQPLAIIQINDSNGNAQVCVREALLGNEVRVEDFATRLDPNDPAKNRLVTTLYAATYGQPAAGARMEFWAAGPALDYDNTPTSPDAATTPRALLPVNNVPGGAIRIEPREVVTGADGTAQFTVHGPEFMATPREYMDGQLFTINYNFAGDNPAVQQPYDNLALMVFSTYPQPGQQVNLEHPRWDDVQPILQQYANLYPVMSQGLFDFSKQGVADACAAIMRFVFDKPIEDPDQMPVTRDLSSSKRRMLINYFQDVMDRTGNTMDRQLMFGKRCPLRPSAMPGEADIAAARAAPTASKSRKAGR

SEQ ID NO: 5467 - protein, 367 aa, Chromobacterium substugae
MLKIRPELMAKLRAAASVEDVREMLAGAVRLELATIPPYLTAQFSVMPGQNQASRALVQSVVVEEMLHMTLAANALIAIGGNPDIVADGRSLQYPGPLPMCVDEGLTVTLKSLTRLQAFEVFMAVERPDTEAILPGETAPELADNSGYESIGDFYMAILHKLEELVAAGVPCFARPRLEQQVDISKWFPPEVPGHPEGKVYDIGSARAAIMTIVRQGEGLQIQDDKINPKEDPRGGYAHYFKFGEIYYGKRLVRDPASVSGWSYSGEPVPLDETGVYPLLPNAALSDYAKGSGAAVSGTQFYQAYQNLLVALNRTFNGEPNQLDAALGIMYELKLVAQKVMQNLANPDVPGVLAAPPFMRTHHPDEE

SEQ ID NO: 5468 - protein, 120 aa, Chromobacterium substugae
MSYINLTADNFNANMREEGLVILDFWAPWCGPCKMFGPVFEAAAEKHADIVFGKINTEDERDLAAHFNIRSIPTLIAIKDGIMVFNQAGAMMGAQFEQLLQSLRDLDMDKVRAEIASQPE

SEQ ID NO: 5469 - protein, 400 aa, Chromobacterium substugae
MIQLDFYGTLVAASLVLLLGRKLVAHSGALRTYNIPEPVAGGLLVAAALLASRQFSGVEVRFDASLQTPLMLAFFAAIGLTANLASLKQGGKSVGIFLGVVVGLLLVQNTLGVAVASALGLDPLMGLLAGSITLSGGHGTGAAWSGTFADKYGLASAAELAMACATFGLVLGGLIGGPVARFLVKRVNTPGAEHNADQPPQGFEQPDAQRLITPHSFIETLALIAVCLLGGTFLGGLLKGTAFELPTFVCVLFVGVLISNGLAALGWYKVFEREVSVVGNVSLSLFLALALMSLRLWDLAALALPIFALLLLQTLAMALYAVFVTFRVMGRNYDAAVLAAGHCGFGLGATPTAIANMQAVTERFGPSHLAFLVVPMVGAFFIDIVNAIVIKLYLALPFVG

SEQ ID NO: 5470 - protein, 37 aa, Chromobacterium substugae
MNQEGMEALHIPPLARRGGAKAAGWLVGDSMRKRAFL

SEQ ID NO: 5471 - protein, 314 aa, Chromobacterium substugae
MQDVSAFANRLAKNYKHYAKWARRQGLDAWRAYDKDVPQFPFAVDIYGGKVHLQEYDTGWEMADDDYRAWIDAVVAAIEQVTGIAAAAVTLKNRRRQKGVSQYEKVGREGDDFIVEEFGQRFIVNLDRYLDTGLFLDHRNTRKRVREEAAGKRFLNLFAYTGSFTVYAGAGGAASSETVDMSNTYQDWSRRNFELNGLDSSRHKLVRADVFQYLEEAVDAGKQFDLIVMDPPTFSNSKKMRDILDVQRDHVWLIDYAMALLAPGGKLYFSNNLRSFALDERLRGDYQIRDISEQSVPEDFRNRKIHQCWQISRG

SEQ ID NO: 5472 - protein, 160 aa, Chromobacterium substugae
MYAGSFDPVTNGHLWMIREAVELFDELIVAVGVNPDKHCTFDVEQRVGLLREVTAGFSKLRVDVFENQFLVNYAQSVGANYIVRGIRTASDYEYERTMRYINSDLHPDITTLFLLPPREYAEVSSTMVKGLVGPRGWEGMIRQYLPEPVYRKMLAMYSQQ

SEQ ID NO: 5473 - protein, 135 aa, Chromobacterium substugae
MHVYPYLNFNGRAEEALQFYREALNGDIAMLMRYSDAPKDTPPMGDIDPNWVMHARLAFGANVLMISDTDRPAPPSQQIVLSINLDGDTAAAEKAFAALSAGGQVTVPLGKTFWNALFGCFSDKFGVNWMINCQL

SEQ ID NO: 5474 - protein, 323 aa, Chromobacterium substugae
MTSVLQARDLTRYYDVAQGWLKPKAQVKALGGVSFELSAGRTLAVVGESGCGKSTLARQLTLIEQPTSGSLILDGQDAAKAGGAELKAMRRKVQMVFQNPYGSLNPRQKIGDQLSEPLLINTELSAKEREEKVRGMMARVGLRPEHYFRYPHMFSGGQRQRIAIARAMMLNPKIVVADEPTSALDVSIQAQVLNLFMDLQEEFNTAYVFISHNLAVVEHVADDLMVMYLGRAVEVGAKDRVYDRPLHPYTQALLSATPSIHPEDRRVKIKIEGELPSPLNPPSGCAFHKRCPHANERCKSEVPQLRELDARMVACHRAEEING

SEQ ID NO: 5475 - protein, 326 aa, Chromobacterium substugae
MSLLRIKNLSVEFGAEKNPFRAVEGLDLTVAQGEIVGIVGESGSGKSVTMMAMMGLLEGQGRIVADELSFDGKDLLTISARGRRKIVGKDISMIFQDPMTALNPSYTVGYQIMEVLKVHQGLRGAALKARALELMQQVEIPAAASRLDAYPHQLSGGMSQRVAIAMAIACNPKLLIADEPTTALDVTIQAQIMELLVSLQKSQNMALILITHDLAVVAEVAQRLVVMYAGQSAEVGGVPGIFRQPAHPYTEALLSSIPEHSKGARRLATLPGIVPGQYDRPSGCLLSPRCPYVQENCRSQRPGLTPQPNGAVRCHYPLLAKEKQHD

SEQ ID NO: 5476 - protein, 304 aa, Chromobacterium substugae
MSQTKQNAAPADLALSYPSPLKEFWQGFSHNKGAVAGLIFVLFIVACALLAPVIAPYSPIEQYRDHMLTPPAWEAGGSVQFLFGTDELGRDILSRLIHGARLSLFIGLMSVLMALIPGVVLGLLAAFFPKALGASIMRLMDIMMALPSLLLAVAIMAILGPGLTNAMIAIATVSLPAYVRLTRASAMTELNRDYVVASRVAGAGLFRLMFVTVLPNCMAPLIVHATMSFSSAILEIAALGFLGLGVQPPTAEWGTMLASARDYIESAWWVVTLPGLTILLSVLAINLMGDGLRDALDPKLKRAA

SEQ ID NO: 5477 - protein, 342 aa, Chromobacterium substugae
MFAFILRRLGLLVPTFFGITLLTFGLIRMIPGDPVEVMVGERTLDPKLHAEALHRLGLDKPLYAQYFDYVTNLLHGNLGESLVTKVGVWTEFKTLFPATLELALSALLFAVVWGLLAGVLAAIKRGSLFDHGVMGISLTGFSMPIFWWGLILIMFFSVKLGWTPVSGRMDLMFDIHPRTGFMLIDSYLAEMADPEGNAGAFKSALSHLILPSIVLGTIPLAVIARMTRSSMLEVLREDYVRTARAKGLSPARVIFIHTLRNALIPVLTVIGLQVGTLMGGAVLTETIFSWPGIGKWLIDAIARRDYPVVQNGILMVATLVIVTNFIVDILYGIANPRIRHAK

SEQ ID NO: 5478 - protein, 531 aa, Chromobacterium substugae
MQAFKKLLVAGVVAGSSLAAHAAGTLVFCSEGSPAGFDPGQYTTGTDFDASAETVFNRLVQFQRGGTKVVPGLAEKWDVSADGLSYTFHLRKGVKFQTTDYFKPTRDFNADDVLFTFNRMIDKNHPFRKAYPTEFPYFSDMSMDVNIVKIEKLDPYTVKFGLKKVDAAFVQNMAMSFASIQSAEYADKLLKDGKPQLINQQPVGTGPFIFKRYQKDAQIRFVANKQYWDKVDGPKVDNLVFAITTDASVRYQKLKAGECQITTFPRPTDIPAMKADPKMHVISQAGFNLGYLAYNVRHKPMDKLEVRQALDMSINKKAILQAVYQGAGQAATNPMPPTQWSYNKSLKDAPYDVAKAKALLAKAGYPNGFEITLWAMPVQRPYNPNAKLMAEMIQSDWAKIGVKAKITSYEWGEYIKRSKAGEHDAMLIGWTGDNGDPDNWLSTQLGCEALNGNNFTKWCYKPFEDLIQKGKTTANVAERTKLYMKAQEIVKQQLPYTTIAHSTVNQPMLKSVQGFKVSPFGMNSFYGVSIK

SEQ ID NO: 5479 - protein, 373 aa, Chromobacterium substugae
MHKVVISGTGLFTPPHAVGNAELVEAFNAYVRDFNAANRAAIDAGEVAELAESSAEFIEKASGIKQRFLMDKGGVLDPARMAPHLPERGNDELSLQAEMAVAAARQALEAAGRAAADIDMVIVACSNMQRPYPAMAIEVQQALGIAGFAFDMNVACSSATFGIQTAVGAIATGQARAVLMVNPEICSAHLNFRDRDSHFIFGDACTAVVLERADAATSAQRFEVLGCKLATVFSNNIRNNFGFLNRCDEAGVGQPDKLFIQQGRKVFKEVCPMVGEHIVAHLGSLDIAPEGVRRFWLHQANLAMNQLIAKRVLGREADNVEAPVILDRYANTSSAGSIIAFHLHSHDLAAGDVGVISSFGAGYSVGSVVLKKR

SEQ ID NO: 5480 - protein, 53 aa, Chromobacterium substugae
MGRGEQASPADNNLMHVDLSFFTRGRGSKHGGQPMRPNIAAILHKPPQKVRNP

SEQ ID NO: 5481 - protein, 160 aa, Chromobacterium substugae
MRLTTKGRFAVTAMLDLAMREEGGPVTLAGISERQSISLSYLEQLFGKLRRAELVDSVRGPGGGYTLAKETHEITVADIIVAVDEPVDATQCGGRENCRGSQRCMTHDLWTNLNVTIFDYLSKVSLASLVAEQHAKETSVVQDKRDSCSTPHLAAASRAL

SEQ ID NO: 5482 - protein, 405 aa, Chromobacterium substugae
MSQPKLPIYLDYSATTPVDPRVAEKMIPYLTGKFGNPASRSHSFGWEAEEAVENARAEVAKLIGADPKEIVWTSGATESDNLAIKGAAQFYKSKGKHLITVKTEHKAVLDTCRELERQGFEVTYMDVQENGLLDLEAFKAAIRPDTILVSVMYVNNEIGVIQDIPQIGEICRGKGIIFHVDATQAPGKVKIDLNTLKVDLMSLSAHKAYGPKGIGALYVRRKPRVRLEAQMHGGGHERGFRSGTLASHQIVGMGEAFRIAREEMDGECERIRMLRDRLWNGIKDMEEVYINGDIDQRVPHNLNVSFNFVEGESLIMAIKDLAVSSGSACTSASLEPSYVLRALGRNDEMAHSSIRFTLGRFTTEEEIDFTIALLKSKIGKLRELSPLWEMFKDGVDLNSVQWAAH

SEQ ID NO: 5483 - protein, 127 aa, Chromobacterium substugae
MAYSEKVMDHYENPRNVGSFDKGDDSIGTGMVGAPACGDVMKLQIKVGADGVIEDAKFKTYGCGSAIASSSLVTEWVKGKSLDEALTIKNTAIAEELALPPVKIHCSILAEDAIKAAVEDYKQKHGK

SEQ ID NO: 5484 - protein, 107 aa, Chromobacterium substugae
MALTLSERAAAHISAFIAKRGKGLGVRLGVKTSGCSGMAYKLEFVDVASDDDVRFDSHGVSIFTDAKSLAYLDGTELDYAKEGLNEGFKFHNPNVKNECGCGESFNV

SEQ ID NO: 5485 - protein, 175 aa, Chromobacterium substugae
MNTDFSQDFFSLFGLPRRFAIDSALLDNAWRAAAAQVHPDRYAASPDAEKRSALMLSTRVNEAYRTLKSPLSRARYLLQLSGVDTQEESNTAMPGDFLMAQMEWREDIDDARRDLARLEALSSRLRAEANALQAALAQALDSRADLDGATVLVRKLRFMEKLDQEIGDAIESLLD

SEQ ID NO: 5486 - protein, 598 aa, Chromobacterium substugae
MGIDLGTTNSLVATVKSGSAVVLPDEHGCSLLPSVVRYVDEGEPEVGYEAQREQNRDPHNTIVSVKRFMGRGLSDLKDAGSLPYRFVDAPGMVQLHTRAGVKSPVEVSADILRALKVRAEASLAGELTGAVITVPAYFDDAQRQATKDAARLAGLNVLRLLNEPTAAAIAYGLDNGSEGTYVVYDLGGGTLDVSILKLSRGVFEVLATSGDSALGGDDFDHRVFCWVLESAGLSGLSAHDMRLLHTRAREAKEALTDHAGTRITAILSDGQTLDLELDQATLHAITKTLVDKTLLPVRKALRDAKITPEDIQGVVMVGGATRMPHVQKAVADFFGRAPLTNLDPDKVVALGAAIQANVLAGNKQDDEWLLLDVLPLSLGIETMGGLTEKIIPRNSTIPVARAQDFTTFKDGQTAMSIHVLQGERELVSDCRSLAKFVLSGIPPMVAGAARIRITFQVDADGLLAVTAREQTSGVEASIEVKPSYGLSDDEISRMLTESMSHVQEDIEARKLREAIVDADSLAEATRNALAADGDLLSDAERAEVETAVAAIAQAIAGNVTRRINEATAALNHATETFAARRMDRNIQRALKGHKITDL

SEQ ID NO: 5487 - protein, 113 aa, Chromobacterium substugae
MPRIIVLPHADLCPEGAVIDNAETGQSICDVLLAHDIEIEHACEMSCACTTCHCIVREGGNSLNEADELEEDLLDKAWGLEAQSRLSCQAIVADEDLVIEIPRYTINHAREHH

SEQ ID NO: 5488 - protein, 64 aa, Chromobacterium substugae
MKWTDVNDIAIELADAHPEVDPKTVRFVDLHNWVVELPGFDDDHSRGGERVLEAIQQAWIDEAE

SEQ ID NO: 5489 - protein, 427 aa, Chromobacterium substugae
METVEALKFLSPEEIPHLAERYGTPLFVYDLDTIKRNYDYFSQIPAPYGLTVRYSVKANPTRAILAYFNQLGASFDVSSVWEARRCVNAGIDASKILITAQEVSAGWEELCEAGMEFDAGSLQQLRAYGEKFPGGQVSLRINPGFGSGLVKKLTSGGDHSSFGLWYAQFDEALALAERYSLSIKRIHLHIGSGHDSGILEKTVNRALELCARAPGVTHLNLGGGYKVTALNSDPQYDHHAVGARISASLEQFHRETGRQLHLEMEPGTFAMALAGSLITRVIDVVNTGGDGYRFIKIDGGLTELMRPSYYGALHPLVVVKKDGSLGTHDVTPQMVCGHCCIAGDSLTPVAGNTEDFTPVPLARAEINDYLVVERTGGYAASMSVKNFNSYPEAAEVCRAGKGSYHKIRERQTLEQMTQNERDLPLER

SEQ ID NO: 5490 - protein, 322 aa, Chromobacterium substugae
MQLAPVKGQDLRRNLPREYFVKRPALFTAKILFAFALIALGWYGIWYALTTPVTTVSILAAVGGFFLNGLIYAHLIELQHECLHCHAFKSVKLNRLFGALAGVFMFSSHSHYRYDHLRHHAYLGTERNLEHFDYRFNDLNSLTGFAIAFFDLNRYKRVFNILAAALTGKPIAGVAKEEAQRHIKQEYLIYALAFIASVIASLHFHTWLFALAWWLPTLIIAEGAHFMIEMPEHYGLNTQTAPDVLENTRTIRTNPIIAWYVNGNHTHTAHHFHQGVPMCNVKKLNALIKPQLQVVETSYFAFYCDVIRGRISHRYDATCMAR

SEQ ID NO: 5491 - protein, 372 aa, Chromobacterium substugae
MKKVGLVGWRGMVGSVLLQRMQEENDFHGIDPHFFSTSNAGAAGPAIHGATHLLKDANDIRSLAEMDIIITCQGGDYTKAIYPELKASGWQGYWIDAASALRMDKDSCIILDPVNRPQIDQAIQDGLKLFVGGNCSITLSLMGLAGLIKADLIEWMSLMTYQSASGAGAKQVRELIAQSGYISSRLEQEGLTKQDSILPLVKRVCELISSPELPTEALGAPLMGSIIPWIDSDLGDGNSREEWKGEVETNKILGLAPGTIPVNGLCVRVGVIRCHSAAITMKLKREVNEQEFAALVKDAHPFVSYVPNNKQQSVTQLTPAAISGSLKVGIGRYKKMSLGQEPIYSVLTVGDQLLWGAAEPLRRMLNILLGRA

SEQ ID NO: 5492 - protein, 281 aa, Chromobacterium substugae
MLLTGEVSQRLSPFIVCFFTFALATAIFLSYNARHLGSLWRRIREKRVQGPVLAINLSSFASWGLMIYPLTYLQPTLVATMILGINPLATALITRLFLKQRSPDKLVVTSLALFAVIVFLSYRSWQGENSIPGTPHQQIALSLLCCVLSGIATSVNNILTKRIMSNAFGIIDVMCMRFYFTILISGVIGFSSHQVALNQDLAVSILQTTLVFVVVPLILLQIALKKLDPLRVAIISPLMPVLVVLMQLYGNIAALSAAAIGAALATWLLVSLGTYWAMQKN

SEQ ID NO: 5493 - protein, 525 aa, Chromobacterium substugae
MSKLYLKPNTILEPLLWNWHAWSHLMSPLTASMHIKNRHLRIMQRFVETGSKPQVKNQKFEGGPVVQLDGSFARDVERLLNKTLDECQDLIALAEGIEDASQKVLEPAGKTLEPLYDSLQPAVKGLLELVYNLDFQPGLKFYESLVWQDYYSTQPQAIAFSQIHSDRRPFILGTPVLSTADNLVLPLPFASSIIDDIQRSTQHGIERQTLLDQLQLDPSQLDSLLRFFSTEPIATRHKRYDGEGVRVRYYGHACLLIESKDTAILIDPLISYDYPAEIERFTYSDLPDQIDYVLITHAHQDHFSIETLLKIRHRVKNIVVPRNNRGDLVDPSLKRILQHMGFANVIELEEMDQVPLPHGEITAIPFIGEHAELDIQTKLVYNVRLHGRSYFAGADLNNFDGDVYRRSFRKLGEIEVVFIGMECDGGPIHWLYGPLITRSYDKEATRSRTLSGSDCAKASALIESIGAKHAYVYSMGEEPWLNYIMNINYSPEALQIIESDRFIRQNQQNGLHSRRLFGKDEWLFS

SEQ ID NO: 5494 - protein, 420 aa, Chromobacterium substugae
MPQRNKLVIIVDAYGPARHFRHYLQQQGYLCAHLLGTPQPLPRLKLTELDRYDAALIHHGDLAATARRIEELAQELDAELQEILPGVEPGVLLADQLSHRFQLRSNGIAKSLARRDKSVMADVLSAAGVKVPSYCRTASLDEALAFSRGQQWPLVLKPLDSAGTNGVFFCHSEQELAHAFDQVMGAENNMGLINQAVLVQSFLQGKEYMVNTVSRDGRHLITDIWFAEKTRISGYAYIYDKNHLIDSGSAEYALLRDYVFTVLDALDIRYGPAHAEVIITPDGPVLVEVASRISGGVDPEFNQLCLSHDQITLTLESYLRPDAFLQRIGQRYQIRKHGLQLFLSSSQAGVVTAFDFPEHLSRIASVVNYNLKPKVGDTLAKTIDLSSSLGIVHLAADDQATLQADYQHIQHLLARHLQFA

SEQ ID NO: 5495 - protein, 213 aa, Chromobacterium substugae
MDMFTLVIGNKNFSPWSLRPWLVLKMLDEPFKEQQIDLYLSDSKARILAANPAGKVPVLVDDKLRVWDSLAICEYLAECFPAAGLWPDDSKLRAVARSIMAEIHSGFAALRHSLSMDISLRQIDYETSPAVESDIARVVSLWEEHRQRHVADGEFLFGRFSIADAFFAPICTCFETYNVKLPPVSQAYVRHILSLPAMQEWYRAARQERQRQA

SEQ ID NO: 5496 - protein, 218 aa, Chromobacterium substugae
MARFLFFHYTEESDMSTPFIIGVAGGSGSGKTTVTNKVLETIGSEMAAVIIQDYYYRDQSHLTFEQRLGTNYDHPQAFDWPLLISHIDDLRNGRAIEMPVYDFANHTRSDQTITVQPAPVIVIEGLFPLYDAALREMMSLKIFVDTDSDVRFIRRLKRDIAERGRTMENVIEQYLSTVRPMHNQFIEPTKRFADVILPHGANDPAVDIITTKVASLMV

SEQ ID NO: 5497 - protein, 91 aa, Chromobacterium substugae
MHTIKPRNPLACAAILKKGGAHGRSRSGQRQSQKQALWAELDQDWNLEADLPPSPLAARAGQDADEAFSPRQAPKETGHRKMACFFWAHAA

SEQ ID NO: 5498 - protein, 150 aa, Chromobacterium substugae
MKWIATTLLMLLLAGCGSLGLKKPQVGLSNIEPGNSTLFEQNFTVTLRIRNPNPIPLSASGLNFELMLGGEKLGGGASNQAFSVPAQGESLVPLQVHTSLAAWIRQLANWQKLPDGKLDYQIRGELQGLNGLATLPFDNKGEWKLPARGR

SEQ ID NO: 5499 - protein, 146 aa, Chromobacterium substugae
MKKLCLPLLALLAAGCSMIPTQQGYAQKVYRWQGRDVNELLAEWGAPSNSLKMPNGNTLYAYVKESTQQQPLTQNTRYEPGTKLSVTDSNGQTKVVETPGRWVSDGVSGGGTIHYKCTTNFVVDKKTQEVLSVSFDGNDCVALPRQ

SEQ ID NO: 5500 - protein, 627 aa, Chromobacterium substugae
MKSIRSKIALLLALAILVATCSTAVSAYYKFRDSLSDSVDTQLDLAITGQQRFVSAWLEQRRQIISSALRHGNEADPTLYLQQLAEAGGYTQLFVGDGDTKGMVYSIPGKQKPTPEYDPASRGWFKMAKASGQTIVTAPYQPASASIKDLVITIAQALPGGNKVVGGDIAIGQLVKSVLSVSLPGNGFVFLMGKDGKLIAYPKADTALKPLSDLMPGMDADRIGSLLDKQQLATVELEGSSRLLRLSSVAGSDWVLGVVVDRELLDAPLRQMMVDMLLALLAVLALTQLLAGAYLRRLLKGLLQVRDALREIAQGEGDLTRRIEAAGDDEVAQMAEAFNQFVGRLNRLFRELRSEAVQLADGVIAVGGDVERLAEDSHTLADISSSNAAAIEQVTVSISHIADATRETDELARDTGANSQASAEELQRISGAMARTSQSVGELSGLLASLEQRSQEISKITGVISDIADQTNLLALNAAIEAARAGEQGRGFAVVADEVRKLAERTGSATVEIGKMVENILSETGKAVGNMNSTIGAVDSSAAQTEAARERLVDITRAMRQVVEKIGDVALSTGEQHNATTAMAQSTESINNKILDSDAALQSAQQTLKTLDGVARSMQEAFSRFKL

SEQ ID NO: 5501 - protein, 628 aa, Chromobacterium substugae
MRSIRHKLILLTAVSILVATLSVAIIACLNIRNHAYDEAKREVTQVLQLQGGLVSEWLGVRKSLISASLSKAGDPQASYYLQQIAKGGGFNIIYAGHGDSGEMFYSVPGRVKPSADYQPAQRPWYQQAKAQGGLIVTDPYKDSEPETKDKLVITIADKAQGQEIVVGGDILIDKLVKSVLDIKLAGDGHAFLLTRQGKVIAYPKPGQELKPVSELIPALDDNRFQQLVASGDVTPMEIDGKTFLVDLRQVEGTDWVLGVAADEDAVLAPVTQLIWLIAGGVAVVLLVLVALSSGYLTRLLRGLIQVRDAMREISQGEGDLTRRIEVHGEDEVAQTAEAFNQFVGRLNGMFRELRGEAEQLAHGVIEVGGAVKQVANDSHRLADISSSNAAAIEEVTVSISHIAEATRETDTLARNTGEHSRESAGDMQRISSEMEQTSQAVGELSGLLASLEQRSQEISKITNVISDIADQTNLLALNAAIEAARAGEQGRGFAVVADEVRKLAERTGKATVEISQMVENILSETGKAVGNMQRTVSAVDTSVDLTSQARGRLIAISDAMQQVIDKIGDVALSTSEQHNATTAMAQSTESINNQILDSDSALQGAMQTLEALNQLARSMQGAFGRFKL

SEQ ID NO: 5502 - protein, 319 aa, Chromobacterium substugae
MNNIDAVQLRKLDLNSLVALHALLSTRSVSQSAERLCLGQPAVSHILKRLRALTGDELLCRHGRRMELTPLAEALLPPLEAWLEQGQRLLRPQVFDPAALRAEYRLAMPDLLEAALLPALIVALQAQAPGLSLQVVAMPAGEVEDALERRRIDGAIGYFPHASARLGRQALFVSRFVCFYHAAQIRMPQTLRAEDLARPPHIHTSYAGDSASLVDDYLSGQGLKRRVIASTASLLAIPAVLAQLPAVAVLPDLIAGVLRRGDNGLAAQRLADAELQIGIEHLWHPRRNADPLQNFFNALVRDQSARLAERWQQSFGDIF

SEQ ID NO: 5503 - protein, 501 aa, Chromobacterium substugae
MSQAPSARPLPRLLAIMLIAWLEFLQNGMLNFASSHVMGGVGAGPEEFSLAAMAYALCAVVALFNHQWCVERLGSRRHLQISLLLFGLGALLAANAQTPAAFIAGRAVQGLGGAAFFTAARLEAAQLPPAWRAAGLVAFGQALLLGSALGPLLGGMILRAGSWRGIFWAILPCLPAAWWAARQLPLRPPAPQAPRYHPAAFIWLVAAAFLLQWLIQQLPYQLFGHPQWLLGLLAAALACCAALRLRHPGGASDRERWRALKQPGYLLGLFCYACCYLLVSANSYILPAVAIQALGFDVPTSGALLAVSFFAGMAASLLYAVLLRSRRPPSLAAAMLCGCLLLALYGWRMSALNAEASQLRLTLTLLLNGGFMSLFIMATAQRAFRDIAPAAFGHAYQTKNIVRQVSISAGVALATVFLQARNALHYSRLGENFSWNTPQFVEVLHQMRQLMPELSDTQRLGVLAGELARQATLLSCLDFFRLESGIALGLAAAIACLRKRM

SEQ ID NO: 5504 - protein, 214 aa, Chromobacterium substugae
MRKSGSQSPTFDKIIEASLQLFNQEGERVITTNHIAERMNISTGKLYYHFRNKEEIVNELYQRYVKGMGEQLSAAINHCNSIEAMVGAMEKTLRHIWSFRFLPQSLPSLFCVNPTLAENHQQISRGQLSDKLAQLFARLREQGMLQGDDSQLQHLVQHFQMVQTGWINTIKQNASPAELEKLIQSGCRSLMYLLTPYVSPRFQSPFERACARFA

SEQ ID NO: 5505 - protein, 294 aa, Chromobacterium substugae
MSVLVNKDTKVLVQGFTGKNGTFHAEQALKVGTKVVGGVTPGKGGSEHLGLPVFNTMKDAVRQTQADASVIYVPAAFAKDSILEAIDSGVKLIVCITEGVPTLDMLYVKKAVDEAGIRLIGPNCPGIITPGECKIGIMPWHIHNPGRIGIVSRSGTLTYEAVAQTTALGLGQSTCIGIGGDPIPGTSHIDALRLFQDDPDTDAIVMIGEIGGSAEEEAAEFAKSYVTKPVVGYIAGVTAPKGKRMGHAGAIISGGKGTAEEKFKAFEKAGIAYTRSPAEIGKTMFELLKSKGMI

SEQ ID NO: 5506 - protein, 390 aa, Chromobacterium substugae
MNLHEYQAKELLSRYGLPVQQGILAKSPEEAAAAYDKLGGKFAVVKAQVHAGGRGKAGGVKVVKSREEAAEVAKTLIGTNLVTYQTDAAGQPVNSVLVCEDMYPVQRELYLGAVVDRGSQRVVFMVSTEGGVEIEKVAEETPEKIIKIEVDPLVGMQPFQARDAAFALGLSGAQVAAFSKLMLGSYQAFVENDFALFEVNPLALRENGELACVDGKINLDSNALYRHPELLAQRDKSQENEREVKASEFDLNYVALEGNIGCMVNGAGLAMATMDIIKLKGGQPANFLDVGGGATKERVIEAFKLILADTSVQGVLINIFGGIVRCDMIAEAIIAAVKEVNVTVPVVVRLEGNNAELGAKILDESGLKLTSAQGLNDAAEKIVAAVKAVA

SEQ ID NO: 5507 - protein, 477 aa, Chromobacterium substugae
MSQQFDVVVIGGGPGGYVAAIRAAQLGFSAACVDAFKNPEGKPSLGGTCLNVGCIPSKALLQSSENFHAVQHDFAKHGISVSGAKMDVGQMLARKTDIITKNASGISFLFKKNKVANIHGLAAFKGRQGDKWVIEVTDNGAVVDTLEAGHVIVATGSSPRALPGLATDNQLVLDNEGALALSAVPKRLGVIGAGVIGLEMGSVWKRLGAEVTILEAMPTFLAAADQQIAKEAFKTLTKDTGLDIKLGVKIGEVKAGKKSVTVNYELNGEAVKAEFDKLIVSIGRVPNTQGLGAETVGLQLDERGFVAVDEHCHTNLPNVWAIGDVVRGPMLAHKASEEGVAVAERIAGQKPHVDFGVIPWVIYTSPEIAWVGKTEEQLKAEGVEYKKGTSGFGANGRALGLGQAQGTVKILACAKTDRILGLHMIGPMVSELVSEGVVSMEFKAASEDLARIVHAHPSLSEVIHEAALAADKRALHG

SEQ ID NO: 5508 - protein, 61 aa, Chromobacterium substugae
MNLPDWFYGVASVLAGVVLLFLTWKKHQRGVREDSYSRVGKIVIALFMIAFGALLFKVGKA

SEQ ID NO: 5509 - protein, 414 aa, Chromobacterium substugae
MLIEVKVPQLPESVSEATLMSWHKKVGEFVKRDENLIDLETDKVVLELPAPQAGVLVEIIEQDGATVVSGQLIAKIDTAAQAGDAAPAPAAAAPAAAPAPVQAPAAAPAAGAAAMPSAAKLAAETGVNLANVAGSGRDGRILKEDVQAAAKPAAPSQAGPVSSGAALSSTPAAVNIAGILSGRPEQSVPMSRLRQRVAERLVMSQQTNAILTTFNEVNMKPVMDLRNKYKDKFEKEHGIKLGFMGFFVKAVVSALKKYPIVNASVDGNNIIYHGYFDIGVAVGSPRGLVVPVIRNADQLSLADIEKQIADFGKRAQEGKLTVEELTGGTYTISNGGTFGSMMSTPIINPPQSAILGMHATKERAVVENGQVVVRPMMYLAQSYDHRIIDGREAVLSLVAIKDAIEDPARLILDL

SEQ ID NO: 5510 - protein, 942 aa, Chromobacterium substugae
MMQSMYSHSYLFGGNAPFIEELYEQYLADANSVPNEWRDYFDKLAQAPGAAERDVPHQPIQESFIQLAKKPLSGQRSSAAADWDAMQKQVGVLKLISAYRVLGSRQANLDPLKRMDQQTLRELDPATHGLTDADMAVQFNVGSLVGPQKLPLSDILARLKQTYCGNIGVEFMHITQSDEKHWVQKRFEGDLSTPRYDAAKKQRILKQITAAETLERYLHTKYVGQKRFSLEGGESAIAALDHLIQNATAQGVQELIIGMAHRGRLNVLVNTLGKQPRDLFAEFEGKAAQQMASGDVKYHMGFSSDIPTANGPMHVSLAFNPSHLEIVNPVVEGSVRARQERRKDAERKTAVPVLIHGDSAFGGLGVNQGTFNLSQTRGYGTGGTIHIVINNQVGFTTSDTRDIRSTMYCTDVAKMIEAPILHVNGDDPEAVCYVMQAALDYRMTFKKDVVIDLVCYRKLGHNEGDDPFLTQPMMYKKIAKHQGVRAMYAERLVQEGVLKAEEGDAQIQAYRDALDKGEHVEQTALTNYRREHALDFSQYLGTHWAHPTDTSLPQADIQRLTDKFTSLPEGFKLHPTVQKVLAARKAMAAGEQNVDWGMAETLAYASLVTNGFGVRISGEDSGRGTFSHRHAVLHDQNRERWDQGAYVPLRNMSDNQADFLVIDSILNEEAVLAYEYGYACSAPDQLVIWEAQFGDFANGAQVAIDQFISSGETKWGRLCGLTTILPHGYDGQGPEHSSARLERWLQLCAEHNMQVVMPSEAGQMFHMLRRQVLRPYRKPLVIFLSKRLLRFKDSMSPIEDLTSGSFRPVIGDAIVKDPKKVKRVVLCAGQVYYDLAAGRKERGLEDEIAIVRIEQLYPFPTEQVAAELARYTQAKEVMWVQEEPRNQGAWYQIRHRLEGLLSAKQQLSFAGRPSSASPAVGYMSKHVAQLKAFVEEAMSVAR

SEQ ID NO: 5511 - protein, 429 aa, Chromobacterium substugae
METNRKVTLSYNEGKDSIDLPVLGGSLGPDVVDIRSFGKTGMFTFDPGFLATASCESGITFIDGDLGHLYYRGYPIEQLAEKSDYLEVCYLLLNGELPTAAQRKEFERGVMRHNMLHDQLMSLFKGFRRDAHPMAVMVGVVGALSAFYHDSLDISNPEHRRISAHRLVAKLPTIAAQAYRYNKGLPFSYPKNGLNYAENFLHMMFSTPCEEYKVNPVLARAMDRIFTLHADHEQNASTSTVRLAGSSGANPFACIAAGIACLWGPSHGGANEAVLKMLDEIGSVDNVADFMQGVKDKRYKLMGFGHRVYKNMDPRAAIMKQTCDEVLKELGLGDSPKFKLAMELEKIALNDPYFIERKLYPNVDFYSGIVLSAIGIPVSMFTPIFALARTVGWIAHWNEMIGDPGMKIGRPRQLYTGAPRRDFVEVAKR

SEQ ID NO: 5512 - protein, 82 aa, Chromobacterium substugae
MTTYDPIELKRMRWRSRRGLLELDLVLEKFLAGPFGRLAPAEIEAYRRLLDLADTDFLDIVSGKADLEDPEEMAIVAILRSL

SEQ ID NO: 5513 - protein, 236 aa, Chromobacterium substugae
MTTETIKFRIYRYNPDQDAKPYMQDISVEMDATEHKLLDALVKLKIKDDTLSFRRSCREGVCGSDAMNINGKNGLACVTDFRGLKQPIELRPLPGLPVVRDLIVDMAQFFKQYHSIKPYVINDTPPPERERRQSPEDRKELDGLYECILCACCSTSCPSFWWNPDKFVGPAGLLAAYRFIADTRDEATSERLDNLEDPYRLFRCHTIMNCVDVCPKGLNPTKAIGKIKDLMVKRAV

SEQ ID NO: 5514 - protein, 579 aa, Chromobacterium substugae
MGAGGAGMRAALQLSEAGLKTAVLSKVFPTRSHTVAAQGGVSASLGNSEPDNWHWHMYDTVKGSDWLGDQDAIEFMCREAPKVVVELEHYGMPFDRNPDGTIYQRPFGGHMSDFGEGKPVRRACAAADRTGHAMLHALYQRNVRANTHFFVEWMALDLIRDAEGRVQGVVAMEMETSEIVVFQAKATLFATGGAGRIFASSTNAFINTGDGVGMAARAGIPLEDMEFWQFHPTGVAGAGVLITEGVRGEGGILRNAQGERFMERYAPNAKDLASRDVVSRAMVTEINEGRGCGPNKDHVLLDITHLDPEVIMSKLPGIREISIKFAGVDPIKAPIPVVPTCHYQMGGIPTNYHGEVVIHGEAVHGFYAAGECACASVHGANRLGTNSLLDLLVFGKSSANSMIEFIKQHPEDLPELAMADVERSVARVARLDNQTNGVQVHEARAALQRTMQAHCGVFRFKDMLAEGVEKILEVADMVAKTEIGDKSKVFNTARIEALELENLIEVAKATMVSANARTESRGAHVRDDALDTEATPNGRDDVNWLKHTLWFRDGNRLEYKPVNMQPLTVDTIKLKARTY

SEQ ID NO: 5515 - protein, 114 aa, Chromobacterium substugae
MVNRNVVGAGYGLRDWVMQRVTAVVMVIYTVALALFLLALPSGYEGWKDLFSHTWVQVLTQTTLLALFLHVWVGIRDVWMDYVKPVGIRLALHMFTIVWLVSCFIYSVKVVWGL

SEQ ID NO: 5516 - protein, 125 aa, Chromobacterium substugae
MQKQRPKHLDLARIRLPVPGFVSILHRVSGVALFFSLPLLIYLLHGSLSSAESFETYRAVVAHPLMKLVLLGLIWAYMHHFCAGIRFLFLDIHKGLELETARATAKTVLVVSLALTLVLGGIALW

SEQ ID NO: 5517 - protein, 244 aa, Chromobacterium substugae
MTANTLKRQPLYAQVKQRLLERMGEGEWQAHEALPSEWELAGELGASQGTVRKALSELEAAGLLYRQQGRGTYVAPVPGDWGDAALLTPGLFGEQPDDLAREFLGLSRLNASEDIADALQLRRLAPLLRIRQLWRWHGAPVALDDVLLPAERFDGMEARWLRNSAGVYATLQQRFGVRVRVRSEQFRAEMLPREEAGLLGVTGMVADVPALCLLRLSEGMDGSPLEWRQRYCLTHQLAYTVKHG

SEQ ID NO: 5518 - protein, 326 aa, Chromobacterium substugae
MKAPVRVAVTGAAGQIGYSLLFRIASGEMLGKDQPVILHLLDLPQAQTALKGVMMELEDCAFPLLAGMVATDDPNVAFKDVKVALLVGARPRSKGMERKDLLEANGAIFTVQGKALNDHAARDVKVLVVGNPANTNAWIAMKSAPDLDPKNFTAMLRLDHNRALSQIAAKTGKPVASIEKLAVWGNHSPTMYADYRFATIDGQSVKTLINDDVWNRDVFLPTVGKRGAAIIEARGLSSAASAANAAIDHIHDWVLGSNGKWVTMGVPSDGSYGIPEGVMYGVPVVCENGEYKRVEGLEIDAFSRERMDLTLAELEEERAAIAHLFG

SEQ ID NO: 5519 - protein, 299 aa, Chromobacterium substugae
MLVLDSINATLADSRELFDMGKSEDDDDTILAVQADLEGVEEKVAKMEFRRMFHDPMDPNNCFLDIQAGAGGTEAQDWAGMLLRMYTRYAERKGFKVDVLEVSEGEVAGVTSATLKIEGEYAYGLLRTEVGVHRLVRVSPFDSNARRHTSFSSVFVYPEVDDSFEIDINPADLRVDTYRASGAGGQHINKTDSAVRITHIPTNTVVQCQNDRSQHRNRDEAMQMLRAKLYELELKKRNEAKQALEDTKTDVGWGHQIRSYVFDQSRIKDLRTSHEVGNIKGVMDGDLDGFIEASLKHGV

SEQ ID NO: 5520 - protein, 502 aa, Chromobacterium substugae
MSDHEQAPAQSQDENQIMAERRLKLQAIREKGIAYPNDFKRSHFAKPLQDDHAAKEAEALEAEKIEVAVAGRMMLKRVMGKASFATLQDVSGRIQAFISRDNVGEDVYADFKRWDLGDIIAVKGVLFKTKTGELTVQASEVRMLSKNIRPLPEKFHGISDQETKYRQRYADLIMSEESRDTFIKRSKIVQKVRDVMVGEGYLEVETPMMHPIPGGASAKPFVTHHNALDMPLYLRIAPELYLKRLVVGGLERVFEINRNFRNEGMSTRHNPEFTMIEFYEAYSDYQRMMEMTETIIRECALVSCGATTVSYQGKEVDLGKPFDRFTIVEAIKHYNPQYTDAQLSDSAWVASEIKRLGGKLPPAPGLGSLQLALFEECAESLLWNPTFIIDYPVEVSPLARGSDTQPGLTERFELFIVGREHANGYSELNDPEDQAARFQAQVAQKDAGDDEAMHYDADYIRAMEYGLPPTGGCGIGIDRLVMLLTDAPSIRDVILFPHMRPE

SEQ ID NO: 5521 - protein, 476 aa, Chromobacterium substugae
MIEGIVKKYNDGVIDDDGLFRSLFSAHFLIDIYQAKYKNSSAKGIDRINGFQFSSRAAAEIYLACEKSINGTYRFSPYLEVLKVKNREKPPRLISVPTIRDRIILSQLNKFLSIIYPERVTRNIASVYIRDISGKLAELPMDSTWVCGADIVTFYDDVDISRLIALLSRRIKSKIALKLIKSSLVTPTVPKNCSKNLYHKYKRACGIPQGLAISNILSSIYMQPIDDGMVGMGVGYHRYVDDVLMYGERDSVEFAFKSLKRRLQTRGLKLHPLSSEKTHFGRRCEPFLYLGYRFDGDTLTVRHATVERFLQSIAAKFSDFRHNKSKRLERLSYLNSSRLKDIFVSELNEKVAGAISDNKRYGWIAYFNQINDMSLLYRIDNAISNLFGRLGEFDFTAPPNLKKLSRAYWEMKFNPTGGYVKNYDSIVSLVDKLEFLVARGRVAPDESLSDEQIESRFQSYKRFVLSSMHADEGVVY

SEQ ID NO: 5522 - protein, 87 aa, Chromobacterium substugae
MENTTKPLTARAVFARNLRIARRLHDVSQEALALQAGMSRTYVSEIERGERNVSIDNMGALADALGVALRDLVDPEMFGGLLDKASK

SEQ ID NO: 5523 - protein, 138 aa, Chromobacterium substugae
MPSITRSSSHLALSLKNRHPARSRWLLHNPVPTHPPSLLAMTRLHEAFAALQEQLAGKDQAKVREPAARVAHLCHDIEQAVVESICHLAHGQLGLQSVIELLACLGDDVRLPSSRITELLSPLDKRMDESLSLLTRVL

SEQ ID NO: 5524 - protein, 47 aa, Chromobacterium substugae
MAASNRFKPGIAPYACDARQPSSRITELLMPLGKRMHESLTLLTRVL

SEQ ID NO: 5525 - protein, 207 aa, Chromobacterium substugae
MPRASYGGPWREHHSDAPVVKPVRQSRHAPAALPRKRQVKALHTSIPNRYSLPGCRAARGCASWRHMEMQMSEKYTGQCLCGAIQYAAAAEPLFTGNCHCLDCQRSSGSAYIPAMVFPEAAVEIVGQAKYFATTADSGNTHSRGFCPNCGSQLFARFSAMPGLLGIKAGTLHDTSRYAPKLDFHVASAAAWDYMNPQLPKKPGPAQG

SEQ ID NO: 5526 - protein, 205 aa, Chromobacterium substugae
MNMPFAAWMRRLAPAALLLLAAHASAATETIVMIRHGEKPDQGLGQLTCQGLNRALALPRVLTSAFGAPDAIFAPDPATQVSDSGANYYYVRPLATIEPTAISLGLPVNTAYGFTQTADLASRLLASDYAGSTVFVAWEHKKIVTLAKQIFANLNQSANIPAWSGSDFDSIYVITINSSGSRRTASFSIQAQGLNGQSTACPGPN

SEQ ID NO: 5527 - protein, 538 aa, Chromobacterium substugae
MTVSKKILLLILLSILAQIGISAYSLHTQSQLADTATSFANVDYPSLINLGQFSNAVGTLRLAGLHELTSTTAADRAAARSKVGDAYQSAKAALGEYQKMINDDEDRGHFNDDGRLLDQYYAAMQPMLAAAERNNLEDALKIRADAVTPAGNALTKAISAHIDYNKRYVEKEVAEAQALIGSTRVITLATTAVLTLLLGALGLRTYLSITRPLHELNHAMNQIGERLDFTRQVKVHNAKDEIGNTAAAFNQLVQRIRHSLRDILHNCGKVAGYSADLGQAANHVQTAAENQNQASAFIAATMEQLTVSINHVGDRAEQSNQQSEEASRHAGNGHQVIAKTVEEIRSISDTVGHANTSLTELEAQNSRIANSVGSIKDIADQTNLLALNAAIEAARAGETGRGFAVVADEVRKLAERTAILTSEIDQVIRGVTDTSRQTTSRMSETQQLVASGVVCADEAMTAIGEIGKSSGTAMQMVSEITDAIREQANACNSIANQVEKIAQMATQSSAAAQQTATTAQQLDKAVLAMNEAVKRYTL

SEQ ID NO: 5528 - protein, 655 aa, Chromobacterium substugae
MASTTDLPQHPPSGSGSAPDPGQPFTLPDFIQLRADGFFVATELLSGAEAFRQAIDQIFAAGFFLSGLDYPKLCYYLYDFDAANAGPGQRIAQCILSFAEERRALYHAVIQVEAGVEYLFEQVFLTRNVATPVYGRDPAGQPMVVGQREESQTLPSRLEFDEMVAHLWQQGIRFGLNRAVIDDCLAQRKVGRFLIACPQPPVPGVDAGVQEKTAAIRRDDHPRKLSGGRVDLTQFQNRYPQIKANTALLMKTPSVPSRPGRGLDGCVIPIAAPRDFDLATLAGEGTEVREMEGQEFIVAVRDGFLSIDAETNQIAIVDKIVNREGVSVRTTGDLALQGDEYEEHGEVQERRIVTGKNLTLCNDVYGTVRSTGGRILLKQNLVGGAALNDDGPISVEGMVSNAQVRAERGDITIQRAENALVIGRQVRIAEASRCVIVADEVDIDSAMGCAIAAKSVRIARVGARASQETAISILLPDLSAFAARQDWLEKRQQEGAQKTATAQQAVAALMGDETVKRYVGLAARLKKGELQLSAEQQAGWKRLSEQAAPKLKQLNQLNAMLKALQDEQADFRSQVGALAEERNDAISGIRCRLEELSGETVVRSLIRPLNAPALASLPLEQLRTRLRAADDQTKELFSDSSGCFTWQYSARFASP

SEQ ID NO: 5529 - protein, 41 aa, Chromobacterium substugae
MGLASLAASARTVRLMIILMQKECRRLARWTAPRAGRAKPA

SEQ ID NO: 5530 - protein, 155 aa, Chromobacterium substugae
MKQDFVIRAAQTGDYAGWRPLWDGYNAFYGRAGDTALPEAITAQTWARFFDPAEPVDALLAEQDGRIIGLVHTVIHRSTTRLADVCYLQDLFTAPEARGRGAARALIEAVYRQAAARGCNRVYWQTHDSNRAARALYDKVGENKGFIIYGLELPA

SEQ ID NO: 5531 - protein, 407 aa, Chromobacterium substugae
MTSIQKTHDQILAAAPSRADQPGKALTFLLAAGAGLSVASLYYSQPMLGILAADIGAGSREIGLVPTLTQLGYALGILLLAPLGDRHDRRAIILAKAALLVLALLACSMAPSLPWLLAASLAIGLTATLAQDIVPAAATLAHEQRRGKVVGTVMTGLLMGILLSRVVSGVVAGHWGWRSMFMLAAGGVALIGVSAWLWLPKFAPTTALPYRQLLASLWALLRRHASLRQAALAQGLLSMGFSAFWSTLAVMLHAAPFHLGSAAAGAFGLAGAAGALAAPMAGHLADRRGPAVVARLGAGLSALSFAAMCLMPLLDPVAQLWLLGLGTVGFDLGVQASLIAHQTIVYGIDPGARSRLNAVLFVSVFIGMAGGAVCGSMLLAQWGWLAVTTLAALLALASLAVRWGRWQ

SEQ ID NO: 5532 - protein, 334 aa, Chromobacterium substugae
MGRRADLLYILRMKKPIISDLYPQPGVSLPASAGDRLELMQTFVRIVEAGNLSAAAQQLGTTQPTISRRLQALEKSLGMKLLQRSTHSMRLTDDGERCFARAKELLAGWAAFESDLRGAREEPEGMLRVVAPHAFGQERLVRPLADYLQRYPRMKVEWLLHDDSAAQDFIAAGIDCAIQVGEVTDSSLVAIKLAEVPRIVVASPALLAGGPIPQTPAELAGLPWLALRTYYRHEIRLRRVDGEEEARLPIEPRLSTDSLYALRSAALMGLGVGVGSAWVMTEDLAAGRLIQLTPDWQAAPLPVSLVYPYSRFYPARLRGFVEVMRAALPDAIRD

SEQ ID NO: 5533 - protein, 200 aa, Chromobacterium substugae
MRFGWVVWCLTLWLTGCAGWPADGGGYIVIADKAIAPGEIGVGGAAISTDPEVWIRDVYFNGSYMMVVNRYAGEQENADVYDIRDSKSFNGSTFQRIHTDTCCYGLPRQWRPGLQALVEWTQSPARPGGQPQAPTPHRVLLNLPKYDDPASLRLVFLPCGDLTAVIDYQLRARVFLTDPPKGPAELARRLGGRTRCEAGG

SEQ ID NO: 5534 - protein, 182 aa, Chromobacterium substugae
MWLTVCAGLAACQTPESAKRKLVSATFVNVDPSSQVLFASFDGNSVCSSSGDTCSVWLPEQWQPGRRAIVKWTQDPSPERNADGSKRPPYGPGGTTTRELDHWRDMHDNNRVLLALNVEVPRYASPYHLELVFLPCKRVAVLIDAADIRRVMGNLPGGQAYEAEIRRRLGAAGDCQPPRAGE

SEQ ID NO: 5535 - protein, 429 aa, Chromobacterium substugae
MKRPQWSRRQLLAAGGAAGAAALLGSLRPGERGSPHDGYFRQLSAALRAAGIATPTLVLDRERLRANVGQVLRNLNGRIPLRLVVKSLPCPALLREAAALAGTRRHMLFSLPQLLAMAEGDHDILLGKPLPAAAALAFYRGFPPGAFQPERQLQWLVDTPQRLAQYRELARAQRLRLRVNFEIDVGLHRGGIAGGDEMRAMLDILRSEPRLQWAGLMGYDAHVAKLPDLPGLRARAHAHARQAYAGFAEQIKAWPGLMAGSGSPCFNAGGSPTYRLYDGSGVENEVALGSALVKPGDFDSALLADLLPACFIAAPVLKALPRFQLPYGVEWLGGLLRAWDVNARRAYFLYGGNWLADPVSPPGLAGSALYGASSNQQVLLGSGRQALKVDDTVFFRPRQSEAVLQQFGAIAVYQDGRIVEMWQPFPATA

SEQ ID NO: 5536 - protein, 460 aa, Chromobacterium substugae
MKPAAVTRRRWLQLGGAAMLAGLAARPGAPAAAKPAGAYLWRSWSGLNQCRAQALATPADEAELAALLRGGGPLRCVGSGHSFSPLVPTGGRLVSLDRMSGLKTQDQQALTATVLAGTRLSQLSRQLDGHGLALRNLPDVDAQTFAGAISTATHGTGAQLPALHADVLSLRLLTPAGEALACSLERQPELLQAARVSLGCLGVIVEAGIRVVPAYSLRRRLWLKPVGEMLEAAPELARRHRHFEFFYLPFTGYAAAITHDISADGAVSHPDSQDEDMLRELRRLRDWLGRAPELRRWVARKLIDPGLVEQARDKSWRLLSTARPTRFNESECHVPREAGIACARAVISRLERRNEVFFPMEFRFVQADDAWLSPFYQRDSCSIAVHAAAGEACDYLVSDIAPIFRKYQGRPHWGKLHAHQAADFAALYPRWNDFLQLRRELDPDGRLLNPHLRRVFGIRT

SEQ ID NO: 5537 - protein, 127 aa, Chromobacterium substugae
MPIPFALDARRALSVGALLCLGACQDGKPQSADLQKAETLRPADARLAEKYERSCLGCHGAAASQAPLTAFAAAWAPRLRQGMPVLLAHARDGFKTMPAMGYCNDCSDEELRRLIVFMAGAAAGARS

SEQ ID NO: 5538 - protein, 47 aa, Chromobacterium substugae
MGISNSLRMAGAQRSRTKPEHRASAPAGPQHKGQVRPPPGPPTPYSP

SEQ ID NO: 5539 - protein, 325 aa, Chromobacterium substugae
MTIHPADGYPHTSKHYAYSAGDRARQCFQFVRDIDAAMRANYSANIEAIGRNIYPILFAESTFDGGRYTLVVNPDIRHVKENVCPIYDQCKAISHIPLGIYSILSAYQCDSTLQQWAPALAAYHDQIQHVHDHLDELEWPDAGIRQANREILHASLHFIRHTLERGRYDMEEFSHYSRKLTAQIVLNQTTAAQNQVRVMSDTLREWKAMLGDRWRDLYVVVSALWTLSQESAHEEIIGAFMDEDRRETHMIVSETPHSVDDAQALLGRIVGDRIMAEMVFSPHGTETEKENIYSLSTKRDLLSQAIEKAIAEGAGGTAVCPHLSR

SEQ ID NO: 5540 - protein, 141 aa, Chromobacterium substugae
MKHVMTAAALIAASLTSLPSQAADVGVSISVGQPGFYGQIDIGGYPPPQVVYPQPVIIQPVPVGLPPLYLRVPPGHMKHWDRHCREYHACGRRVFFVRDDWYNRVYVPHYQQRHFPHHDGYEHRDHHEEHRDEHRDYPRDR

SEQ ID NO: 5541 - protein, 335 aa, Chromobacterium substugae
MPTRHAVHRRLLPALLLLAPSASALACASCGCTLSSDWESQGFATQPGLKMDIRYDYLNQNQLRSGSGTITPAAASQLNQGNQEVEQYTRNNYLTLGFDYAFSPAWGVNVQVPYIDRSHSTLGTGSDGANAASGGGAYDSSTSGLGDIKVIGRYQGFAAARNFGLLFGLKLPTGSHSETGVSTDPANPGAAAPIDRGLQPGTGTTDAIVGAYYYGDLGRSWSYFTQATVQSALDSANQYRPGTGVNLNLGVRYAGFSGWMPQLQLNARYVRHDAGDNADTVSTGGTLVYLSPGLTVPLTRRASVYGFVQLPLYQHVNGVQLAPRYTTSIGARYAF

SEQ ID NO: 5542 - protein, 1450 aa, Chromobacterium substugae
MGGRMTARKNGLTWVVTSAYAVIASIWIIVPDVLVDTDRAIGGVVGGLAWDGLFTFVSAALLYLALRQLPEESLSKLAPPGRLPRWLAARPRHQPAALALGYALLTLLMMTMPDWLQSGMASRQWQVRLTLCWDALYVAATAILLFHGLRRLRRPGDEVAGRRHGSDYLFAIVSSLLVIGMRAQLHPEFGKHHRMLLFLIPISLSALLGGVGPGLLSTGLITSVIGYLFFTSTPDMAGSPMSFLLSLSLLALNGVLLSLVSEIHLQGKAKLEAALRRQSADAEALRQSDERFRALFEGSPVAMAISRLADGLLEEVNEAFLDMFGLEEQAVLGRTTGELGIWQDVADRQAIVSALREQGCVQGAPVALRRSDGSVLYALLSFRQVRFGGGEHIHGVVLDVSAQHAAQQALLRIEHEFRLLIDSITDYAFFLLSPEGLVLNWSNGSQGIKGYTTEEIVGRSFDCFYTAEDQAAGVPQQLLANAAQQGRDVHEGWRVRRDGSRFWARAILYAIRGDDGELQGYAKVTQDLTLQQAAERELRDSEARYAGMIRSAMDGVISIDAGQRITLFNPAAERMFGYSVDAMLGQPLDRLLPPMLSELHRGKVEAFGRGMASSRRMGGQGKIQGMRAGGELFDLEASISRLEVAGERSYTVILRDVSERENTLAELRRHLQQLESMNELARAILAAGMPEQVAQLGLRYLRRLLPFWGATAMIVDWEAGATRVLAVEREPGASYDPGQRLTLISYGLEDLERLKKGLVCRVDDLDALPRRSSTLERLRLQGMQSYIRIPLMAAGELLGMMNLASDKLGAFSEAQQEVADVFAQQLAIALQQSLLRQSVERLGRVYRLLSRVNTLIVRCHQRRELFDGVCRIAVEDGAYRMAWIGVMDPQSGDGEVAAFCGEDDSYRALIRLSARADSPFADRPACRAVREQEMVVCNDVQADPSLRALARDLMARGLRAVACLPIVTDGRAQAVLALFSEASGAFDRQEVQLLRELSGDIAFALSHIGQTERLDYLAYYDSLTGLANRGLLAERLAQRITDAAERRFAIAFLDLEHFKSINDVFGRVIGDQVLQRFADRLLRHVQDASQLSRIGADQFALILPQAGGEEEAARQVQKLQLECLDAQMEIGGAELRLSAKFGIAMYPDDGAQASDLMEHVESALKRAKAAGAKSLFYRQEMTERAAAALELGNLLHAALARGQFELHYQPKVEANSHHLVGVEALLRWRHPERGLVSPEQFVPLLEELGLIVEAGRWALEQAARDHRGWREAGLASPRVAVNVSPRQLGQADFVAMLAEVLAPYGADHGIDLEITESQIMEDVDGGIAKLREARELGVAIAVDDFGTGYSSLAYLARLPVQALKIDRSFVMGMLDEPESMTLVETIISLAHAMQLEVVAEGVENAEQARVLAGLNCDVLQGYWLSRPLSADQLADKLRQERRWASPLKRG

SEQ ID NO: 5543 - protein, 936 aa, Chromobacterium substugae
MAQQADDKSTASSGLNLRDVFLIAVILGLLIPASIISYLSFNIQKDNLTTQLETDQRRLLDIVALGMQEPLWNLSRQAGNPLISSVMEDPRVISIRVTDTQSNQVFLSSVRSERRIGSVSYVEKPVIYRGEAIGQVTMEFDNENLAIALSNQVKNILMILAAQLVLSIMLIMSILHSRFLSPMRLLTEQARLLAELKLDTPFEWSRRDELGRLGTHLEWTRSELKRLVDELRAKTLALEADIARRREVEDALRRSENKYRELFWSNLDGIVISSLDGQVIDANPAFLNLMCYSLDQLKQQNFWSLVAEESEALERFNLDNKVLRFGYCDEFEATYLNRFDNQVPVSVKTVAMRDAFGRINAVWRMVRDISEKRAAEERVQLAAKVFENTVEGIMITDADRRIRSVNRAFTEITGYTQHEVLGQKTSILSSGRHDQPFYDQMWQAIAEDGSWQGELWNRRKNGEVYPEWLAINAVRNSLEEITHYVAIFSDLTERKAADERIQFLAHFDVLTSLPNRMHMQDRVELAIHNAVRDNQRLALLLLDLDRFKTVNESLGHSAGDTLLQVAADRIRTVLGPGEMLARQGGDEFIVLLPLVSDPGEAALAAERVREVFANPIELHNHVITITPSIGISVYPDDGRDYETLVRNADAAMYHAKSSGRNSYKFYTADLNARAREILAIESQLRFALERDEFVLHYQPQVEMQSGRIVGAEALIRWNHPSLGLLGPVRFIQVAEERGFIVQIGNWVIGEATRQLVAWRQAGLPELTLAVNLSALQFRQPDLAEQLQHALASSGLPGHALDIEVTESIIMEDAQATIQTIDNMKNMGLRLSIDDFGTGYSSLSYLKRFKADKLKIDRSFVRDIPQDADDSAIARAIINMAKNLNMQVVAEGVETMEQWQFLEQEGCDFVQGYLIAKPLPADDFAALLTRDSLLPQS

SEQ ID NO: 5544 - protein, 439 aa, Chromobacterium substugae
MPQSRYEKIISARWIITVETDGEVLENHAVAIKDGRIAAIIPAAQAAGLDADERLELPDHVLMPGLVNLHGHSAMTLLRGLADDKALMDWLTNHIWPAEGKHVHDDFVFDGALLAMGEMIRGGTTTINDMYFYNAAMARAGLASGMRTFVGCSILEFPTNYAANADDYIAKGMAERSQFLGEDLVTFTLAPHAPYTVSDDTFRKVVTLAEQEDMLIHCHIHETADEVNNSVKEHGQRPLARLQQLGLLSPRLVAAHMVHLNDAEIELVAKHGLSTAHNPASNMKLASGIAPIPKMLQAGIAVGIGTDGAASNNKLDMLAETRLAALLAKVGTLDPTSVPAAAAIRMATLNGARALGIADKTGSVKEGKDADLIAIDLSALETAPAFDPISHVVYAAGREQVSHVWVKGRALLAGRKLTTLDESNLKTRADDWRNRILAK

SEQ ID NO: 5545 - protein, 233 aa, Chromobacterium substugae
MSNVDELEIDKFSQLAHKWWDKDSEFKPLHEINPLRLDFIDRHASLAGKKVLDVGCGGGILAESMAQKGAQVTGIDLAKKSLKVAQLHSLESGVPIDYRCVAVEDLAAEMPGAFDVVTCMEMLEHVPDPQSVVRACAQLVKPGGWVFFSTLNRNAKAYLLAVVGAEYVLNMLPRGTHEYARFLKPSELGRMTRHAGLSLQTLSGMGYNPLTRIYSLNDDTAVNYLMATRLPAA

SEQ ID NO: 5546 - protein, 222 aa, Chromobacterium substugae
MTFKANDLLTEQIAQYLGKQIIQGDMQPGERIQELRIAAELEVSRGSVREALLILQRRHLVDIFPRRGAVVASIGARDVRDFFDLWFLLLDRVAQNLAAGWQNDDLARFIELMAQLEEDNRRDDLQAFYEHGIEFLSALYNHADNRYLTDTLNDMLPLTQRCLYAILRAGKSQMDNTYRFLESLLKTLIARDTSRLKQMVATFGQEYSQLAQTAAEALEGRR

SEQ ID NO: 5547 - protein, 165 aa, Chromobacterium substugae
MTAQNKPRLTLVAAMASNRTIGVDNQLPWHLPEDLRHFKAATLGKPVIMGRKTWDSIGKPLPGRRNIVVTRQADWRADGAEVAHSLEEALALAGAVEEVCLIGGAELYRQAIAVADRLCLTEIADAYDGDAHFPEFSAADWRQASREEAVSAGGLAYAFVNYLRR

SEQ ID NO: 5548 - protein, 264 aa, Chromobacterium substugae
MQQYLDLMRHVMEHGHDKADRTGTGTRSVFGYQMRFNLADGFPLVTTKKCHLRSIIHELLWFLSGDTNIRYLKENGVSIWDEWADENGDLGPVYGYQWRSWPAPDGRHIDQISQLLGMIKKNPDSRRLIVSAWNPALVDQMALPPCHSLFQFYVADGKLSCQLYQRSADIFLGVPFNIASYALLTMMVAQVCGLQAGDFIHTLGDAHLYSNHLEQAQLQLTREPRPLPTMKLNPAVTDLFAFRFEDFELQGYDPHPHIKAAVAV

SEQ ID NO: 5549 - protein, 369 aa, Chromobacterium substugae
MAREDGNIPRSRELSTFAVTMAGVSLLMNLGGKIGTFLGDTMRHLLTFDQSTVQSTEPVLLRFKEAIFGALWQLAPFFAGLALVALFTPMLVGGWNLTLKAIGPNFGKLNPLPGIKRLFSLNAVTEGFKAILKSLLIGGIATWYIWRERGEVIGLLAMPLESAILKMTDLIIHTFFIVASAMILLVAIDVPYQLWSYYKKLRMTKEEVKQEYKEAEGSPEVKGRIRQMQREAARKRMMQEVPKANVIVTNPTHFAVALKYDDTMRAPQVVAKGSLKLAEKIVDTGKGSHVPVMRSPSFARALYFNAELGEDIPAPLYAAAAQVLAYIFQLQQYQAVGGLAPVFPDKLEVPAELDPYSKRPQDSAPEESL

SEQ ID NO: 5550 - protein, 693 aa, Chromobacterium substugae
MDSILQILRSLKISQLAGPVLIILILTMMVLPLPPVLLDIFFTFNIAVSVIVLLVGINVRKPLDFSSFPSVLLVTTLLRLSLNVASSRVVLLEGHTGPDAAGKVIESFSHFLVGGNVAIGIVVFVIITIINFVVITKGAGRIAEVSARFTLDAMPGKQMAIDADLNAGLIGEDEARKRRSTIAEEANFFGAMDGASKFVRGDAMAGIMIILINIIGGLIVGVVQHDLPAGQAAETYTLLTIGDGLVAQIPALIISTAAGIVVSRVGTEQDMSEQFLTQLFTKPQVLYITSAVIGMIGLIPNMPHLSFLLIAGALLLLARMMEQRRLRDLAREQQAAQPPAPPEQQGAEVSWNDVQHVDQLGMEVGYRLIPLVDRTQDGELLRRIRGIRKKIAQDLGFLVPPVHIRDNLEIKPNAYRILLKGVELGKGEAYIGQFLAINPGRVSKEIAGNATTDPAFGLPAVWIEAGKREEAQSLGYTVVDASTVVATHISNLLQTHSAELLGREEVQALIDHQAKESPKLIEDLVPKVVPVGTLQKVLQQLLNDGIHIRDFRTIVETLADHIGVTQDVDELTGSVRTALSRVIVQQLFPGEAELPLMTLEPQLENVLMQAVQSKAGGGLEPGLAENLLSSAAQQTEQVEIQGYNPVLLTAPGLRPLLARFLRRALPQLRVISHNEIPDNKSIRIIAVIGGSKG

SEQ ID NO: 5551 - protein, 492 aa, Chromobacterium substugae
MVVKKFFGKTTRDALRQVREELGADALILSNRPTMGGGVEIMAVADADVANLASTLSTSSSKHPPRNAPPAVNRPQQPAPIPPNGSAVNRAIARTYAMPVEPLESPAAPRLESAPRPRMEPVYAPPEPAQAPPRQSAQPVRPAAAPQPAQARPAARPPQMPASPPPTLSHANGEEPEQMAQELRQIGDEIKLLRSLLQSQLASFAWSDMEGKAPNRIELFKHLLAMGFSAQLIRQLIEKMPAQYQAEVAVKWARSALVHNLKCADADREVMDRGGIFALVGPTGVGKTTTVAKLAARATMRFGAQHVALITTDSYRIGAQDQLRIYGKILGVPVFSIQNEGDLQLTLADLSNRHIVFIDTVGMGQRDARVLAQIDMLRTAGRPIERLLLLAANTDGHTLEDVVKRYRGDGLAGCILSKIDEAVAQGPSLDVIIRNRLKLYFITNGQRVPEDLHSANAAFLVDRAMRAQQIGSPFSLQADELPIMQAAQAGWL

SEQ ID NO: 5552 - protein, 292 aa, Chromobacterium substugae
MNAMTDQAASLRLLAAQQNRAPSFAFIGSERSGTSTVVTELALGLAYAGLRPLVVDCCLGQVQTRRLGVPATATLESQVVNAGGLDDMMITSRQGVQLVNLYARPEQRALFSAQLWLRLGSEFGAQERDASALLIDVPNPGLDAIPASVADNLVLVLTPAAESLTAAYANIKRLASLYGRQRFNVLINRARHLDEARELFTRLSAVTSEFLTVSLRWVGFVPQDSAVRRSQTLHRPMMEAFPDSEAAAAFSQLAAVLLHWDAPETTRDNTGYMDLLIAASRDWAEADGAKPL

SEQ ID NO: 5553 - protein, 246 aa, Chromobacterium substugae
MNPSFRRSGYANAAPSVEIDVEAHAPLVRKLASIMIARLPASVDLGDLIQVGMIGLIEAARQFDPAQGVMFETFASQRIRGAMLDELRREDWLPRQARRQARQIEEAIARLEQQLGRAPLESEIAAELGVELEQYQDMLGECKGTTLLHFEDFASDDENPHNPVANVADDDSPDPLATLADDSFRQHLISAIKFLPERDQLVMALYYEQELNLKEIGAVLGVTESRVCQLHSQAIARLRAKLKDWL

SEQ ID NO: 5554 - protein, 249 aa, Chromobacterium substugae
MDKISLIAIILGLTAIVAGQAIEGGSLGSLMQLTAFMIVIGGTTSAVMLQSTPKQFMAGLRMVRWIFRPPNFDHEKMIREVVNWSQTSRKGGLLALEGVINQQRDPFTKKALQMLVDGTEPDTLRAVMDVEISMFEHARKQAARIWESAGGYSPTMGILGAVLGLIHVMENLSDPSKLGGGIAVAFVATVYGVGSANLFFLPVGNKLKHLVASELAMKELVVEGIVAIANGENPRIIESRLRGFLAMHE

SEQ ID NO: 5555 - protein, 471 aa, Chromobacterium substugae
MDRLNTLFEQPCAIVDLETTGGNISRDRITEVGVILIDGERVERHAWLVNPGQPIPPFIENMTGISNEMVAAARPFAELAEELLARLQGRLLLAHNARFDYGLLKNEFRRHGLRFQTRALCTVKLSRRLYPQHFKHSLDSLVARHGIDMPERHRALADAEAVYRFLRIAEGELGQGRLAHEAEQLLSQPAELGDLAPQLQQQIEELPDSAGVYALFGAAGEALYVGRAANLYRKVLGHFAKAKPGHKSHEVRIDEPVARVEWRESLGEFGAHLQELQWLRAYQPLHNPRARMLSEACSLQLRVEEDGFARLRAVSAQDIDFSRTTDLYGLFRHAREARKALAQIALAQGLCQAVLGVEQVTSRKGVACNAYSLNRCRGACVGKEGADSHNLRLVSALQRLKVRQWPFEGAVAVVERDEVCGDVVEHLFDRWCYLGSRRNGGELDGEPAFDLDYYKLLESELRKPERELAAQ

SEQ ID NO: 5556 - protein, 153 aa, Chromobacterium substugae
MIFAIGLSELLKNDPFVMSAIQIAGVGYILYLAYRQWTSKGVRMEVAGLSSDMRFGQLFIKGMLTGFSNPKTILMFSAVFPQFAGRAGSRAADIAILGLTFLLLQFASGCSYCYFGQRIKHVLDQPRRQRLMQRITAVLLLGVAGMLVNSFAA

SEQ ID NO: 5557 - protein, 472 aa, Chromobacterium substugae
MPISPIAFHPGSPKVQQIVESLSEAILQGTIPAGSKLPSIRELTRLFGVGKFTVIDALDRLRGCHLVSSRQGRGFFVSPLNAAPTAAPLADLMPQDLISILRRSLIADNGAMRPGSGHLPESWLDTDAYRQAMRATVRSPLLRISGYGSPAGYLPLRQALQQRLSLQGMTVQLEQIVTTANTVQAIDMLLRLLLRPGDTVLLDDPCYFNFHANLALHGASVVTIARNTGGIDFDQLETLLAARKPRIYLTTSLLHNPTGHSFTPAQSYRLLQLTKQYGCHIVEDDLYGDLHSSPPPRLAALAGFDHVSYLSGFSKVLSANTRASYVVTTPDLSAKLCHLKLMSGGITSELLEQLLCRMLTEGSYGKHRNRLVVRLLESGSRVAEWLRQSGCEPAHSFDGGMFIWARLPAGIDAEELAQRGLEQDLVLAPGTLFSRNPDARRFMRFNVASSDDAGVAHRFAMLLSQARAASRV

SEQ ID NO: 5558 - protein, 901 aa, Chromobacterium substugae
MRIQHKINTYVIPALLGLAAVPAMAAAGDADSAALERVTVTGSRISRSAQEGPTSVTVLTGSDIEKQGYTNVYDALNSLPQNTGFTQGADFGNTFTPAANAISLRGLGPNHTLTLINGRRVADYPTAYDGSVNFVNLANIPAAMIDRIEILNGGASAIYGSDAIAGVVNVILKKKTDGVDVNVKVGASEHHGGENGRLQLSGGHSWDQLSLVYGLELSQRNAIWSNQRGFMADNSSDGSAPTTIWSQQIKQGPNKGKYIGAGDCSAFSSLFNGSVRPYTINSRTGNGVVCASGQASPDYWTIQTANQSQNGYLSANYQLNEHAELFSDALLGFNHTENNTRGPAWTSLGGSSQYFLNQNTGQYEQWTRRLAPEEIGGATVYNRKWDDLSANLTFGVRGDLPGTSWNYEAAYNASIYTSQQAAPRLLSNVDSFFLGPQLGTDSNGIGIYAPNAAHFAAPITPAQFNSIVGRSFEQDKSWLQALSLSGSGDLFKLPAGAVKLAGALEWGSQGFSNDPDIQLGQGVFYRASPGSHAGGTRARQAAGAELFIPLHKRLNVTLSGRYDRLAIADSSVGKFTYGSGLEFRPLDTLLLRGNYATSFRAPDMNYLFLTQSRGYYPSVTDYWRCQQAGQPTATCDYKDLTANFVKSGNPDLKPENGKSYGFGFVWSPSADADLSLDYWNISINDLVTDLDQDKILRDEAACRSGQLDSNSSLCQDALRRVQRNPANAVLDPGAINQILTNPINAANERTSGIDLNGKLRWRTAKWGRFQLQASYSQVLTFTYQQFAGDPTQDRLQDLSNSDWRNKLSASLGWSIGNWSSTLQLTRYGKVPNNAQTGYLTPTILANLSLGYQLSKQTSLGLIVNNLQDFIKKDYSDGSPFYPVGTYLPYGRQAWLELNHHF

SEQ ID NO: 5559 - protein, 443 aa, Chromobacterium substugae
MGRHVRLCQFSLAFIDILWSESKLDISTILKQEARMALIVQKYGGTSVGTTERIKNVARRVAKWKAQGHDVVVVVSAMSGETNRLIALAKDIQDYPDPRELDVIVSTGEQVTIGLLAMALKEIGVPAKSYCGWQVKVVTDQSHTKARIQSIDEEVMRSDLKEGRVVIVAGFQGVDEEGNITTLGRGGSDTSAVALAAALKADECQIYTDVDGVYTTDPRVVPEARRLKTVTFEEMIEMASLGSKVLQIRSVEFAGKYKVRLRVLSSFEDEGEGTLITFEEDESMEKAVVAGIAFDRNEARINVKGVPDKPGIAYQILGPIADANIEVDMIIQNVGENGTTDFSFTVPRGEFQRTLAILREVQTHIGAAKIDADDKVAKISIVGVGMRSHCGIASTMFRTLAEEGINIQMISTSEIKVSVLVDEKYLELAVRVLHKVFGLDQAA

SEQ ID NO: 5560 - protein, 304 aa, Chromobacterium substugae
MTAPVQPWRWIRLEIGLVVNGGIQYALFIDHPLFWPALGLTTLLLLLLLLWPRSLPAASRPPPRDIGSQAQYWRDVAGHVYALLPLWAGHIALGREQIDEAAGRLTGHCDNMLRQLGYQAPEPADAAAEQKTADAPPLGAPSGLSPPDRMLMPMLKQLQQSALQLEALAQARENSQPDGQIASQVGNLLRQLETLERDSQPPPGQKRDGNAAGFDLRAAAEDTLTQLQFQDRVNQILSHVQNDIWQLEAMLHEALSSEDELPAPPDTEAWLSALKSSYTTHEQRALHNRDGGDRPPGPSDITFF

SEQ ID NO: 5561 - protein, 122 aa, Chromobacterium substugae
MAKTILIVDDSTTLRQVVRMTLAGAGYEVLEAGNGKEALDILDGRKIHLIISDVNMPLLDGIGLLKHIKQLSSYKFTPVIMLTTESAEEKKREGKEAGAKAWVVKPFQPPVLLTAVAKLILP

SEQ ID NO: 5562 - protein, 91 aa, Chromobacterium substugae
MPLAIRAGHEQTIYQAAQLRAQLAGALRDGAGVTLDLSAVEEIDCAGAQVLLWLQREGIRLGQPVALLSPSRAVRDFVQLMGLQRELRLEP

SEQ ID NO: 5563 - protein, 711 aa, Chromobacterium substugae
MDLEQALQTFLEESRELLADMESTLLDIEAEHADAEQLNALFRAMHTIKGSAGLFGLEEIVNFTHQAENLLDQLRDGHLRLDDELVGLLLRCHDHVKLMIQALAAKQDLTALRDEGLLAALRDYLAHPQAPPAADSADIEPPPAPASSRWLLSLRFGPDALRNGLDPSSFIRYLASIGRIEQIEAICCALPDGDAFDPESNYLRLEALYHGEQDEKSLLDVFEFAREDSAIHLWPLALVQPSLPDACANAGAEETAAVRQAWTRFGVLEPIDAAADAQPEPPGHAPLPAAAETAADGEARSAKPAESRFIKVEAGKLDNLINLIGELVIAGAAANLIARRAQQTPLVEATLTIASLIEQIRAGTLSMRMVQIGEIFQRFPRVVRDVSRELGKDIHLHIVGAETELDKSMVEKLGDPLLHIVRNAIDHGIEATDLRQAHGKPAQGNLWLNAYHESGSVVIEVADDGGGLDRRRILAKARERGLLGPDDEPPDSAVFQQIFAAGFSTAEQVTNLSGRGVGMDVVRRSIQQLHGTIDIDSEPGRGTTFRIRLPLTLAIIDGFLVEVAASTFVLPLEAVVECIELPDGLPANGVHDWINLRGELLPLLHLSSFFELPAKAAPRRNVVVVHYDDRKAGLVVDALQGEFQTVIKPLGALFSTLKAISGSTILGSGEVALILDVPSLLRHACRKEAEHFPPPDGAAARSHAPLPGNAR

SEQ ID NO: 5564 - protein, 530 aa, Chromobacterium substugae
MTAFSGMRIATRQALGYGAVILLMLLCIAVALQGFGNINSAVHNITRVNNVEARLAHQLLESNQLARLEIRNGLLASNRGELERAGRNLQDALRRYQEAERQLAQMFQREAGTNARERELMAAIQNGSRDAHQDYLQALALVGQQKPRDARALLAGKGGRLNEQISALADVEDGLNEELARQSAAAYQASRGRMLLLAALAVAASLLIAAAIRRNLLRTLGGEPQAVAGVMREVANGNLQCGIALRPDDQTSLAASIAQTIQTLGAIIGEVKNGSESLSVASQHIHATSQMLARSASEQAAGLEQTSSSVAQMSASINQTNDNARLTESMAEKASREAGQGGEAVQQTIRAMREIAERIGIIDDIAYQTNLLALNAAIEAARAGEHGKGFAVVAAEVRKLAESSQVAAREIGALARDSVLLVDEAGGLLEEIVRSSRRTSDLVQEIAAASNEQSDGVGQISLAVQQLNQTTQQNASASEELAATAEEMNRQAENLHDLIGFFHLGALRAGVDARGTPAAPEAAARGRMPF

SEQ ID NO: 5565 - protein, 181 aa, Chromobacterium substugae
MAALNILRRADSDAAEAEAAELRQFLTFQLAGETFAIGILRIREILEYIRPTSVPLMPPFIRGVMNLRGAVVPVIDLSLRFARDETAIHRRTCIVIMEVEHEEQWQLIGVLVDAVHEVLAIPDDAIEPPPQFGSKIRVDFIEGMARLDDHFVVLLNVDKVLSVHEMSLLSELSRQEEAEEE

SEQ ID NO: 5566 - protein, 541 aa, Chromobacterium substugae
MKHFSIRHQFILLTTGVLLGLGCLTATAWQGLRTVMINGDMYRQVVLGKDFINDLDPPTLELQASFLLANQLRGAMDPSIRQQLLNQMQAQRAEFYDGLKKWEANPLPAEMRATLAQKVQPSGDAFFQEVDTRFLPALDAHDQLAINLSFDRLAAQYDRNHQTILPLIEQTSRMQRQMEDEAQRITSQTFAWLAGVSLTVLLLLAGFLLLIYRQLIRRLGGEPRDVARATREVAAGRLDIELAPAPEGSLSEAIRLMCLQLRAIIGEVKTASDGVASAAQQISSTALALSQGASSSAAGLEQSSASIEQVSASINQTSDNSHTTEAIAEQASAEATEGGQAVQQTVQAMRQIADRVGIIDEIAYQTNLLALNAAIEAARAGKHGAGFAVVAAEVRRLAERSQVAAQEIGELAERSVAVAEHAGRLLKEIVRSSGRTADLVQEIAAATKEQAGGIGQINQAILHLNHSTQQNAAASEELASTAEEMTQQANRLQQAMDFFRLAASTAALPVAAAPAARADSAPPPAEPPAHDQEQLDDMFRF

SEQ ID NO: 5567 - protein, 196 aa, Chromobacterium substugae
MALTPPLPAAAPAPDSRPSATAAADAAGDAIFLHPGDWHFGGRGTRIRTLLGSCVSIILWHPQAQVGGMCHYLLAQRTNRRGEALSGRYGDEAMLLLLREILACGLPLQEFHARLIGGASMLISRERKLTHDVPARNISLARAMVKQLGLRLQAEDLGGNCPRLVLFDVASGNVWIKQSQEAELELVPPKNTRMRT

SEQ ID NO: 5568 - protein, 365 aa, Chromobacterium substugae
MSIKVLIVDDSAVVRQVLSQVFTEASGIEVMDVANDPYMAMDKMKLRWPDVVVLDVEMPRMDGITFLKQLMSSRPTPVVICSSLTQKGTDISMQAMAAGAVEVIAKPTSGVKGFLEESSAQLVMAVRSAAAARMNRVRVMPSASGSPTAAPSGSNPLETRPKLSADAILSAPTGSNVFATTERIIAIGTSTGGTQALETVLTELPRTCPGLAIVQHMPEKFTRSFAERLNSLSQIEVKEASNGDRILPGRALIAPGGKHMMVKRSGAFYQVEVVDGPLVSRHKPSVDVLFRSAAKFAGKNALGIIMTGMGDDGAKGLKEMHDCGAKTIAQDEESCVVFGMPKEAIKLGAADEVMALDMIAKAICR

SEQ ID NO: 5569 - protein, 392 aa, Chromobacterium substugae
MELDDILVIDDSKVQRQHALELCRALGAASVREAADGGQGLAMMRERLPSLVLLDLEMPGMDGVRVMQGMAASGLHTPVVVASSKDYLLISTVEMMGRELGLPVLGALQKPLRLDALRDLAQRAWTPDARMDGREFAPAELRAALDADQIRPSYQPKVDLADGALKGAEVLASWRHPQLGAIDADSFLPVIEQSGWATELTMQMLTQGLGQWREWARQGLRLPLSLNLEPRSLQEDGLVEQIERIIADSHVPVRFISFEVTETAIADNLSRAIGCAVRLRMAGVGLAVDNFGTGFAAMQQLERFPFTELKIDPSLVTSIGGKPHLQAVLNSIVELARRLKLATVAEGVQSQEDCQLMAERGCQLGQGRYFAEALPPDELLDWSRARTAAASK

SEQ ID NO: 5570 - protein, 329 aa, Chromobacterium substugae
MDTTLPPPFAALTPDAILDAVESLGLRASGSLLALNSYENRVYQVGIDDGAPLVAKFYRPQRWSDDAILEEHAFSWQLAEREIPAVPPLRLQGRTLHEHGGFRFALFERRGGRVPELDRDDTLQWIGRFLGRIHALGRVEDYRSRPTLDQQSFGREPADFLLQGGWLPPELGNVYRGVLEQALEGVARCFERAGQASQLRLHGDCHVGNLLWTDAGPHFVDFDDSRMGPAVQDLWMLLSGERAEQSRQLAEVLAGYEDFCEFDTRELYLLEGLRTLRLIHYSAWLARRWHDPAFPAAFPWFGGQRYWEEQILALREQIALMDEPPLWSC

SEQ ID NO: 5571 - protein, 86 aa, Chromobacterium substugae
MKPHLPPLSFHLDGDQLRHGSERWANLTLQGWLVLLDRGARRQAWRRLLEHRLNTRQLLQGFACWLSGSLVLLALAYLLYLVSTRW

SEQ ID NO: 5572 - protein, 310 aa, Chromobacterium substugae
MKHPHATESGDSAERQKTARASTLVSVAVNVLLSALQIIAGVWAHSSALIADGIHSLSDLLSDFVVLVAGRHSGKGPDHDHQYGHQRYENAASLALGLLLLAVGAGMLYSAANKFIHPADIPAVHSLALWIAALALVAKESLFRYMLAAAQKVRSSLLVANAWHARSDAASSLVVAAGVAGNLLGYPILDPVAALVVGLLVGRMGWRFAWDALSDLMDRAASEDDIAAIRATLLATPGIVGIHDLRTRKMGDMILVDVHLEVDGNINVYQAHAITEEAQQRVLRQHPVLDVMTHVDPAEHYRDGNMPVAG

SEQ ID NO: 5573 - protein, 93 aa, Chromobacterium substugae
MTIPFQSIPRWLLHALLLLPLLWQFENYAVSRAPFNGNPQPATISTWTEHWPADTPFLLVQEVRDQLRHADAKRDAGTPVRDVAAMPRPSDAS

SEQ ID NO: 5574 - protein, 88 aa, Chromobacterium substugae
MKRKWIAALGAGGAMLGVGAICQASPLPMSAGAPTLDSHGSASLAQGKQGAQGEADRLSRLRALVHNSSIHCSNPGCPICHPQPSASL

SEQ ID NO: 5575 - protein, 453 aa, Chromobacterium substugae
MLFSELGLSPEILRAIEEQGYSQPTPIQGKAIPLVLSGRDLLAAAQTGTGKTAAFMLPILERLKKFANTSVSPAMHPVRALVISPTRELADQIGENVKSYTKYLPLRATTVYGGMNMDPQTQELRRGVEILIATPGRLLDHIQQKNVQLGKVEVLVLDEADRMLDMGFIQDIRKIMGLLPKERQTLLFSATFAPEIKRLAADFMHSPQTVEVARQNATNDQVEQLVFKVDAFRKRQVLAQLIRARDMSQVIVFCKTKISADQLARDLKRDGLDAEAIHGDKTQGARLETLASFKDGELRVLVATDVAARGLDISELPYVVNYEMPNSPEDYVHRIGRTGRAGAKGVAISLMSPDETRQHEAIEKLTRQTLTPQSVDSFMPAQPPARAKPAAREREQGGDREPAAMREREREVPALTGNGEGLKQARPARRNRKARREVPALLLPPRYKVEIIR

SEQ ID NO: 5576 - protein, 306 aa, Chromobacterium substugae
MTLISLILALALEQLRPLGNRNRVWLLFTRYANHLERNLNAGAERHGVLAWLVAIVPVLLLSLLLFYSLKAASPLLALALNVLVLYLTMGFRHFSSAFSEISQALAEGRDLDARVALSNWTGLPTAELSVEEISRLAIEQGVLDSYRHVFGTMFWFVVLPGPSGALLFRLCSMLNQKWGSRNAAEDPFGVFAARAAAWLDWIPVRLTAAAFAIMGDFEDAIYCWRSQARTWGNYANGILLASAAGALGVKLGDPLRQDYSVKYRPELGLGDDADPSFLKSAVGLVWRSALLWLAVTLLISVASHMG

SEQ ID NO: 5577 - protein, 131 aa, Chromobacterium substugae
MLEQEQALLIQGEEHKLEALADNKSAVLDELARQSSVRGRLMTTLGVQDRDTLYIWLADKPPACEAWTSLEDAVNRAQSINQLNGSFVSERLAMVEESLLVLRTAAASTLGYDRGGNQPEVVTGRRLLGSA

SEQ ID NO: 5578 - protein, 98 aa, Chromobacterium substugae
MKIDNSGKLSGTYSTQSKTTARAPSSSTSSQGSSSDSVQINSVASRLSAIGNDPSQQPAFDAAKVESIKSAIANGSFSINPDKIADGLISSAQELLQG

SEQ ID NO: 5579 - protein, 220 aa, Chromobacterium substugae
MWFCGLLAAMPACADGIQNLVQLERLADQFLKHELELRAATWRLGQLDRRLALPACSRPKADWATPGVTTGATFVAVSCPDLGWSLRIPVSINEKRMGVALSRPMAAGETIGAADVRLVDIANPALASNVLDDLNLAVGQVLRTGAPAGAWLRTFMVRAPYLVRSNQQVKVLAQGDGFSAEAEGMAMGNAAQGEQVMVRLSSGRVVRGTVQADGSVAVIF

SEQ ID NO: 5580 - protein, 707 aa, Chromobacterium substugae
MRSRLTALALATALALPAAANAYSNIYYFGDSLSDVGAFGGQSGLPAGARWTTGYGPNWTNVLSGHFGLQSVANNPLNATTSSSGNNYAQGGAVAQTYQAITQYPNTSGSSGSVEQYGPGGTLLIQELPQQTAAYLASTGGKADPNAVYSVWIGGNDVIAALGTASSTSGQQLLGASAQYTAASVQALVKAGAKNVIVPNLPNMGAAPLAIYASLTAVQQTVNAQVPGLVTTTAVNNAWVAAWQVISAQNVGPSNSAAVIQAALTAANTSLSTATGGAVPAGSVATAYNGNGTAANPGVQPSLQQLAAGYNQLTDMTLSGAGVQHNIVRPNISLLFQEILANPGQYGFTNTIGSACATSAIQCAANTLPGQSYVFTDQLHPTPAAQQIIGDYVYGLLQAPYYAAALPDSALNNARQLGGALDSRYQAIRSQKRAVGTVSAFVDGAFNDDKIGYNNLAAKPKGQLYTLGLDYQASPALSIGVAMSRQQGKTDISSTGTPGSVDDRTTLMSGLVSYNQDKFWIDGDVHIGSGDLDTSRAVTLGPTQVQINGSTRQTQYGLRIGGGYRLQYGNFTTGPVAGLDYAHVKVAGFAEQGGSSSMAFGGQNASSLVGRVGWQLDADVGKFSPYAKVSFAHEFQQDDRNITAGLTSTLGDWTTNIGKADANWMEWTAGVSANFSKTVTAYGQFSVTSGRSGGNQTGGNLGVAVSF

SEQ ID NO: 5581 - protein, 469 aa, Chromobacterium substugae
MKYVSTRGGMAPLPFCETVLMGLAPDGGLLLPERYPRIDRATLDAWRQLGYAELAFEIIRLFADDIPADDLKGIVSRAYRAETFGSEAIAPLKRLHDGLAILELSNGPTLAFKDMAMQFLGQLFEYVLEKRGEKLNILGATSGDTGSAAEYAMRGKRGINVFMLSPDGKMSAFQRAQMYSLQDENIHNIAIQGMFDDCQDIVKAVQNDHVFKARHKIGTVNSINWARVVAQVVYYFHGYFRATASNDETVSFCVPSGNFGNVCAGHVARQMGLPVERLIVATNENDVLDEFFKSGRYAPRGSERTYVTSSPSMDISKASNFERFVFDLVGRDGAKVKQLWAEVDAGGGFQLDGETMRQVRDAFGFVSGKSAHADRIATIRLVDADDGVVVDTHTADGIKVARELRREGETVVCLETALPAKFAETIREALDREPPRPAGFERLESLPQRVVTLPADAGQVKALMEKALG

SEQ ID NO: 5582 - protein, 111 aa, Chromobacterium substugae
MTRHWQAGLCAALFTGFAAATPLSPGQHQLLQGFLMRGCVKRTPASDGVGLPGNEQVQRYCQCASEKLASTFTAEEVMGVVTGQIKKDDPRGKQRLKEASAACGQYLEPQQ

SEQ ID NO: 5583 - protein, 436 aa, Chromobacterium substugae
MKPIHIGLLGVGTVGGGTATVLKRNAGEITRRAGREIRLIQAASRDLAKARAVLGPEVALVDDARRIVDNPDVDIVVELIGGDTIAKELVLKAIENGKHVVTANKKLLALHGTEIFARAQEKGVMVAFEAAVAGGIPIIKTLREGLAANRIEWIAGIINGTSNFILTEMRDKGASFADVLAEAQKLGYAEADPTFDIEGHDAGHKLTIMAALAFGIPMQFDQCYLEGISQLDGRDIRYAEELGYRVKLLGLTRRTDSGVELRVHPTLIPEGRLIANVNGVMNAVLVKGDALGPTLYYGAGAGALPTASAVVADIVDVTRLLTSDPEHRVPHLAFQPDQLQDLPILPISEVTSSYYLRIGAIDRAGVLASITRLLAENGISIEALIQKGSVSDGTAEVVILTHRVQEKAINHAIAGIEALDSVAGKVVRLRMEELND

SEQ ID NO: 5584 - protein, 45 aa, Chromobacterium substugae
MDRFHKSVSVQSLDFLFRPKAVWTGASCPGGPRAAGICPAAAAGA

SEQ ID NO: 5585 - protein, 410 aa, Chromobacterium substugae
MQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVGLAGGKAVHYLCDEEQGWFPSIADIQAKITPSTRAIVIINPNNPTGAVYPPALLQQIVEVARQHQLIIYADEIYDKVLYDAASHTSIGSLAPDLFVVTFNGLSKNYRACGYRAGWMVLSGEKKHAKDYIEGLNMLASMRLCANVPAQYAIQTALGGYQSIDDLVAPGGRLARQRDLAYKLLTDIPGVSCVKPQGALYLFPKLDPKIYPVGDDQQFILELLQQEKVLLVQGSGFNWIAPDHFRVVFLPNTDDLVEAIGRIARFLENYRKRHGSAD

SEQ ID NO: 5586 - protein, 54 aa, Chromobacterium substugae
MDWLHGGDGFRFRPPAGWDGMLVAVWLLFHGISVFRPAAKATFRAWSLEPRVWV

SEQ ID NO: 5587 - protein, 122 aa, Chromobacterium substugae
MKMHQSLGQGKNLFTGYGDGHVLINAQRHDGNLIVSADEVAAWAAPDFSGLAAAHFDALLAYQPEVVLFGSGESQRFVHPRLYAALTEAGIGVECMDTQAACRTFNILLAEDRRVVAALLAI

SEQ ID NO: 5588 - protein, 438 aa, Chromobacterium substugae
MEMELGKWLDERPLGGFQYRLLVLCGLCMILDGFDVQAMGYVAPALLEDWGIAKSALGPVFGAGLLGLMLGALLFGALADRIGRRPVLLGCALLFSAGMLLTAGAANLPQLIALRFVTGVGLGGIMPNAMALAGEYSPARRRASLMMLISCGFTAGALLGGLLAAWLIPAHGWRSVFIVGGVAPLLLWLPMWRGLPESAKFLLLRDRTGQAEAWLRRMEPSLPAGIRPWLAERPARSNPVAELFRNGLARRTLLLWLLSFLNLIVLYFLSNWMPSLLRAQGLDMRHALLAGSMLQLGGVIGTLAFGYWIDRAGFRRALPPCFLLAALGLWLLGRAQGEALWLHMLLFGAGFCIIGAQPAVNALAASAYPTSLRATGVGWSLGIGRIGSVLGPWLGGVLIGLAWSQAALFALLALVALAAAAVVLAYHREPARRVGEAV

SEQ ID NO: 5589 - protein, 438 aa, Chromobacterium substugae
MLSRNAALPRIVIVGGGAGGLELATRLGRTLGARHRAQVVLVDGSPTHIWKPLLHEVATGALNTGEDEVNYFAHGYRNGYDFEFGYMQGLDQARRSIRLAAIPGSDGQQLSPEREISYDWLVIAVGAEANDFGTPGVAEHAMFLNTPNDAEKLRHRVLEQAFRASSGDAPARALSIAIVGGGATGVELAAELNHTMCELHHYGARLQPERVRISVIEGAERILAAAPATLSAYAEEQLAGKRIQVLTNSRVAAVEADGVALADGRKVDADITVWAAGVKAPGWLAGLDGLETNRVNQLVVDTRLHCAGGDCVYAMGDCAAAPDGDSGRMLAATAQVAHQQARYLADELARRLDDKPARPFVFKPQGMMVSLGKHTAVGSLAAVVGPKRDYHVEGRGAKLIYASLYRMHQAAVHGWALAILLFIGDKLRRAARPALKLH

SEQ ID NO: 5590 - protein, 508 aa, Chromobacterium substugae
MSISRSLKIVATLYRYGLDDFLEGHSKLAFLHRLFALCPVGRDIRAPLPERVRLALESLGPIFVKFGQVLSTRRDLLPPEYADELARLQDRVPPFDGDIARQVVENSLGRKVEELFVDFDLKPVASASVAQVHKAWLRQPDGSRGREVAVKVLRPGILPVIEQDLSLMRTLAGWVEKLFSDGKRLKPREVVAEFDKYLHDELDMMHEAANASQLRRNFKGSQQLIVPEVFYDYSSRDVLTLEWMHGIPVGQVERLREAGVDLQKLSRFGVEIFFTQVFRHGFFHADMHPGNIFVAPDGRYIALDFGIVGSLTDTDKHYLAVNFLAFFNRDYHRVATAHIESGWVPKDTRAEELEAAVRTVCEPIFEKPLSQISFGMVLLRLFETSRRFNVEIQPQLVLLQKTLLNIEGLGRQLDPELDLWDTAKPFLTKWMNEQVGWRGLLRTLKNEAPQWATTLPTLPRKLNEALGSAKTELLVEGYIQLMREQKRQNFLLMLIAILLAGLLAKVLW

SEQ ID NO: 5591 - protein, 194 aa, Chromobacterium substugae
MALTIAAFNHLLNQHPARRAELAAHAGRRVAIALPPLHVAGVITDEGWLAACEGEPEARLKLRHGAVLSQLSGQPPQLSDIALEGDAELAAALGRIVGQLHWHAGEDLSRLFGDVAAQRMETLARGLFGVKGQLAFRLAENWVEHLREEAPVLASRRLVQRFVSEVDHLRDDAGRLDKRLARLEAALNKPNTPT

SEQ ID NO: 5592 - protein, 171 aa, Chromobacterium substugae
MQAELAARLAELGIDPASLLARGLETHPEPAELALAETNAEGREFHLTPAAAQAWTAMRRAAAEDGVEMFLLSAFRSVARQHEIVAAKLARGLSLDDILQASAAPGFSEHHTGCAVDIGAPGSPPLEEAFETTAAFAWLSRRAAAFGFHLSYPRGNACGYLYEPWHWRWRV

SEQ ID NO: 5593 - protein, 244 aa, Chromobacterium substugae
MDKTTHFGFKTVDESEKAGKVAEVFHSVAGKYDVMNDLMSGGLHRVWKHFTLTTSGVRAGDKVLDIAGGTGDLARGWAKRVGKTGEVWLTDINSSMLTVGRDRLLDEGVILPVSLADAEKLPFPDNYFDAVSVAFGLRNMTHKDAALQEMCRVLKPGGKLFVLEFSKVWKPLSPIYDFYSFKALPIMGKLVANDADSYQYLAESIRMHPDQETLKQMMLDAGFGKADYHNLTGGVVALHKGFKF

SEQ ID NO: 5594 - protein, 140 aa, Chromobacterium substugae
MQSAAPGAAAEPIESKTMSGVAPQAAQPVEIQLHQVSKMLEIAFDDGARFELPCEYLRVHSPSAEVRGHGVGQETLQTGKRQVGITALEPVGHYALKITFDDGHDSGLYSWTYLYELGAKRDQYWQEYLDKLAAAGASRE

SEQ ID NO: 5595 - protein, 340 aa, Chromobacterium substugae
MQLSDFDYHLPEALIAQHPPAVRGASRLLHVDGMNLSDQTFADLPTKLQAGDLLVFNDTRVIRARLFGEKASGGKIEALIERVLDDHTALAHVRSSKSPKPGSRLIFAGRWEAEMLERQGSLFKLRFLAEDKLFDILEASGKLPLPPYIERSAEGDDDERYQTVYAREQGAVAAPTAGLHFTDALLEQLRAQGVETAFVTLHVGAGTFLPVKVENVAEHKMHSEIYEIPQATVDAIARVRARGNRVVAVGTTSVRALESAARGGELAAGRGETDIFITPGYRFRVVDRLLTNFHLPKSTLLMLVSAFAGYDEIFQAYRHAVEKEYRFFSYGDAMLLEKKG

SEQ ID NO: 5596 - protein, 60 aa, Chromobacterium substugae
MIIEVGELHTETINQNRQIIPAPTFPAQCRASHRRRTQLDPCRYSIYILQTCHTDFPLKI

SEQ ID NO: 5597 - protein, 156 aa, Chromobacterium substugae
MKNRSQALSRSILVLHGPNLNLLGVREPQHYGRDTLDDINQRLAKQAKAAGFSLSALQSNAEHVLIERIHQCLDDGTAFILINPAAFTHTSVALRDALAGVKLPFIEVHLSNVHAREPFRQHSYFSDLAVGVICGLGAHGYELALAHAVRHLAAQA

SEQ ID NO: 5598 - protein, 155 aa, Chromobacterium substugae
MDLRKLKKLIDLVEESGIAELEVTEGEEKVRITRVSASQQQVYAQPMPQMYAAPAAAAPAAAAATDAAPAAAPAAASDKNAMKSPMVGTFYRSPSPGSKSFVEVGQSVNAGDTLCIIEAMKLMNEIEADRSGVVKAILVEDGQPVEYGEPLFVIE

SEQ ID NO: 5599 - protein, 451 aa, Chromobacterium substugae
MFEKILIANRGEIALRIQRACREMGIKTVVVHSEADREAKYVKLADESVCIGPAPSGKSYLNVPALIAAAEVTDAQAIHPGYGFLSENADFAERVEQSGFVFIGPRAETIRAMGDKVSAKHAMIEAGVPCVPGSDGALPDDPAEISKIAKKIGYPVIIKASGGGGGRGMRVVHSEGALINSVQMTRTEAGAAFGNPTVYMEKFLQEPRHIEIQILADEYGNAIYLGERDCSMQRRHQKIIEEAPAPGITDKQREKIGEACAEACRRIGYRGAGTFEFLFENGEFYFIEMNTRVQVEHPVTEMITGVDIVQEQIRIAAGEKLRYKQKDIVLHGHAMECRINAEDPFTFVPSPGKIESYHPAGGPGIRIDSHIYQGYTVPSHYDSMVGKLIAYGDTREQAMARMRVALSEMAISGIKTNIPLHQELFLDAAFQRGGTSIHYLEHRLQQKKGEA

SEQ ID NO: 5600 - protein, 298 aa, Chromobacterium substugae
MAWLQATIDSDSAVAEKLADALMDAGALSTAIEDAWAGTDREQPIFGEPGEPVDQLWSQSRIITLFDENADVALLIAAAANACQLAMPGYSVERVEEQDWVRLTQSQFEPIRISDRLWITPTWHDAPAPDAVNLQLDPGLAFGTGSHPTTRLCLQWLDKQLQGNESVLDYGCGSGILAIAALKLGAASAVGIDIDAQAVRSSADNAAQNGVKADFFLPDANPQAQYDVVLANILANPLRMLGELLSSHVKTGGRIVLSGILAEQADELSAIYSQWFEMDAPVFDEGWTRLTGTRRATV

SEQ ID NO: 5601 - protein, 327 aa, Chromobacterium substugae
MFKAPDHFVVTQPAPEPAVAQPAPAPEPAAERDPIDDFELEVPDFDPQGNHPDIDIPADNPLIAPPPSAMPAAEPEPEAAPQAEMEEFQRALAEAMQNRQATAPIGNPFDDPQPIAAAEPEVFGRRRRAEALPEPESKPARAPIEEEPLFTDADAEEEAEAASHQPAGPWLNGVLAVLAVIGILFLAAQLVYINRTRIAAEVPEMRPALESMCRALDCQVPWPTDIALIRTEWSELAFVPDYPNLIQLSATLKNHAQYAQAFPMLEVTLKDSDDQVLIRKVFAPKEYLKPDDLKLGRFNPNSEAKITMRLDAGKVHAMGYSLYWFYP

SEQ ID NO: 5602 - protein, 106 aa, Chromobacterium substugae
MRKTKWLAGLLAAGMAAGAVAAGCSHQEAPDYPLKALRDEVGGVVKVMFQTRADGTVAGIQSADWRQIPPQYRSGFRYEINKALREYRCTPGASLTQEFAFRMEEE

SEQ ID NO: 5603 - protein, 84 aa, Chromobacterium substugae
MAAPAYPIRAEMDKIAGDVTLVFHTDARGRYDGRASMVFSATIPEAYREDFRLALDAMLEEYRCRPNANLQLKLRFVPDDGAQR

SEQ ID NO: 5604 - protein, 294 aa, Chromobacterium substugae
MDRFSEIRAFVAVAELGSFVAAADRLELSRAMVTKLVASLENRLGARLMHRTTRKLSLTEAGETYLSQAGSLLAELDELDALLSHGASEPVGRLRVSAPVSFGMRYLGRIIGGFHQRHPQIEVELSLNDRRVDLVEEGFDLALRVSNLSDSTLVARRLAQIDDLLVAAPSYLARHGAPAHPSELAAHQCLLYALTSQPNVWDYQAPDGSRDKVRVKGPLKANNGDVLTDAAINGMGIVLQPRFLVEQALAEGSLVAILQDYNWHCLDLSVVYPVRRHVPGKVRVFVDYLAEFFA

SEQ ID NO: 5605 - protein, 132 aa, Chromobacterium substugae
MNRLQNPALAALLLRLSLGLMYLAHGALKLFVFTPAGTAEYFASLGLPGFFGYVAIVIEIGGGLLLLAGVKARWVALLLIPQLLGAIALVHGAKGWMFTNEGGGWEYPAFLIAASLALFLLGEPARSQSAAR

SEQ ID NO: 5606 - protein, 805 aa, Chromobacterium substugae
MVGDGISLDPTSGSLLAPVAGVVSNLHSAHHALTITTAEGVEVMVHIGIDTVMLKGEGFFPLVEQGQQVSAGQAVIDFDIDQVGRRAASLLTQIIVTNGDSVHSMQPARGMVNAGRDVVLSLTLANGQAAAQVQSGEPQLSAAIAIGNPAGLHARPAAVFASKAKSFSSDIQLILADKEANAKSVVAVMGLATKLGDAVRIRAQGADAAIAIAELTQLLNERCGEKADEAPAAPAAAPIAIQQQDSESQLAGVGASPGIAIGRIVHHRLQEFDVPEQGKGGNVEQQAFARAAEEAAAQIELVKAQLSDPAKQAILSMHQELLQDPDLLALTYTGLAEGKSAGWAWRAAFSAYSARLEAQDNPLLRERANDIRDVGRRVLALLAGVKQAALELPAGSILIAEDLAPSDTAALDPSKVMGFCTRTGGATSHVAILARSLGIPAICGISQAALKLPEGRQVILNGSEGTLAIAPSADDLAAAEREIARLAERRAAEAKGSMQPAQTRDGARIDVVANIRNAADAREAVAKGAEGVGLLRSEFLFDNRDTAPTEAEQAAEYCAVAEALGKERPLVVRTLDVGGDKPLSYLPLPKEDNPFLGLRGIRVSLDRPDLLRTQLRAILQAAPLTQLHIMFPMVASLEELRAAKAVLAEEQAALGVADVKVGIMVEVPSAAVLAARFAPEVDFFSIGTNDLTQYVLAMDRGHPQLAKQADALHPAVLNMIAMTCDGARAHGKWVGVCGGLASDERAAPLLVGMGVTELSVSTPAVASVKATLARWSLDECRELARAVLALSTVTDVRHHLNQHAR

SEQ ID NO: 5607 - protein, 587 aa, Chromobacterium substugae
MFSQSFAFLQKIGKSLMLPVAVLPVAGLLLGIGATDFHTTNSVALAILSLMKNSGDVIFGNLPLIFAVAVALGFTENDGVAAIAAVIGHLVTTVTLGVMAGLMGVKTATIMGLPSIQTGVFGGILAGGMAAYLFNRFYRINLPTYLGFFAGKRFVPIITAISAIGLGAVLSVIWRPIGEGIATFSHWAAVSDPRTAATVYGFVERMLIPFGLHHIWNLPFFFEMGDFVDATGKHVHGDINRFFAGDSTAGVLAGAFFFKMFGLPGAAIAIWHSAKPENRAKVGGMMISAALASFLTGITEPIEFSFLFVAPVLYFIHACLVASAQFIANTLDMHMGFTFSQGGIDFVLFNLIGDKAKHAGYVFILGPIYFVIYYGVFRFVIAKFNLKTPGREDESLETAGAVSEDQRARELVLAFGGRSNIRTLDACITRLRISVQDTAKVDQAKLKAMGASGVVVVGNGIQAIFGPLSENLKTDMDIYLRSAGSDAELSSAPLAAPAPVAVAPAAPAAAAKADIAALKQALGGNANLGKVEAIAHTRLRVELKDAARFDEAAARSAGVMAVMQVAPGTLHLIVGDQAAALAAALLA

SEQ ID NO: 5608 - protein, 265 aa, Chromobacterium substugae
MSYRFIASDLDGTLLDQHHAVNSLTAATLQSLEARGVQFALATGRHHLDVKGIRDALGVRAHLITSNGARIHDPDGRLIHRQDIAPQLVRALAQPEYAAGSILNFYLDDEWLIDQPCQSFLDMHRDSGLSYRVDNLAEHDGVGVGKVLYIGEHAHLLRVEEALQRRFGDQLYITFSLENCLEVMAAGVSKGHALRLVLGRLDIDPAHCLAFGDGQNDVELLRAAGHPRLMGNAHPRLSSEMPDAHRIASNAESGVAQHLRELFAL

SEQ ID NO: 5609 - protein, 146 aa, Chromobacterium substugae
MNPLSLAAHSGASLDALLRQAVIQLGCPEGRLADVDQHATLAIQLQALPDVMVSALDDRLWVWSILPGLSEARLHAMAAETLAILLEPVEDVESGQLALGRGEHGYELKALVRLDCLSRDGGLQPVLAAFIERLRALCQTLNLTGE

SEQ ID NO: 5610 - protein, 327 aa, Chromobacterium substugae
MPGITTISHAGGAQRAASPSTPAAPRAGQPTGLTSSPLPGPTSSRQAVIYAPFAAGDVVTQSLGKNLVREQNGKPLLPLIAQDDQAHVRLQQLQQQQVQDLRGKGSLFPDQIRKLQQQHNLSQDVLRQHIGPAEFDKAMQASATFARQADVLQRMEIRSNEHGAELGRLQPQRDKIYIVGHGGPGMDILAADQQVTQGKATSADVAQQLAAGGLDRAFRDFRATACFSADTREPTSFHPADLGRAAAPALGPRPGFLQLFGKRPVLSQPFAQSLSDELAKQGFKQPEVAGYHGAGVTFSQIGHSSRRLPGAADSRASELKQVFTPRK

SEQ ID NO: 5611 - protein, 134 aa, Chromobacterium substugae
MPDLAAFHHCANELLQHLGFDAIVPASHQEVISLTVEQRFAVHLGAIDQDHWFMQAELGEHPLRDADPLLAQALRGNQLCGQSWQPVAALDAEQRLCCWLRLPCRGLDLPQLAAAFDALIARAEALLDSAAAAR

SEQ ID NO: 5612 - protein, 462 aa, Chromobacterium substugae
MSTIHTGIHMIRPNLSQLNELGAGLRADSARIGIRKDGSLVVYTGRSYLLHPDQTRRAQQFLRQNHLLEPQERPRDIRLLDLVTRLNTRANSHTRPSPQDLAQRTDAGAKPHLRWADQQPPRQEAASLSQRRGLQHLKLAPQPAAAPANPQAALARALGSSDNRVGLSSQLQQQAGPAASGAAFINDLAGARFRDIPTAAATLVRAPDGAQLPANRVQVGGANVAIASQYPTAGQLESYFGMLAANRTPVLVVLASDHDIAKSQGGGNPLPPYFSQSGQYGKVAVSAREGSHSQLAGGLEVRAYQLAVQDGGGKKISIPVLHVPNWADFGAQGPVALKALAEHVNAVKEKQIGVYQRGNSSALNDPDKLLPVIHCRAGVGRTGQLIAATELLKPGASSLESIVGDMRRSRNHLMVQTAEQLNTLADLAQQQGRAVVASQPAAAGNQPIYANTAPPLPPRHPR

SEQ ID NO: 5613 - protein, 395 aa, Chromobacterium substugae
MSNRYGQLFRTPGVAELALAGWVARLPGTMVAVGVITMLSLSRNSYSLAGAVAATLTLASALLAPQVSRLADRYGQSRVLPPATGIGACALLALILCNHLHAPAWTLYLCAAPAACLPSIPAMTRARWARLLEGQPLLPTAFALDSVLSETAFVMGPPLSIGLCMAWFPEAGPLLAALLILFSVSALLRQKATEPPPHPITSDSRRPALFLRPVPVLALLMGTLGAIAGTIDVASVAFAKAQGQPAAAGWVLALYALGSGIGGLAFGALKPALPLGRLLLGCCLATAASSTLIALAPNVIWLAAVMLLSGLSFAPTLIVAMEMVEKAVPRARLTESLTWLVTGIQLGVAGGASLCGLATDAYGARAGLSLALAAGLASLSIAALQPRVVPTKSAC

SEQ ID NO: 5614 - protein, 511 aa, Chromobacterium substugae
MQTRLLASLLTLTLLSACTSTQLAGDPLNEKPDSQSGTVILSLTINTGEVPPIELIELTRNEDPTSGFNKKYQLKNIVPGLSKDTALYIGTLPAGTYKLDYLRAQLKFLSVSPGQRELVGDFRVEPGKTSDLGRLILTAINYKVAFGRSLHEKDNRKLVALAAPSYQSLYQQASSTGWLKTEPTDRIEAYALSRPQGAGGFSELADHRIIGGSRFGSILVRQDSGHWKLIGRTGELNSILFTTPYPIQPYMAVAVGEFGSFFKVRMDGKTLPIDRGNLPLGNYFFIDSSPDQKHWFVGVQLPGKVSLYESNQLENGNWKIARENPAGILWLWHYPGGIGYASSSVRVIACYDYAQKQWRQNDTPEKRYIISVAGGPTKSVGVLTQVGLGIAGVFAKTHYSSDCGANWKETHSPYTVKASAPIILPSGQILESGGVFGDTGIYRSDDGSNWSKIYSDQLILRDHIWVMPTAGLISVSNSINGVEDIQYSNDGGATWSTEVTSYDSRQNNTKD

SEQ ID NO: 5615 - protein, 214 aa, Chromobacterium substugae
MAERVLYGYFRSSAAYRVRIALNLKGLAYQYRAVNLLKGEQRSADYLAINPYGLVPLLDDGGVQIAQSLAICEYLDEAYPDTARLLPAEPAARARVRSIALAIAADIHPLQNPRVGKFLQAEHGASEEGKTEWIRHWIRTGFDALERQLAQTAGRYAVGDAPTLADVCLLPQVFSARRFGVDLAPYPTIVRIAEALEALPAFADAHPAKQPDAV

SEQ ID NO: 5616 - protein, 325 aa, Chromobacterium substugae
MKLATYHNHTRDGQLMVVSRDLTRAVAVSAIAATLQGALDNWAQAAPRLQEVYAALNQGKVPDEVAFDSGRCLSPLPRAYQWADGSAYLNHVELVRKARGAEVPESFYTDPLMYQGGSDAFLAPTAGIPLRDEAWGLDFEGEVAVVTGDVPLGAPADEKHIRLLMLVNDVTLRNLIPPELAKGFGFFQSKPATAFSPVAVTPDELGDAWQGGKVHLPLLVDYNGAFYGKPDCGVEMQFSFPQLVAHVSKTRELVAGSIVGSGTISNKDRSVGSCCLAEQRMIETIEQGAAKTPFMKVGDTVRIEMKSAAGDSIFGAIEQTVVAHG

SEQ ID NO: 5617 - protein, 377 aa, Chromobacterium substugae
MRKWISYPHREGTFSRQAHADFPAEAIYEREVGRSGFFGPATHLHHKHPPTAWSAWEGPLRPRAFDLNELPHGAPAPWDAPLVLHNAQCKLRIWRCEQAMTQLFRNADGDDLLFIHAGSGELFCDYGHLSYRDGDYILVPRSTSWRIEPASPTTMLLVETSNGAYQLPEKGLVGPHAIFDEAVLDVPAIDDVFKAQQTEDEWQVVIKRRGALSIVTYPFNPLDAIGWHGNNSVARVNWRDIRPLMSHRYHLPPSAHTTFVADGFVICTFVPRPIESDPGALKVPFYHNNDDYDEVIFYHAGDFFSRDNIKPGMLTFHPAGFTHGPHPKAFAKAMTEPKKFTDEVAVMIDARDALEQGPGLASVEWQGYVDSWKPKPV

SEQ ID NO: 5618 - protein, 358 aa, Chromobacterium substugae
MKMEAMLQNPLATDGFEFVEYTAPDAEGVEKLNQLFLSLGFTEVARHRSKDVRLYRQGDINFILNAERSQPASEFAKAHGPSACAMAWRVKDAAKAYEYALSHGAKPYQRPVGAMELNIPAVQGIGGSALYFVDRYGQGKDIYEIDFVPLEGVDQHPFGVGLTLIDHLTHNVARGNMATWADFYTGIANFREIRYFDIEGKLTGLVSKAMTSPCGKIRIPINESSDDKSQIEEFLRQYNGEGIQHIALTTDDIYATVETLKARGTRFLDTPDTYYEKVDTRVPNHGEDVARLKKNSILIDGAPVEGILLQIFTETVIGPIFFEIIQRKGNEGFGEGNFKALFESIEEDQIRRGVLKAD

SEQ ID NO: 5619 - protein, 161 aa, Chromobacterium substugae
MPSLTLDKTDLRILAELQLDGRLTNVELAERVALSPSPCLRRLKQLEESGVIRQYVALLDPAHIGLGLQAWVRVTLEKRGNLHLQSFIEAVQSWPEVINCFAMTGEMDYLLQVYFEDMEHFSRFVMDELLQHPGVEDVKSSFVLKEIKRTTALPLGQLRSM

SEQ ID NO: 5620 - protein, 181 aa, Chromobacterium substugae
MQENITNRREPRKSLLGQVIFSSRWLQLPIYLGLIVVQGVYAWKFLAQLWELLEGLDHLTETDIMLAVLGLIDVVMIANLLVMVTVGGYETFVSRLRIDTHPDQPEWLDHVNASVLKVKLSMAIISISSIHLLQTFINASRIDEHTIKWQLFLHLAFLLSAAAIAYTDKLLSSTAAHHQGH

SEQ ID NO: 5621 - protein, 279 aa, Chromobacterium substugae
MMTQTPRTFSFEFFPPKTPEGIAKLRTTRQQLAQFKPQFFSVTFGAGGTTRDGTLSTVLEIRSEGHAAAPHLSCIGSTRENIAAILDEYRNNGIRHLVALRGDIPSGMVAAGEFRYANELVSFIREQHGEHFHIEVAAYPEFHPQARSAEDDINNFVRKVRAGANSAMTQYFFNADAYFRFVDEIQARGVDIPVVPGIMPISNFGQLCRFSDMCGAEVPRWLRQRMQAYYDDTASIRALGLDVVTELCDRLLQGGAPGLHFYTLNQAGLVSTIWQRLGL

SEQ ID NO: 5622 - protein, 466 aa, Chromobacterium substugae
MADFSDFHVADINLAGWGRKELNIAETEMPGLMATRDEFRASQPLRGARIAGSLHMTVQTAVLIETLTALGAEVRWASCNIFSTQDHAAAAIAAAGIPVFAFKGESLDEYWEFSHKIFEWPEGQPANMILDDGGDATLLLMLGSKAEKDIGAIAHATNEEETALFASIKRHLAIDPYWYSKRLQHIQGVTEETTTGVHRLYQLEKDGHLPFPAINVNDSVTKSKFDNLYGCRESLVDGIKRATDVMIAGKVAVVLGYGDVGKGCAQSLRGLGATVWVTEIDPICALQAAMEGYRVVRMDEVAGEADIFVTATGNVGVISHEHMKKMRNNAIICNIGHFDSEIEVASLRQYQWENIKPQVDHIIFPDGKRVILLAEGRLVNLGCATGHPSFVMSNSFTNQVLAQIELFANGQKYDKKVYVLPKHLDEKVARLHLARIGARLTELSDQQSAYISVPKQGPYKPDHYRY

SEQ ID NO: 5623 - protein, 531 aa, Chromobacterium substugae
MPFVFTPLAALSGLAALLSAAISVIAWNRRQFAGVRWLALLMASVAFWAAGAMCELSATSLSAKVLWSKVEYLGTLSTPVLFLLLALDYNHIDLMRRRRWLPVLFAIPALCLLLAASNEYHQLVWTSYRPSPSGYNLLIYGHGPAFWLGVAGYSYLMMLLGSLLLIRSLHYYPPHFRGQSITLMLSALAPWLGNILYLSGLFPLQGLDPTPHSFAFTGIVFAIDLLYLRQLYLVPVARARAFEAMGDGIVVVDQQLRILDINPSGARMLGQPAGQLQGSALPAPWLDSARLRREGQLLEMMAPASGKILDIRAYAIDQGRHPGHTLMLVMRDITQRREAEDALKNANQQLVERLAQIEQLQAALREQALRDPLTGLYNRRYLDETFERESRRAERESQPIAMAILDLDNFKQINDSHGHQVGDRVLQALARLLQRECRATDIVCRLGGEEFLVLLPGSDAEQAQARVEGWRGGFARLSHAGRDHPFQASFSCGIAALPRHGRALSELYHHADRALYQAKAAGKNCSVRAPA

SEQ ID NO: 5624 - protein, 389 aa, Chromobacterium substugae
MSEYLFTSESVSEGHPDKVADQISDAILDAILREDKHARVAAETLVNTGLVVLAGEITTTANVDYIKVARETIKRIGYDDSELGFDFRGCAVMACYDKQSPDIAQGVNEGEGIDLNQGAGDQGLMFGYACDETPTLMPFPIYYAHRLVQRQAELRKDGRLPWLRPDAKSQITCVYDAATGLPKRIDTVVLSTQHSPDIDHKTLTDAVIEDIIKPVLPPEMITPETKFLINPTGRFVIGGPMGDCGLTGRKIIVDTYGGAAPHGGGAFSGKDPSKVDRSAAYAGRYVAKNIVAAGLARQCQIQISYAIGVAEPTSIAVDTFGTNKVPNEKIVELVKKHFDLRPKGIIQMLDLLRPIYGKTAAYGHFGREEPEFSWERTDKVEALRADAGL

SEQ ID NO: 5625 - protein, 258 aa, Chromobacterium substugae
MRLRENLSSSKIFENYQVLPREVKRSAAETGKGALELAIAWCRSPEDIAAMVKSCDGWHHVESALAQGNGIIFVTPHLGSYDIAGRYISSRLPFPLTAMYRPPKLAWLEPVMQAGRSRGKGKTAPATAAGVRVLMKALKSGEATIILPDQAPGNGEGAWAPFFGRPAYTMTLVPRLAQMSGVATLFFVGERLPRGQGFAVHIEPLAQPFTGDKEADCALMNAQVENLIRRFPSQYLWSYNRYKCPAGVTRPDDAQGHA

SEQ ID NO: 5626 - protein, 288 aa, Chromobacterium substugae
MRLAFALLWLIRLLPMRAIGLIAAGLGNIAYLLAGGRRRVGLINLRLCFPDMPLAERRRLVRKNCQHMMRLVLEYGVCWWSSAKRIDNLVDIKNLHYVTELRDKGEDVILFYPHFVGFEMCVYALNQYIPLVSVYSHQKNDTLDRQIYAGRQRYDNAYIVSRQEGLRPIIKAMRKDHAPFLYLPDQDFGVRDSLFVDFFGVKAATITGMSRIAKLARAKVVPAIARRVGDRFELEFYPPWDNYPSEDIEADTRRMNAFLEERVREIPDQYFWLHKRFKNRPQGEPRFY

SEQ ID NO: 5627 - protein, 244 aa, Chromobacterium substugae
MLKFLLSSLAALLLAGAAQAKPLQPARHGDFAHYTFALTWQPGFCATGDGCLPEQPKQPLIGLHGLWPSLPQSLIQQGVPVQQWWAKGCAFFPHALAIALPPTELRQRLSQVMPQLKDDLYTHEYVKHVQCFGYNGVDFFSTAMDMRQAVADSGFGAYLLAQAGQVRRREELEEAFVKAFGTDQARSLQLQCGKDKQGRNVLTQAWFTLKADRLADFPKAEAFVNTPDGEYEDTCKEPFLLPAW

SEQ ID NO: 5628 - protein, 98 aa, Chromobacterium substugae
MQSSITILLLLAFAAANLPFITTRVAGFVKVARKHFGWQALELAALFLLMGGLARLLESRQMPVHEQNWQFYVTTFSLFLVAAFPGFVYRYFWRKPGQ

SEQ ID NO: 5629 - protein, 484 aa, Chromobacterium substugae
MNWADLNLIPALPELFLIGALLVVLMLDLFIPDEKRCITYGLTLLTLAGTAVAQVYTFTPYPVTTFSGMYVADPLAALVKLAMYGATAVVLVYSRQYTADRGLYKGEYFSLALFALLGMNLMVSASHFLSLYMGLELLSLALYSLIALQRDSVAATESAMKYFVLGALASGLLLYGISMIYGATGTLELAGVAKSIKLHAANPMLLLFGLVFIVAGLSFKLGAVPFHMWVPDVYQGSPTSVTLMVGAAPKLAAFVFVLRILAQGLDVLVGDWQGMLVIVAVLSMAIGNITAIVQTNIKRMLAYSTISHMGFLLLGVLSGTQQGYSAALFYAVVYVAMSMVGFGIMLALSRKGFECEKIDDLKGLNSRNSWYALLMLLAMFSMAGIPPLAGFYAKFVVIKAILDIGMVKLAVFSVLMSVIGAFYYLRVVKAIYFDDAADNSPIAVRADMKLVLSLNALALLAVGVLPESLLELCLQAMRQSLTVI

SEQ ID NO: 5630 - protein, 499 aa, Chromobacterium substugae
MFTNLLSLVIWTPILAGLVVLATGGDQRAPLARWLAVAGALAGFLLSVPLFTEFNNLNGGMQFVESKPWIASLGINYRLGVDGISMLFVVLNSFTTLLVVIAGWEVIQKRVAQYMAAFLIMSGLINGAFAALDAILFYVFFEGMLIPMYLIIGVWGGPRRVYASIKFFLYTLLGSLLMLVALIYLYFLAGKSFDIQAFHQIAKIPLTAQLLLFGAFFLSFAVKVPMWPVHTWLPDAHVEAPTGGSMVLAAITLKIGAYGFLRFALPILPDASRELAPVIVGLSLVAVVYIGLVALVQSDMKKLVAYSSISHMGFVTLGLFMFTGSEMNQWAVEGALVQMVSHGFVSAAMFFCIGVMYDRVHSRNIADYGGVANKMPIFAAFMMLFAMANSGLPATSGFVGEFMVIMGAVQVNFWFAFAAATTLIFGAAYTLWMYKRVIFGDVANSHVAELSDVNKREFLVLAILALMVLGMGLYPQAFVSKMHLAVNDLIAHVAQTKLP

SEQ ID NO: 5631 - protein, 683 aa, Chromobacterium substugae
MDMKSLYLLIALAPLAGSIIAGLFGWAIGRRASHVVTIAGVAVSAALSLKVLLGFLNGSAEVFNGPVYTWLTVGGYEFSVGFLVDALTAMMLVVVTSVSLMVHIYTIGYMQEDPGYQRFFSYISLFTFSMLMLVMSNNFVQLFFGWEAVGLVSYLLIGFWFKRPTAVFANLKAFLVNRVGDFGFLLGIGMVLAYFGGSLNYSDVFAAAPALAHKTIEIIPGHEWSLLTVTCILLFIGAMGKSAQFPLHVWLPDSMEGPTPISALIHAATMVTAGIFMVSRMSPLFEMSDTALNVVMVAGAITALFMGFLGIVQNDIKRVVAYSTLSQLGYMTVALGASAYSVAMFHVMTHAFFKALLFLGAGSVIMGMHHDQDMRNMGGLRKYMPITWITSLVGSLALIGTPFFSGFYSKDSIIEAVAASHLSAAGFAYFAVVAGVFITAFYSFRMYFLVFHGKERWMQNHGSHHEHHGDSDEEEVSHDHHHGLGPNDKPHESPWVVTLPLVLLAIPSVLVGFFGIDKLVYGSFFGKAISVNEALHPGMEELHHEFHGAVAMALHSFTTLPLWLAIAGVVVAWYFYMKAPHIPAAIKEKCAPIHKLLENKYYLDEIYFAVFAKGSRALGTFFWKIGDMLLIDGLLVNGTAKLVGCFSAVIRRLQTGFIYSYATAMIIGVLALMTISFWQLIWR

SEQ ID NO: 5632 - protein, 101 aa, Chromobacterium substugae
MLTLTHFLVLAAILFAISVLGIFLNRKNLIVLLMAIELMLLAVNFNFIAFSHYLSDSAGQIFVFFILTVAAAESAIGLAILVVLFRNLQSINVEDLGSLKG

SEQ ID NO: 5633 - protein, 213 aa, Chromobacterium substugae
MNLTTVIFYVLSAILIFAALRVVTAKNPVHAVLYLVLAFFTSAGHWLLLEAEFLAITLVLVYVGAVMVLFLFVVMMLDINIEKLREGFWNNLPVAALVGAIMVFEMALILMSPATGLGQFKAAAPLAADYSNVKVLGHQLYTTYLLPFEIAAVVLLLAMVAAIGLTMRARKDSKAIDPAIQVKVRREDRVRIVKMDAVKQVEEAAADSGEQQA

SEQ ID NO: 5634 - protein, 162 aa, Chromobacterium substugae
MNSIRNFFKTFLLVELVKGLMVTGRYFFARKITVQFPEEKTPLSPRFRGLHAQRRYANGEERCIACKLCEAVCPALAISIESEQREDGTRRTSRYDIDLTKCIFCGFCEEACPVDAIVETHIFEYHGEKRGDLYYTKPMLLAIGDKYEAEIAANKAADAKYR

SEQ ID NO: 5635 - protein, 349 aa, Chromobacterium substugae
MEFLQGILGNEAGLLVWTLLKIVAIVLPMLGCVAYLTLAERKVIGYMQIRIGPNRVGPFGLLQPIADAVKLLMKEIILPTNSSKGLFLLAPVLAIGPALAAWAVIPFTEHLVVANVNASLLYILALTSMGVYGVIIAGWAGNSKYSFLGAMRSAAQIVSYELAMGFALVGVLMVSGSLNLVDIVKQQSFGMGGGSIVSWNWIPLFPLFIVYLISGVAETNRAPFDVAEGESEIVAGFHVEYSGMAFAIFFLAEYANMILVAALTAILFLGGWLSPFPASWGLLGAGGFHWLAIKVSLVLFCFLWFRATFPRYRYDQIMRLGWKVFIPVTLVWILVVGVWMFTPLSIWTH

SEQ ID NO: 5636 - protein, 783 aa, Chromobacterium substugae
MLEIEIDGKKLTVPQGSTVIEAAHSVGTYIPHFCYHKKLSIAANCRMCLVEVEKAPKPLPACATPVTDGMKVHTASPLAKKAQQGVMEFLLINHPLDCPICDQGGECQLQDLAVGYGNSTSRYEEEKRVVVGKDMGPLVSAEEMSRCIHCTRCVRFTEEVGGFQEIGMANRSEFSEILPFLGKTVDSEISGNVIDLCPVGALTSKPFRYSTRAWELSRRKSVSPHDGLGSNLVVQVKSNEVMRVLPLENDAINECWIADRDRFSYEGLNSAERLQKPMIKFDGKWHETDWETALEYVVKGLNGVSADHGKDAIGFLTSPHSTTEELFLAQKLARAFGVNSIDYRLRRSDFSADSAKQGAEWLGSTIAELAAAKSVLVVGSTLRKEQPLLASRLRQSVKKGGELNIIHVADDNLLTQIKGKLIVSPLALVNALSQVLKAVAEIKSGSTGIDLAAVEASAEARRIAESLTGAETASVVLGNVAQHHPAYGQLLSLAQEISRLSGARFGILAEAANSVGAELVGALPTRGALGSAVNAGDNAAAMIAKPRKAYVLLNTEVEFDSYDSQAAVAAMKQAATVIALTAYKGQGLLDYADVLLPIAPFSETAGSFVNMEGKLQTFNGVVRPLGETRPAWKVLRVLGNMLSLPGFDYNSAEEVRAEFAAGNLAAALNNALSAVAAQPAAAAGIVRVGEVPMYQADAICRRAPSLQATNEAKAPVARAHGSLLQKLGIAAGSTVVLKQGAGEARVALEADDSLPADVVRVATAHAATLQLGGMFDAIEIKQG

SEQ ID NO: 5637 - protein, 431 aa, Chromobacterium substugae
MAVFVNGVIFDGVDTSQPDCWRLDAYVARGGYQALRSILERKMAQEDVIAEVKNSGLRGRGGAGFPTGLKWSFMPRSFPGDKYVVCNTDEGEPGTFKDRDIIRYNPHSLIEGMIIAGYAMGTKAGYNYIHGEIFEDYVLFEEALEEARKAGFLGENILGSGFSFDLFAHHGYGAYICGEETALLESLEGKKGQPRFKPPFPASFGLYGKPTTINNTESFASVPFIIRDGAQKFLEAGKPNNGGTKLFSVSGHVNRPGNYEVPLGTPFSALLEMAGGMKDGKKLKAVIPGGSSAPVLPADVMMQCTMDYDSIAKAGSMLGSGAVIVMNEDVCMIKALERLAYFYHEESCGQCTPCREGTGWLYKVIHRIANGQGRKGDLELLDSVGNNMAGRTICALADAAVFPVRSFTKHFREEFEYAIEHGKTLVDHKWC

SEQ ID NO: 5638 - protein, 166 aa, Chromobacterium substugae
MLSAQSLALIDREVAKYPADQKRSAVMGALRIALEERRESGSTPEERCLNTGIIEFVANYLGIAPVAAYEVATFYNMYDMKPVGQYKITVCTNLPCALQGGVNAAQYISQKLGIAIGETSADGKYTLLEGECMGACGDAPVLLVNNHKMCSFMTAEAIDKKLAELK

SEQ ID NO: 5639 - protein, 417 aa, Chromobacterium substugae
MAEIRNYTLNFGPQHPAAHGVLRLVLELDGEVVQRADPHIGLLHRGTEKLAEHKTFIQSLPYMDRLDYVSMMCNEHAYCLTIEKLMGIEVPERAQYIRVMFAEITRVLNHLLWIGAHALDIGAMTMFLYAFREREDLMDCYEAVSGARMHAAYFRPGGVYRDLPDSMPQYTVSKIKNAKELARLNEGRKGSMLDFISDFTDRFPGYIDEYETLLTDNRIWKQRTVGIGVVTPERALNLGLTGPMLRGSGIAWDLRKMQPYDVYDKMDFDVPVGVKGDCYDRYLVRVEEMRQSNRIIQQCVAWLRANPGPVITDNHKVAPPSREGMKSNMEDLIHHFKLFTEGMHVPEGEAYVGTEHPKGEFGVYLVSDGANKPYRLKIRAPGYAHLAALDEMAKGHMIADVVAIIGTQDIVFGEIDR

SEQ ID NO: 5640 - protein, 198 aa, Chromobacterium substugae
MASKKMEALGSVVAAALGDKLVRSTLALDELTIVCKAADLLSVAETLRDHAELAFEQCIDLCGMDYSAYRDEPWDGPRFAVVYHLLSVKLNHRIRLRVFAEDDSFPVVASVNGIWNAVNWFEREAFDLYGIVFEGHPDLRRLLTDYGFVGHPFRKDFPLSGHVEMRYDPTQQRVIYQPVTIEPREITPRIIREENYGG

SEQ ID NO: 5641 - protein, 158 aa, Chromobacterium substugae
MGVEGILEKGFVTTTADKLINYTRTGSLWPMTFGLACCAVEMMHAGAARYDLDRFGIVFRPSPRQSDLMIVAGTLCNKMAPALRKVYDQMAEPRWVISMGSCANGGGYYHYSYSVVRGCDRIVPVDVYVPGCPPTAEALLYGIIQLQNKIKRTNTIAR

SEQ ID NO: 5642 - protein, 118 aa, Chromobacterium substugae
MLQNYFPILMFVIVGLLVGVGPIALGKLLAPNRPDSEKLSPYECGFEAFEDARMKFDVRYYLIAILFILFDLEIAFLFPWAVVLKDLGVYGLGVMVEFLAVLTLGFVYMWKKGALEWE

SEQ ID NO: 5643 - protein, 52 aa, Chromobacterium substugae
MFFSTSMALAYLSGGGKDNLGVMGGKIEQVAPQIPAGAPNNKASGPASKIPE

SEQ ID NO: 5644 - protein, 249 aa, Chromobacterium substugae
MSGKLVIGNWKMNTRGDSAGRLAAELLADQDTNREGVGIAAPAVYLAALAAQLRGSHIALSAQDVSRYDADGAFTGEVSAAMLADVGCRYALVGHSERRQYFAEDNASLLKKMRHAIAAGLVPVLCVGETLEQREAGQYLEVVRGQLALLAEIGHGDEYVVAYEPVWAIGTGKVATLEQIAEIHAFIKNWCLQNAGGSAKIRVLYGGSVKAENAESILATENVDGALVGGASLDARSFRVICQAAGKMI

SEQ ID NO: 5645 - protein, 331 aa, Chromobacterium substugae
MIAGSVYAADITGAGATFPYPLYAKWAATYKGNTGNNMNYQSIGSGGGIKQIQSKTVDFGASDMPLKPEELEKSGLTQFPTVMGGVVPVYNIPGIAAGQIKFTGPLLADIYMGKVSKWNDAAIAKLNPGVKLPDQRISVVRRSDGSGTTFIFTNYLSKVSPEWAKDVGSNTAVSWKGSSVGGKGNEGVANYVSRIKGAIGYVEYAYAKQNKLAYGLLQNQAGAFVKPDEASFKAAAANADWKKAPGFYLLLTNQPGKASWPIAGATFILMHKKQDKPAQAAEVLKYFDWAYKNGDKTAQELDYIPMPDNVKTVIRTSWKQITDASGKTVWN

SEQ ID NO: 5646 - protein, 320 aa, Chromobacterium substugae
MQKLSNEQQMNYQMLLDKLFRITTRCFAFLVLALLVGILISLLIGAMPAIKGFGLGFLTSTDWDPVQQKFGAVVPIFGTLATSIIALLIGVPVSFGIALFLTELCPTWLKRPLGIAIELLAGIPSIIYGMWGLFVFAPFFADHIQPWVIDHLGPFPLVGFLFQGAPMGIGLFTAGLILAIMVIPFIASVMRDVFEVVPTMLKESAYGLGSTTWEVVRYVVLPYTKTGVVGGIMLGLGRALGETMAVTFVIGNSTRFAASLFEPGNSIASSLANEFAEANGDLYMGSLIELGLILFFITFVVLACSKLLLLRLKKQEGQPS

SEQ ID NO: 5647 - protein, 297 aa, Chromobacterium substugae
MCEALPRASAPVSLKQDSLTYRRRRLVNRVTMACSMFTMAFGLFWLFWILATLLQYGLSGIEWRVFVESTPPPGSAGGLANAIYGSLVMTGFGTLFGTPIGILAGIYLAEYGQRGWLAPATRFINDILLSAPSIVIGLFVYEVYVVSVGHFSGWAGSFALAILVIPVVVRTTENMLRLVPNSLREAAIALGAPQWKVILTVTLRSAKAGVLTGILLAVARISGETAPLLFTALNNQFFNSNMNQPMANLPIVIFQFAMSPYEDWHKLAWAGSLLITFSVLTLNIVARWMGGSKNQSN

SEQ ID NO: 5648 - protein, 254 aa, Chromobacterium substugae
MASPSTKLEVRNLNFFYGNFHALKNIQLEIAPHKVTAFIGPSGCGKSTLLRTFNRMYELYPGLRADGDILLDGQNILARDIDVNLLRAKVGMVFQKPTPFPMSIYDNITFGVKLYEKLSKGEMEDRVEWALRKAALWDEVKDKLKQSGHSLSGGQQQRLCIARAVASKPEVLLLDEPTSALDPISTAHIEELIHELKEDYTIAIVTHNMQQAARVSDFTAYMYLGELVEFGKTDTIFTTPQQKATEDYITGKFG

SEQ ID NO: 5649 - protein, 50 aa, Chromobacterium substugae
MGVEPGEQVQHGESAIIVKAGLLCSRPVASSVYKKKINRVVLPVKTAKST

SEQ ID NO: 5650 - protein, 484 aa, Chromobacterium substugae
MLDLFSGLDTHVAITLMLSLGFVLAFEFINGFHDTANAVATVIYTQSMKPRLAVFYSGICNFLGVMSGGLAVAYAIVHLLPVDLLISVNTTRGMSMVFALLAAAILWNLGTWYLGLPASSSHTLIGAILGVGVANSLINHTSLSHGINWGKAVDVGASLLVSPLVGALVAGLIVILLRRFRPHSNVHKTPYQRQQVEGRKHPPFWTRFMLIVSAMGVSFAHGSNDGQKGVGLVMLVLIGIVPAKFVLNLDSTPYQLERTRDAAQHLQQFYQRHEADLSKIIVKSTSTSQYECHPQQTVATAQNLLTLMGDGSDYHKLSASQRWDVRTQLLCLDDAAKKAATLPKLSSDDKQLLDNLRKDLTTTTEYAPTWVIVAVALALGIGTMIGWKRVVKTVGEGIGKKDMTYAQGVAAQATAAVSIGLASWFGFPVSTTHVLSSGVAGTMIADKAGLQMGTIRSIALAWLFTLPASMALAGGLYYLAAQWF

SEQ ID NO: 5651 - protein, 682 aa, Chromobacterium substugae
MTPPIDLANQPPAVPAALAKKLEKLGIRRRFDLVLHLPLRYEDETHLYPIADAPYGQPVLVEGTVVSHEVSFRPRKQLRVQIEDGSGALLLRFIHFYPSQIKQFAEGSRVRALGEIRRGFAGDEMVHPKTREVREGAPLAESLTPVYPTVNGLTQPMLRKLVHGELRLQTLDELLPLPLLEPLALQPFAEAIRLLHQPPPEWSAQQLADPRLPAWQRLKFDELLAQQLSMRLAYRARRLGSAPRIVGDGSLSERLLRNLPFPLTGAQRRVLADIRADLALPHPMHRLLQGDVGSGKTIVAALAGLSAIEAGYQVALMAPTEILAEQHYLKLSSWLAPLGIGVAWLSGSLRKKAKQQALDEIASGQCRLAVGTHALFQDDVAFQKLGLAIVDEQHRFGVGQRLALQDKGEEPHQLMMSATPIPRTLAMSFYADLDVSVIDELPPGRTPIVTKLIGNPRRPEVVGLVERTCAEGRQAYWVCPLIEESEALQLQTAVDSHQQLQQDLPGRRIGLVHGRMKAAEKAAVMAAFAAAELDVLVATTVIEVGVDVPNASLMVIEHAERMGLAQLHQLRGRVGRGSARSVCVLLFDSPLSDLAKARLKVIYENVDGFEIARQDLQIRGPGEFLGARQSGLPMLRFADLEQDQALLEAARDLAPQLLERWPREAEAHLERWLAGREQFLKA

SEQ ID NO: 5652 - protein, 143 aa, Chromobacterium substugae
MIRIAKAACLATALGLASQLALAGSAAGLWKTIDDETHQAKALVQINESPNGELTGKVIKLYLHPEAVCDKCDGANKGKPVNGMQILWGLKKSGDEWSDGQILDPKSGKIYTSGAKLMEDGKKLRVRGYIGPFFRSQVWERQQ

SEQ ID NO: 5653 - protein, 279 aa, Chromobacterium substugae
MATYRFELVNVFAEQRFGGNPLAVFPEAAGLSDQDMQLIARQFNLSETVFLFPGDAEAAASLRIFTPSYELPFAGHPTLGSAAALHARGGLGDSFALRTRSGLIPIRHQDGLFRLSALPASVRAAGFGSDTAAAMLGLAPEDIAQPPQWLNAGSEQLLIGLSSREAVLRARPEPELFRRHATLHPGRSIAYLWHQQGGVATVRLFFDQQGSVIEDPGTGSACANLGGWCALNGLAPLSWRLEQGEAIGRPNVLYLDVDAAGRVEVGGRAQAVGSGEFTL

SEQ ID NO: 5654 - protein, 156 aa, Chromobacterium substugae
MKAVLLVCLGWTAVCCQAQVFKCRDADGGISYSQQPCPAGSRSLAMDGSAPLSVIDGGDSQRAARQQYRQSLRDWSGRRDKARQAEELAAQRERLAGRKKWLAERQHCQRLAGKQASLRQGLRQGQTASELERLKFRLAKVEDQMQDRACHLYKDD

SEQ ID NO: 5655 - protein, 126 aa, Chromobacterium substugae
MAKEIIHTDKAPAAIGAYSQAVKAGNTVYLSGQIPLDPASMTVVEGGFAAETHQVFKNMKAVCEAAGGSLDQIVKLNAYLTDLSNFGTFNEIMAQYFSQPYPARAAVGVASLPKGVLVEAEAVMVL

SEQ ID NO: 5656 - protein, 396 aa, Chromobacterium substugae
MSVIDLSALTGGLRELPPLALYVHFPWCIRKCPYCDFNSHEPKNGFDEMAYVDALLRDLEFSLPEVWGRPLTSIFMGGGTPSLFSPQAMDAFLAGVRARMKLHPDAEITMEANPGTFEIERFRGYREAGINRLSIGIQSFNPKHLQALGRIHDGDEAKRAVEIALTYFDNVNLDLMYALPGQTLDQALSDLNTALSYGITHLSAYHLTIEPNTMFAAQTPKNLPDDEVSADMQEAIESCLAAAGFDHYETSAFAKPGRHSRHNLNYWQFGDYVGIGAGAHGKISSHAGIVRQMRHKQPAAYLKAVADGAPLQSSQKVARADLPFEFMMNLLRLTGGFESRLFQERTGLPLASIRRQLDEAQAQGLLDDDGAILRPTLKGQRFLNDLLTLFLKEGDE

SEQ ID NO: 5657 - protein, 197 aa, Chromobacterium substugae
MFDQLVLASNNAGKLKEFGALFAELGVTVRPQRDFDVPECPEPHHTFLENALEKARHASRLTGLPALADDSGICVEALGGAPGVSSARFAGEPKSDARNNALLVEKLQGEANRRAWYYCVLVLVRHADDPQPLVADGIWLGEVRDEAAGEGGFGYDPYFFLPSHGVSVAELDAAEKNRVSHRGQALAALMAKLKALA

SEQ ID NO: 5658 - protein, 357 aa, Chromobacterium substugae
MKKLQKLMLALSMSTSLAYAGPSDVLHIYNWSGSLSDNIVRQFEKRCGCKVVQDYYGDNEEMLAKLAAGAKGYDMVFPSSFVVQAMTKQKLLQPLDHRQIPNLKNVAPAYLSQSYDPDNSYTIPTVLSLTSVGYNVEKLKQLGVDPTSWSVIFDPKVLRKIKGKVTVLDSSREVFAAALFYLGKDPNTATDADMRAARDVIKQAKPYWAAFSNASYLKQLAVGNIWVALGYSTEFFQASEDARQTKRPFHIGNAPQREGNEIGVDTMAITASAKRPDLAHQFINFMLDGQNAAQLTNLNGATNPVATASGYFRADLKASPVINPTAEQAKRWTVLRELTPKERRSLARMWTEVKVSR

SEQ ID NO: 5659 - protein, 356 aa, Chromobacterium substugae
MRRSVSGQAARFAAAKNWFSRMNQTFATRRALPPRRLSVAPMLDWTDRHYRYFARQITRHTWLYTEMVTTGALLNGDVARHLRFDEAEHPVALQLGGSEPAELAACAKLAEQWGYDEVNLNVGCPSERVQKGAFGACLMAEPQLVSDCVKAMRDAVGIDVTVKHRIGIDQIEHYDYLREFVDTVAEAGCRTFIVHARNAILKGLSPKENREIPPLKYDYVYRLKRERPELEILINGGVKTNAEIAEHLQHVDGVMVGREAYHNPWLMAEWDAQFYGDAAAGPERAAVVEAMMPYVAARLGDGSNVRHIARHILGLFQGLPGARNWRRMLSDSKLLDGADAGLLRQAYEATLAGRRA

SEQ ID NO: 5660 - protein, 203 aa, Chromobacterium substugae
MTETMAMEALAAHPEYVSIAGIDGLSLDLRYAGSDNFVGRDLYGGTACALLHRRAAGKLAAAARELRRRLPGHRLRIFDALRPGRVQRVLWEIVKDTPQRIYVADPARGSIHSFGMAVDLGIEDGEGRELDMGTGFDDFTELAQPQREAEMRAAGRLSEAQLANRLLLRGCMEAAGFRAIATEWWHFEADDRDWVRAHMRLIE

SEQ ID NO: 5661 - protein, 530 aa, Chromobacterium substugae
MTLPPLLKTLCLAALLAGALPAAASAAKPLVFCAEASPEGFDPALWDSATTYNITKPVFQGLVEFQRGGVALRPGLAESWTVSPDGLNYTFRLRRGVKFHQTAYFTPSRDFTADDAVFTISRWIRPDLPFNQAFKTPLTGPDGYGLSKLIESVQKVDARTVRIRLKERNATFLTFFAMGFAGMQSAEYAEQLLKAGKPQQINQLPIGTGPYRFKSYAKDSIIRYEANPQYWGKPQKTRDLIFAIVADPQVRIQKLKAGECQVAAAVRESDLDALSSDKNVKIASTGASNISYLAYNLKRPQFAKREVRVALDIAINRDALFKALFPKGGATQAVNPFPPSTWSWNPRTRNEYDPAKARALLAQAGYPNGFTVNLWALPVQRPTNPNGKLMAQMIQQDWARIGVKANIQSYEWGEYLKRAGAGEHDVYMSGLTSNSGDPDDFLWNSLSCSVSKGGQRFCNAEFDRLLQQGRQTTDQKKRAQYYLQAQDIFKRERPWITIAHSRIYIPLRANVQGFIMNPNGSFDFEDVWLK

SEQ ID NO: 5662 - protein, 327 aa, Chromobacterium substugae
MNPAWPPGFASHRYQALRSGPRLIVTGAVHGDETCGAQAIRRVMAELEQGALSLAAGRLTLVPVANPLAYQLGRRGGERNLNRNLAPAASPQDYEDHVANWLCPLLAEHDALLDLHSFQSPGQPFVFLGPRDNAGELEPFVHAAKEEALARRLGVGRAVDGWLATYALGVARRRQAPAGDPQLAALGADPRYGVGTTEYMRSQGGWALTLECGQHADPAAPQIAYQAILDTLAHLGMRDAAPPTPRAQEWLSLYEVVDKLDDGDRFARAWASFDPVERDELIGWRADGSPVRAQAPGRIVFPSPGAPVGQEWFYLARPSSRLSAPAA

SEQ ID NO: 5663 - protein, 363 aa, Chromobacterium substugae
MEHEIEHLLQPIGGGAPAGEDLAYSATFDQIREARRSDDPSLSQGDWEQTLKTAEWPLAIRLCEDALRNKSKDLQLVAWYAEAQVQANGVAGLARGLALAAGWLERYWENGFPELDPQDLDERVAKLEWLNQQLGGALRNVPLIKPEFGAYSWNQWQQSREVENLGLKDSYAREAAIAEGKLSGEVFEKAATQSGHGWFQAKAEELVSALTAYEALDAQVDLRFGAAAPSLADIRNAIYACQDLVLRYRQQFAVNKPAAAPQPQPAAEESRTVSHAAPSPVYTAAPASAFDGQIRSRDEAVRMLGEVARYFRHNEPHSPVSLLAERAARWAEMSLEEWLQHVVKDSGTLSQLQELLDVRQDQD

SEQ ID NO: 5664 - protein, 87 aa, Chromobacterium substugae
MKAAIRLGDPTDHGGKVVSAASSTTLFGKQVACVGDSVSCPQQGHVNCTIVEGDGGWLVGGKAVALDGHKVSCGATLISTLPQVSKG

SEQ ID NO: 5665 - protein, 477 aa, Chromobacterium substugae
MWRMLGLFGGITLGWWALLWLVLPVSWQRISPSAILMLHLAPPMLLSVGIKLWAHLKETRAKAEALRQEEAAQSERDGKRAAARAQHEAALRERQRAVSCRWLWAAAVLAKDEPAWLAETADGSYWLALAKDEVEPGEALDALEPHLAELLASLYAEAPGAAWLPLYLEAMPLVPGVEQLNRVKALKQAAVADALGADCHVAGDCRFLPGSGPIADRVLQALQQDPELPGLLVLAADAPLAQRDDDEDWGDVDPALQAHRRWHGEPGMAAVAMLFLRDGLPLPQEMRQDEGADPYQPYWEKEFSGPAAGWGAVPASRQASLAQLPLLAVMAQSSSADLSQDRALQLARQLQPVLDNALVNAGLLDYPFSPEEAKPDGGQAATLAWLCHNSGQIDVGGVRLAAIATALSRHEVELHPIDEASNVVREWGDAGAATPMLLAAVAASHCARLQAPAVLTQFQHDRVSLALARPPLEEVSE

SEQ ID NO: 5666 - protein, 880 aa, Chromobacterium substugae
MSVSLKSLIGRLTPTARQAIEQAASRALARTHFEIEIEHALLAMFDQDDNAALAALRALGADLARVERELDAALDNFRSGNTRNPVLSSWLPKWLEKAWLLASAEHGQDNVSTLDLLLALWQDDALRGALQSGAPALARQDAGRLQGAYAALRQHGGETGNGGAQPEAADDADAGEQPAAPQGKRGSPALDKYTIDLTAQARAGKIDPILGRDVEIRQMIDILMRRRQNNPILTGEPGVGKTAVVEGLARKIVLGEVPPVLAGVTLRTLDLGLLQAGASVKGEFENRLRQVIDEVKASPVPIILFIDEAHTLIGAGGAAGQNDAANLLKPALARGELRTIAATTWAEYKKYFEKDAALARRFQVVKVEEPAPEIAVQMVRGLTGAMAGHHQVEILNEAVAAAVHLSSRYIAGRQLPDKAISVLDTACARVALSRAGKPGPIEDVSVLIENIDRETAALEREEGHAERIAELQARRAELEQDLAALHQAWEAQQKLIAEIDALKAAQDEAKPAKGKKISPLQAKRKELRELQKHQPLAFECVDESVIADVISGWTGIPLGRMVSNELEQVQKLAQLLGERVIGQDHALEQIAERVQIAKAGLEDPGKPKGVFMLVGPSGVGKTETALALAEALYGGERNLITINMSEYQEAHSVSGLKGSPPGYVGYGEGGVLTEAVRRKPYSVVLLDEVEKAHPDVLELFFQVFDKGVLEDSEGREVDFKNTIILLTSNAGTDLVMRACEHGVTVEDVNRDPTAEDLVEILRPTLQKAFKPAFLGRLTIVPYFPIGDEVLRAIVGLKLEKIRQRIADNHGAQVEFPADLAEQMASRCLDVDSGARNADAILTRTLLAQISNDLLARMASGRAVKKIAVSLKGEQVKVRLS

SEQ ID NO: 5667 - protein, 235 aa, Chromobacterium substugae
MSILSRILGRKAMPIQLAEPQDAPPQLRAALDALQREEWQQALKLAQPHLEAKSASLRADAYRLCALASSRQMQWSTALSCWQKLFELEPSARNALQLASCSVMAGEVARGKAWLMKFDELNHASREVPCAAAYVNFIAALAQAGHARETLPYLAWLRELYRQLRITDDQFLQQRGVPFFPVFLENSWPLLRQCLDDQALLNWYAPMLADLDENGCAALRGWLGEMMPAAAANDE

SEQ ID NO: 5668 - protein, 338 aa, Chromobacterium substugae
MASPSRRSPRDLTRELAADASQFGFFQAVRLLGLAGRKRGAKRGRLPDALRFRTLASLSFPASELTTYRQAEAGSGGQDEMTISFLGLTGPSGALPTAYTELLLERKLRHRDSTMHAFFDLFSHRAGALFFEAWCKYRSWVNVEAGERDGFTRNLLDLGGVGLGQLRQQMGPGAELDERMFVYYAGLLSQKPMSAQALTTLVEGFFGVTASLEQFVGQWLPVPRAEQSQLGMEGCELGFSAFAGERIWDRQTKLKLRLGPLRRAQFDALQPHAAGAQALRALMKFALGHALAVEVCLVLDKRDVAAAVLGDASLRLGGDGWLGKPAGHPDDMRYTLLS

SEQ ID NO: 5669 - protein, 619 aa, Chromobacterium substugae
MLESLLPYYERELGHLRELSGEFARRYPKIAGRLQMEGDQCADPHTERLIEAFALLASRVHKKLDDEYPEVAESFLDVLYPHYLQPIPSATIVQFECDPARPEIAKRYRVERGQPVHAPAIGGVVCKFRSAYPVDLYPLSLENAKLELTSGSPYLRQLAPDAAALLTLEFHTHGGLAVSDIGLESLRFFLDGEPALMHLLYELLLSKVLRIRVGDGSEDPAHSALLPASAILPVGFGRDEGMLEYDERSFMGYRLLTEYFCYPEKFLFVDIGELAKAAPRLTGEKLVLQLVLADYPDSERHHRLQAQLQAHHLKLGCAPIVNLFNHPAEPIRVSHQKAGYAVLADSRKPLAYEAIQIRRVVRVEKSGEGESSEEVPPFYATRHGSEKQAPRFYWHASREGSPRAGDKGTDLELHLVDLAFNMVRPAAEVLSLDLLCSNRDLPEQIPFGGSQSTQRTDFSLPGHSVVKRVRLLRKPSASQRSPLGRAVQWRLISHLSLNYMSIVDSGCAALQEMLALYNLTASPVNVRQIQGIVGIHSEAAVTRVSGRDFAGFVRGSEIRLKLDADYYVGGSVYLFASILERFFALYCAPNSFTRLRVETVQQNEEVAVWPARAGEALVI

SEQ ID NO: 5670 - protein, 41 aa, Chromobacterium substugae
MRIFAPLSEDSQPLQMEGDQCADLHAKWLIRALALLASHVR

SEQ ID NO: 5671 - protein, 535 aa, Chromobacterium substugae
MEFTYEEVENGLKVKKPTSLSDRQAAMKEGMTKVLNKLAQPDFKPQLLKIKLCVYGFSRGAAEARAFLWRLNEQMPDGTFFGIPLEVKFLGIFDTVASVGLTELAPGATGHLDWGGDMALPDKAWLLCCAHMVSAHEQRLCFPLDSVGNSASGGYPSCVQGEWVYPGMHSDVGGGYPPNDQGKARGEQGLLLSQLPLNHMYRLAFDAGAPLKINAAVLQEGAAADKAKLAVLQKQESWRFMSQEVIGLFSTKPLLEVRFNAWREASKASGSLTAILQEQTAQINAWRIERYAGGLKCQGGQGQQNADYFKYAQAKRETPSWAIDQENAAWSKQSSTGRADEVHMTPPTWKLPSAQERRFVDVPIPEDKLSDMDKAYIGKPFTPNLSKVYEPTRDGTQLQAGAKDFSDDYQGKISVGFNPVGWLATMFTAVSRMFSKDCTGKERALLIDKSEKLYPDVKDNAELMALYDEHVHDSRAWFMYSALSKLEPNGSYWRYRTVFFVHDDNKKLICESDEANEAFKKELERREQVKAFTQR

SEQ ID NO: 5672 - protein, 263 aa, Chromobacterium substugae
MKPQIVMTAPSPEAWLYRLLQTARELELPWLDLIVDQAEMGSRWQSLVGTLYPPRMLLQDTPHADAADEGPVLVRLDANQPQTRLLKLLRQWQGQPRVLALFSGWDYDQLAERLTLCMQASWDKGLQQGVLRFHDPRLFAAVVDALDEPRRQLLLEPALQWHWLDRDGHARMLDATALQALAPLEWKHDALTLEPPHIDALACWHLAEIWRQNHLLVPQLYGLDSEEELVRRLALAHQAADKAKLWSEAERMPEVERMLREHA

SEQ ID NO: 5673 - protein, 229 aa, Chromobacterium substugae
METGPDEISADNAKTGKKSQGHLQHHADALKAWEAGSNTDKDGKTAQDQAGQQPLLVLSGPAGIAALTEQSQTISAGQNLNLVAQRDANHTTGRRWIHNVGQHLSLFVAGVKDKVALKLIAAKGKVQVQAQSDAMELTADQDLSITSVKQKIHLNGKQEILLTSGGAYVRIKDGKIELHAPGTVSIKGASHDWSGPDQMNPPLPRFPNTVCKQCMAQGFSQANPLVAAK

SEQ ID NO: 5674 - protein, 46 aa, Chromobacterium substugae
METGPDEISADNAKTGKKSQGHLQHHADALKAWEAPSCTTSEEDAA

SEQ ID NO: 5675 - protein, 43 aa, Chromobacterium substugae
MIYQTYGEDYHVTPRPEPLPAAAGQADEPRYPDDGVESDGGEL

SEQ ID NO: 5676 - protein, 202 aa, Chromobacterium substugae
MKPILFYDTETTGLPNWSAPSDDPSQPHITQLAAELVDEDTGDVLDSMDMLIQPDGWTIPDDVAALTGITTERAAEFGVPLAQAMDSFLALWAQVERRIGHNEPFDARMIRIELMRLYGDERADEWKAGAAFCTCSNSTKLVNLPPTEKMLAAKRTGPKPPNLAEAYKFFTGQDLLGAHNAMVDVAGCREVYFGILRHREAA

SEQ ID NO: 5677 - protein, 602 aa, Chromobacterium substugae
MKISSITIKNFQGLRNAALSFSSRIALIAGDNGAGKSSLRDAIAMALTGVATRVERKKDFGQLVSEGAKNSGVRVDFDDGRHAAVSLPDGKTAGIAIDNDTAQDTLPYVLAPEMFAAAPTDSRRALLYALTGCNANAAEVEKRLKKRGAEQRHIDAIMPLVLSGFPAALKDAQARATEARGAWRALTGETYGDKKAEGWQQDAQAVQDGDIQQAQQDAQAVQDEIAQCQQRLGELRARRQQQDDRQRQLTGLTAAAAPLERIQTRLKVDLVELARVRDEVEAITAGPAPRVGLVHDLARALNLSLTMAIPLGQMNPEQRQHLKTANAALDQYAAEHGSLADDGVPPSAEDMARLPQLQHSLDMMSRAVANDERDLKIAADAAAQLQALHGAEQLAPVTDAEVAALVERITTLQASHRQLADTLATLQEQNRVAADAVQRTRQAAQHHADVQAWTLIADAMAPDGIPGEILADALRPVNDRLFELARLAGWARPLIANDMSISADSRAYGLLSESEKWRVDCIIALALSIMSGLRLVLLDRFDVLSIAGRGELLDLLEALDDELDTALVFGTLKSPPAGDEVIQSVWIKGGEVVVSETIPQAA

SEQ ID NO: 5678 - protein, 82 aa, Chromobacterium substugae
MSNHITTMRYAMEIATLAQAVAERDGQIEQMRILIEMKDQQLDTVLKSAKDLADQNTALVARENRRAERMSADRAKERSKAA

SEQ ID NO: 5679 - protein, 293 aa, Chromobacterium substugae
MNAPRDFRAMTADSIGKDLLGALLQEIKLMPDVWQKLPQQKQDDVIDRIRARVETNIRMAVHVLASEGRTTVVGELDQVVRKDGIKAVFKINSNAEGRHELFDSERKACLIIIADAGENLAGMDDIHGETDQRALDLGHEYHNNDGGGMDDVQDGNVVDAEFEEVKQLPAPGDATPTEAELDAAFDAGYDAAEAGEPESACPVMAGALCIEWVKGWKAAKEDAAGAELFTDKQPEPEPELERKITQPAVRYRHPTNENQTWTGRGRKPAWVQAWLDAGGTLEELAVDDEPEAA

SEQ ID NO: 5680 - protein, 70 aa, Chromobacterium substugae
MGRVIATRPASSIYTPDRLKELLSDAETNASSDWDRNFIDSMQERLRLYGMGMHISALQRHHLERIAANF

SEQ ID NO: 5681 - protein, 396 aa, Chromobacterium substugae
MTGAATNLAELKRVSKMPAAQAGIGSVKTFFESQKATLVAVLPKHVNADRMLKIALGALRTTPKLMNATVESLMGAVVQCSQLGLEPNTPLGHAYLIPFDKNKKVDGQWVVEKTEVQIVFGYKGLIDLARRSGQIISISAHEVCQNDFFEYSYGLDEKLVHRPAMSNRGEVIAFYAVAKLVGGGHAFEVMSREQIEEIRNASQGWQSAKRRNKEGDSVWGQHFVQMGRKTVLRRLFNYLPVSIELATAAALDGRASDGASQGLDNVLQGEFSVVDDDAPQIGQDDAGREDGQQAALGAPADVDTDTGEVLTQQQFRRQRQADPVYQAAEAEESQQRAEAQPMFGLQDALAAVRAGNLDDARDMARSLSEKDQQIIEQTIANEQQPAARQRRQRDLE

SEQ ID NO: 5682 - protein, 272 aa, Chromobacterium substugae
MAEPYRVRASSWASLFDCAHRWEGTHILGMRMPSSPRAQLGTAIHAATAAFDEAVLAGQAIRPVDVAPVLVDELASPDREVDWSADELTRRDAERIGLQLVTRYCLEIAPRYHYVAVELEVVPWLIDCGGGIVIEIRGTLDRSRARADGTGGVGICDLKSGVNAVSQGRAKTKGHAPQIGTYELLYERTTGQAVTLPADIIGLKTSGAPEVAVGQIVGAREQLIGSDDSPGLMDYAADMFRSGLFPPNPTSHRCSAKYCARWRVCKFKDDQP

SEQ ID NO: 5683 - protein, 167 aa, Chromobacterium substugae
MEHTFKILVLHEGYYSDSGAEITDENGFVIIDARQTAILLGYADKLGIDCPSDDERARLEFTKEQQAANARRIVACVNACAGLSDAVVSHGLVPASRHSTVAHQRDQLLAALRKVLELSNEAGADLHCLLEGDTKKARLDARDAEIHLLALNDVAKAAIAAVESGHG

SEQ ID NO: 5684 - protein, 104 aa, Chromobacterium substugae
MPCAAVGSLWQHLMIQDRAERQADHLKEKAGEFQVAYTNGGIDWEDVAGSTEATLAMNAQLLDLVHKMPDCPARRLTVEMLEAARADYVARKLREYVAAQRKVA

SEQ ID NO: 5685 - protein, 42 aa, Chromobacterium substugae
MSPLLQTINRIERRRAVVAAAKSIAVCVGIVVLLAAVNLIGS

SEQ ID NO: 5686 - protein, 74 aa, Chromobacterium substugae
MSRKRADRKNHVKSSLTDRTYDAMQRYMELHGIDTESAAVARILDLALLGMVGSIPEMLIEHTPSNNGTKRIAA

SEQ ID NO: 5687 - protein, 101 aa, Chromobacterium substugae
MRLKAGELGIDPDAEKERFILHHQAATTLRADETAWQKQFGKWLLDQHQINADRERITQSRMQASQSNTGNRQAAMSSMYNPPRRDMPAEREIQGETIHEQ

SEQ ID NO: 5688 - protein, 266 aa, Chromobacterium substugae
MSNDLITGATGSIPLRWVDEIFRRLMGRFGAQFADKYRDGQQATVGGTIVDAGIEEAKKVWAEELDIAGATPNQIVRGLAHRYTYPPTCDEFIRACMGEIASNNRDPEVLFYRAVTEMTKRRRHEPQDWPSQPVFWAAVAMGDDLLRGDYKAMAGRWRAALDANRERMADIPDVSPDHALPAPKMSHADVQVHLADVQRAAKRMRFPDEGRMRLDNWLKIADEVARGVYRGTTIGKQHAAAALKKAGHAVPDSLIPYLPESTEQST

SEQ ID NO: 5689 - protein, 48 aa, Chromobacterium substugae
MEMHEVKGHWQDDARAKIKIAADQYPFRFIAVKVQAKRDGGGWAVEEF

SEQ ID NO: 5690 - protein, 112 aa, Chromobacterium substugae
MSMVMRWLDKHTEFREQYARAREIQADTLADEILDIADDGQNDTYPIDGTGATGVNHDVIARSRLRVDARKWYASKLAPKKYGEMVKQEITGADDGPLIVEIVRYAPDKPAE

SEQ ID NO: 5691 - protein, 484 aa, Chromobacterium substugae
MPRISLPNNWKPRGYQLGMWGYLERGGLRAVEIAHRRWGKDEVCLHWTAVAAHQRVATYWHMLPQASQARKAIWEAVNPHTGRRRIDEAFPVELRATTREQEMMIRFRNGSTWQVVGSDNFNSLVGSPPAGVVFSEFALGNPAAWAYLRPILAENGGWALFITTPRGKNHAYKLLQTAQASADWWGEVQTAEDTGVFTEEQLASERREQVDLFGEDAGEAFYQQEYFCSFEAAVLGAYYGREFATMRREGRITKVAHDPAFPVHCAFDIGWSDDTSIWWFQVIAGEVRILESYSEHGQTVADIVGELAGRECEMDIIAGEVKFRFSDDIEGLEHRRAYRYGTLWLPHDGAAKTFAASGKSVQEQLAAHFGWGSVRIVPSLSLQDGIQATRALLRRCWMDADRCTDGISAAEAYQREYDTENRCFKEVPLHNWTSHLSDGLRMLAVAWREPVENEQQKPAPKFFEHMTADDLFWGDTGPAQRKRI

SEQ ID NO: 5692 - protein, 796 aa, Chromobacterium substugae
MTTETQIPADPEAARWIAEINRYEAKAGPWHERGKRIVKRYKDERESELAKTASRYNVLWSNLQVMLPAVYARCPKPEVERRYKDDDPAGRVASEVLERSLAFTQQLTGFHFIVKNAVRDRFLCGRGVAWVRYVPHLRDASVEGDADVRAAGAQLTDDAPDGDESAGQLAHVPDGTEMVDYEEVMPDYVHWTDFGHTGDARVWEEVTAVWRRVYCTRAELVKRFGEEIGNAVPLTKAATPDGNQTDSATVPQKAIVYEIWDKPTRTAIWVCKDHPQKVLDQRPDPLKLNQFWPCPRPLFATLAGDTCIPTPDYAIYQDQAEELDGLTQRINALVKAVKLVGVYDGSAEGVERMLSEGVENRLVPVKNWPAFAEKGGLAGSVQFLPLEQVAAALMQLYEAREKVKQEMYEITGMSDILRGANDPSETATATRAKGAFASIRLRDMQDEAARFARDLLALMGEVMAAHFGMATLLTISGVELLPQAQKLQLQQMQQQPAMPQGHPQAPQQPGQPPQPAPAPAPQLSPKLLKAMADPSIEEVDALLKNNAARTFRIDIETDSTIGDDEQQEQQQRMAFLDSCSKFLQAAVPAAEQNPTIAPLLGELLMFAVRSFKVGRSLEGAFQATLDRLQQLASQPQPPKPDPEMIKVQGRLQEVQAKGQVEMQLEQMRGQVSIQVEQAKLAALKDLEQFKAQLQAQVDTSAQAAQAQQNAHQNALEAQREMMQQQFDERMEQMRMVLEQQRAEADQNLQIILANLNNAARVEVAEITAQTTLQTAQISAAAAAERADSAEPNGSDE

SEQ ID NO: 5693 - protein, 121 aa, Chromobacterium substugae
MPIYVMKCQHCQHTLDIYRRVAEMNDNLPECCGLVMERQITAPFIQPDQPAYQAMAIDSKTGTAPMIEGRAQHREFLRRNDYVELGPESSKPKPRTEVLGDFNVRRELTEATREVLAKHNA

SEQ ID NO: 5694 - protein, 119 aa, Chromobacterium substugae
MTETTIEQQIQAKGLTAPRITPADVESAIASEHYFTAGQGVAGATGVYPNDGHPGQPLALLTFCVLVLKNGFTVTGESACASPENFDAEIGRKIARQNAVNKLWPLLGFQLKQKLHDAK

SEQ ID NO: 5695 - protein, 372 aa, Chromobacterium substugae
MSEHATAVPGGEEENDAGEQSLREQLQAAYTELNSAPNDPPPQPKPAAEQQTTGQGEPKPGTAARDQQGRFTAKPEGAPAAAAAAAQSVDKTAVAAPAADASAAQPAAATAPPPSWSAEARPHWEKIPPEAQQYIATREAQMQQQFSRMDDERQTGRQFREALKPFEHTIRQFNVPPVVAAQHLFAADAALRYGNPDQKIQMVHQILRDYAIPLDAVAQFQPQQVDPAVAAMQKRLQQLEQMQLQGVQQQHEAQQADMQRQIEAFQQGKPHFEQVRGDMAVLLQSGMASSLDDAYERAVWARPDLRQNLISKHDADQREAAAQAASQRAQQAKAAGVSLSGAPGSVTPAAANQNLSLRDELAQSLRAARGQV

SEQ ID NO: 5696 - protein, 329 aa, Chromobacterium substugae
MGLQNPSATMTEIVTTTLRNRSGKIADNFTKNNALLYRLKRKGKVKPVSGGRTIVQELEYAENSTYKRYSGYEQLNISPSDVFTGAEFNYAQAAVAISISGLEELQNSGEEQVIDLLEGRISNAERTMTNNVALDCYSDGTADGGRQIGGLQLLVSQNPAQGMVGGIDASTSIGAFWRNLAFSALRNGGAAVTPQNIQGYMNQLWINLLRGADKTDLIVADNNYYLAYLSSLQAIQRITSSEMAEAGFESLKFMGADVVPDGGVGGGAPANSMYFLNTNYIFLRPHSARNFAPIGDNRYATNQDAMVKLIGFAGNMTCSNRRLQGVLCA

SEQ ID NO: 5697 - protein, 288 aa, Chromobacterium substugae
MARWTMQDALIGTVDLGSVDPVGPGPEMLVGPNAGKMGRYNLPSQFVDGTHSVLGGGFFAFAQVAPIAAQAVQSITVAAGVATLTTTAPHGLAVGAAISIAGAQPAGYNGQFIVASVPSTTTLTFNVGLVIDTNSQQPIANPNTPTGNATVVGSYTAGIGAGQVVQFTHTLDGNGNLILQAQPWAGVKNSGLSLGAAISNPPAGQWAWFQVGGAMIVYTSGAPAVGGQAYFGAAGSVQPGASASLQMQGVQYASAAGATIGSGNGQIVLPANQAVLWGTFPLAQGAIT

SEQ ID NO: 5698 - protein, 79 aa, Chromobacterium substugae
MNITTEEIRLIALAFAATNRHPDPHAHADEVVAAFNELVSHIPGGFSQAPAAPASLYAAPQQEHAEPAAQQPYIPTLNN

SEQ ID NO: 5699 - protein, 222 aa, Chromobacterium substugae
MNDAFAPEKYSFSPGQTIAQVSHGNDTGLYVEFHTEAVHQPFESQQEGRPIFSEIPFITILFPGDKTKKVVRPVKLQDDEAGPSDLRRFPNQWAAFKQEMTQHGDGIPLEQWPQISKVEVAELKALNIHTVDQLAALADGNLSWLGGRQLRDRARTWLEAAAGNAPMARMQSELEARDNTITRMEQSMAAMQAQIEDLQNKLQEPRTAAEAAESTSRRSRNA

SEQ ID NO: 5700 - protein, 153 aa, Chromobacterium substugae
MRWQLLGPATPQEWQVLKSAVVPLGPRRRWRVLAGQFVLFPVPSPTDNNTLVYEYYSNCWCQSANNVPQPQFAADTDTYLLDDNVMVLGIIWRYRRKKGLEFSIEYEDWKRARDRAIASQAGMRDLSLTSGSGLNPFISTANIPDTGYGNIGS

SEQ ID NO: 5701 - protein, 510 aa, Chromobacterium substugae
MASFSPTTSGVSVPAPVGGWNARDAIANMPANMACILINMFPTPSDVEIRPGFQNWATGLPGQVDSVFAYNGPAARLFAASSAGIYDVTNSGAVGAPAVAGQSSDRYVTAHMTTPGGTFLYAVNGLDYPQLYNGSSWQQVTATSSPISITGIPLNQISFVHTAKSRIWFVIGGTQAAYLPVQSLGGAAQIFDVGPVFRNGGKLVAVGSWSVTGGFGAQDLTVFVSNTGEVAIYQGTDPSQLTTWSLVGVWQFGSPMGNRCLTRFGDDLLYLSKDGLQSMNQGRFFADVSDNKSALTDNIQWAISNATSSYPNNYGWQAIAYPTANALIVNVPVSQGQQQQYVQNTVTGAWCQFQGWNANAFEVFHDQLYFGGAGIVAQAWKGWSDNGAAIQAEALPAFSNFGQPATLKNWTSAKPIFSSSGQPSFLMMLNIDYDTTPPIGMMSTAPITMAMWGSAIWGTSTWPYGQTIINNWQSVTGMGYTAALHLKITTNGANVKWMATDFAFEIGSVM

SEQ ID NO: 5702 - protein, 134 aa, Chromobacterium substugae
MKRIIFDEPERVGRWVCEAAGGRWVEGNPAIGMEVDGQLVVGVMYDSWTGSSIAIHSRCDDPRALNREFYRHIFGYPFNQLGVRRLTGLVGASNMRARRLDERLGFRQEATLADYFPDGDAIVYIMRREDCRFL

SEQ ID NO: 5703 - protein, 429 aa, Chromobacterium substugae
MRYDHFTMLPERAFRPAGFGTSKLATLEGGGKGGSAPAAPDPTATAAAQTTSNQQTAAYNAALNRTNTYTPLGNSTWTQNGTDPTTGAPIWSQSINLSPGQQHLYDSNMQGSQMMQNTSNQLLGNVGSQLSSPVSTNGMPAVQSSVSTSGMPGYAGPVNGGDLTGLAQNATNASYNSQMSLLQPQMDQANKSLAAQLANQGITPGSEAYNNAMDNQARQQGFTQSQAANNATLQGMQYQNQLFNQGLQNANLQNTAQAGLFGIGMQNAQLNNSANQQMLQNQLTMRNQPLNELNALRTGSQVQMPNFSGAPGVSMNPTNTMAATQMAYQGQLNAYNAQAGQSAGMMNGLFSLGGMLGSAYMLSDRRLKKAVQRIGTGVRGLALYAFRYLWQSDRAPRTVGYMAQDVRRVAPGAVFDAGGGNLAVNMGAI

SEQ ID NO: 5704 - protein, 575 aa, Chromobacterium substugae
MMNGMNLLYPNLAQTQQQIELERQVGMQAMNQGMQPQPLQSVGGVAIRQSPLEGLARMLQTWTGAAMAKNAMSQQSELNQQYAQYLRGQFGADGAGAQPATQQQSDPGLSDAGNGSNPAYAAALQALAERGATAGPTRQATALAQALQQSSSGGGDGGGAGQTPAPPPATPPSAGGASMTLPGMTPQQAMAMYLMNPDKYTEAMLSQYKAPDVVTKLRAAGIDPSSQLGRQVLQDSIAKDNYIAPVPVRPGGGLVDPRTGHITTMPAAAPEGFQSVQTADGSWAMVPVQGGTAAVQSSAQAKAAGAAAVKPMTAYDADGNPVFTSELQASGGAPAGGGGRFAGYQAPGQAAGGNLRPAPIAGTNDSRVTIAQANAKRYNDLTTAATDSPTRVNVLDNIIQLSQNGVNTGPGSAWQNKILGYAANSPVLGSLVAGKKDSVTQFQEMQKFLAQNGLRQWQASGGTGTDSQLNAAMHANPNDEHFPQALQALATWNKAGEMALQAKAAAASQYMAQHGNDATQYNQFDNMWRQNFDPRIAQMQLMNPQDLQQFVGKLQPADKAQLLRKYQFVKQQGWM

SEQ ID NO: 5705 - protein, 821 aa, Chromobacterium substugae
MQENPKGNLSAVGPVPAVGDPNDRAIGLMQIRQSIANKLGIDPRDPAQAIDGAAQLLAGSLQRNGGDPEMAVTEYHGGTNPANWGPRTQDYVSKVAGYFQQLKQQPQPQMAQAAKAAPPPAGADPIMAALSGTAAPAAAGSQGQSDPILAALQSKSPVPVAQTKAAKPATPATDNVATTLSAVLPGGLGKDLANSGVGDFIRAGQHHLLNPVLGASQLLDNGVDAGLQMLPDNPVSRYWHGVTQNNNAYMAQREQQYQANTPTNAASVAGAAIGDAAPFLASGGASLLGRAGSIAERLPLVSSSASARRIANAVAQGATVGAMQPVTNAVPPTMSDLITGQGSKAPSYWQEKALQTAIGGAIGGAVSGAANGARGLYQAAKPVISPRATAADTLAAALRTPAQSAATAPAVEGAGASAAAPAGAAGPAAGTASNAADLAAALRTPAQQFVPGSRPTLAQVLQTPQAVQLEKAVSNLPQYRAMFEQRAIENNAARLQAIQGVAGTPDAMAGAIQARQDAAGPLYAAARQESYVPDSTLTDLLSTPAGASALQRARQLAANSMDRAPIITDDGDLTGTGGHYMKMAFDAMLDEGQRTGMAGAEQNAIRNLRGNFLDWLDTQSPNYASARQSYRDASVPISDMEAGQSILDNLGNRALNAAGDPSITLNGYNSALARALRNSDYGISDDATAALTGVQQDLQRSSISNSLKSSGSDTLSNLAANDWLMRQLTGEGSSGGTAQKAAAAAIGTVIPGVGTMGGWLGAGALQDAATRRAADQLAQALLNPDVANQLLQSQTTVSPLLLQALRGTPAAAANVGAQAAP

SEQ ID NO: 5706 - protein, 838 aa, Chromobacterium substugae
MRNGSGQYNPPAGNPVQAGTLMDPNAFNSTISDIGSEITNSVPRDGQAAPTANLPMGNFRHTGVANGQARNDYAALAQVQDNTVQTLTSVGGTDTIVATVLPAFQSYAVGQVFRGVMVGSNATTSPTLNINSVGAVPIVLPGAKTVSVGDIPANGAVFFYNGTQFVLLNPVSTYSHVVPNLTAVRALVKTGAPNAFVTGHDAQGDGGGGNYYLDPLDTTSADNNGTIIVATDGGRWKLSPVGSNINVQTFGAKCDGVTNDTAAVQAADIYAAAVHKKLKIPGVCYLPTYVFTSELEDTMGQMFTPNSNVTISANSFVRPEWWGTQNNIVDLAIHALPASGGIVQLEDKTYPPNGYAVGMSGVGSGKYISKDNVKLVGRKMPSLTNDCKALTGGTIIQGMLLAWANQFEMSDLGIDCGYTVLQNVYGGVEAAGITEAYNFTYPDTTTAASPPAAPKMSSKLHNIIGLCSSPGAPTHAMLIGEGLQGLETSGVIMAVYGQHGVVIKCKNAFVERIEAYMNQSDSVIFKADAGATQIAGGVDVESIYCRAAGPINTAPYATSQCNAGVMLNAHANNLDDIKIGTIHCEGYPFSVYYTWDGPYAISSIDIDHIFSDQFGVTVAGRTAVSMNGTAGQSLQRNSIKSIDARNTIFAVAHNMQGGAGLVSEIGRLEATNVQNAVNVGYGSVLSINVLSVTSASDAVYFITGSPRLLVNMLFKDVATPAVYSSLSGSTPPTLSNSWANQGGVGNEQFGVDLLGGKISLKGLLTPGTSNVIATLPYWARPVSNKRYSAVGFVAPNNVYSVPITVGSNGVVTVNEVVGGTANCSTYVSLSGISYDIVS

SEQ ID NO: 5707 - protein, 100 aa, Chromobacterium substugae
MGESQDVTVARLDERMEGMQREMSAMAQHMQGLASAVQEMTRAQARISTVEAHISTLQSGQDAIWKEIRRIDGRRENGIFEVVKLIVYCAAGAFVSHVVR

SEQ ID NO: 5708 - protein, 160 aa, Chromobacterium substugae
MANFNAAFTALIGNEGGYSNNPHDPGGETMWGVTKRVAVAAGYTGAMRDMPLATAQAIAKREYWDKFQCDALPDALAFQVLDAAYNGGFPAKWLQNAVGVHPDGHIGQATIQAANAMDPARSVLRFLAYRLAYMTTLRTWPTFGKGWAARISRNMLKGAV

SEQ ID NO: 5709 - protein, 194 aa, Chromobacterium substugae
MDPISIAMGLASFVPDIVKWISGSDKAADAAQKVVSIAQQVTGTSSGDDALAAVRGNPTLALQLQQELDRHSEQLNQISQAVQLAEIQADTADTAAVNATMQAEAKSDHWPTYSWRPFIGFCFGLLALISGITVAACYLGVMFGGENPQVLAQLPGMIGAEAGVMATMAPVLGIASWFRGKMQADPRVQTDNRG

SEQ ID NO: 5710 - protein, 261 aa, Chromobacterium substugae
MAEGIQIWAAPTERCDDAALRQAYIALLSDEEAARWRAFAFDRDRHVYLVARALARTVLGEALGMSPASIEFQQGPYGKPSLRGAAAGVGLRFNLSHTKGMVALALARDRELGVDVEGVERRAALDVAWENFSRDEARELSARQGQAQADRFWTLWTLKEAYLKALGCGLSAPLDCISFVDDDQGGLRYARRGSGHADDGRWHFWHGVLAGTHAVSLCAGAREGEEVPELILRETVPLLAAREVPFLPALGPIREEGTASS

SEQ ID NO: 5711 - protein, 461 aa, Chromobacterium substugae
MSKSQRVETDSFGPIDVAGHALWGAQTQRSLAHFAISSEKMPPELILALARVKRAAALANLELGLLDGAKAQAIVTAADEVLAGRHDGQFPLSVWQTGSGTQSNMNMNEVLANRASELLGGERGVRRLVHPNDEVNRGQSSNDIFPTAMHVAAALGLSERLLPSLAALRQMLEAKSREFGGIVKIGRTHLQDATPLTLGQEISGWAAQLQLAEQALQASLPALCQLAAGGTAVGTGLNTHPHFGTRVAEVLSQQTGLPFASAANKFAALAGHEPLLAAHGALKTLAAALMKIANDIRWLASGPRCGLGELTLPENEPGSSIMPGKVNPTQCEAVTMLCCQVLGNDAAIAIGAASGNFELNVYKPLIAHNFLQSLRLLSDGMASLAEHCVQGMQPNRDRIAQLLEQSLMLVTALNPHIGYDKAAAIAKHAHQHGGTLRQAALALGHVSAEQFDAWVRPESMI

SEQ ID NO: 5712 - protein, 340 aa, Chromobacterium substugae
MSATILVTGAAGYIGSHTCVELLAAGFDIVAVDNFCNSKFEAIRRVQELAGRELAFHEADVRDQAALDAIFSRHRIDAVIHFAALKAVGESVAQPLRYYENNVVGTLTLLEAMRRAQVRQIVFSSSATVYGDPASVPIREDFPIGAITNPYGRSKRMMEEILEDLARAEAGWKIGLLRYFNPVGAHASGRIGEDPNGVPNNLMPYISQVAVGKLPRLSVFGGDYPTPDGTGVRDYIHVVDLAIAHVKAVQALPGVDGVLTVNIGTGQGYSVLDIIKAFGRVSGREIPYQVAPRRAGDIACCYADPGKAAQALGWQAERTLDDMCRDSWRWQQANPRGYES

SEQ ID NO: 5713 - protein, 473 aa, Chromobacterium substugae
MLKSLIDGLAGRLKKTTTEEETPAAAAKPDRTLLDPPPPDDEPVDLPPTLGFVSHQPVMDKQQRVVAYDFFVRQGKRNVEAGKQQEFDRLLLATLQNMDIFRLLAYRRAFVHISMTSLDEPLLRDMPAGSVIFVLEAGPGMIVNEYMLNQLDQLQKLGLRFAVEPAAYEQGALSAALQADLFGRVDFMVLDFAGPSTRVLAPILDQLPKRYPGARWMARNVGTAEDLDVCLRAPGHNRFALFHGPFVTTAHALEGGKVDTSQTRVLQIMRLLRANADPKEVEAQFKLDSVLLFKLLRFINSPIHGLARKVQTIEETLLLLGRETMFKWLSMLLFTSRKEDGTAVSLLEKSLIRARFLEKLGSYRGNKLESEHLFLTGMFSLLDVLLNVPFPDVLDPLELPLTVREAVVEQKGIFAPYLALALACEHGDNVQIEALARVLDFDLDLANQYYLDSVVWAQVVLRDSEVHNNVEAV

SEQ ID NO: 5714 - protein, 366 aa, Chromobacterium substugae
MSGNSMGRLFTVTSFGESHGPAIGCVVDGCPPGLALTEADIQLELDRRKPGTSRHVTQRREPDAVEILSGVYEGKTTGTPIALLIRNTDQRSKDYGNIADTFRPGHADYCYWHKYGVRDPRGGGRSSARETAVRVAAGAIAKKWLSEKYGIVIRGHMTQIGEVAIPFKGWEHVGGNPFFSADPDIVPRLEDYMDSVRKSLDSIGARLRVVADNVPVGWGEPVFDRLDADIAYAMMSINAVKGVEIGAGFGCVAQRGSEHGDELTPQGFASNHAGGVLGGISTGQQIDVSIAIKPTSSIAQPRRSINKQGEAVTMETHGRHDPCVGIRATPIAEAMLALVLIDHALRHRAQCGDVRVETPRIAGRIG

SEQ ID NO: 5715 - protein, 472 aa, Chromobacterium substugae
MSASTQALARKLGGWQLWGIAVGLVISGEYFGWSYGWAQAGTLGFLCTSLFVALMYTAFIFSFTELTTAIPHAGGPFAYARRAFGPLGGFIAGFATLCEFVFAPPAIALAIGAYLNVQFPGLQAKWTACGAYLAFMALNIAGVGIAAAFELCVTLLAIFELLVFMGVVAPGFDWANFTRHGWARQDGFHWGAVGGMFAAIPFAIWFFLAIEGAAMAAEEAKDPARTIPRAYIAGILTLVALAFGVMVMAGGSGDWSLLANINDPLPQAMKLIVGEHSSWLHMLVWLGLFGLVASFHGIIMGYSRQIFALARAGYLPAWLAAVHPRFKTPHRAILAGGAVGIAAIFSDDLVQIAGQPLTANIVTLSVFGAIVMYIVSMLALFRLRGREPALFRPFSAPAYPWLPALALACATVCLLAMVRYNLLLAAIFAVTLLLGFAYFLLTRKQRDAAGGDAMLEGTADAAPAPQSARAPT

SEQ ID NO: 5716 - protein, 460 aa, Chromobacterium substugae
MSHAITVGPRRYRFDDLKTLLARASPFRSGDQLAGVAAASAEERVAAQMCLADLPLTVFLNEALIPYEEDEVTRLILDSHDPAAFAAVSHLTVGGLRDWLLSDAATAETLAALAPGLTPEMAAAVSKLMRNQDLVQAAKKCRVVTAFRNTQGLPGRMGVRLQPNHPADDARAIAAATLDGLLYGAGDAVVGINPAGDSPDDIRTLLTLLDEVRQRYAIPTQSCVLTHVTSTLELIRQGAPVDLVFQSIAGSEKANAGFGVSLAVLDEAHQAARELKRGTVGGNVMYFETGQGSALSANAHWGVDQQTCEARAYAVARRYSPLLVNTVVGFIGPEYLYNGKQIIRAGLEDHFCGKLLGLPMGCDICYTNHAEADQDDMDALLTLLGAAGVHFIIGVPGADDIMLGYQSTSFHDALYLRNVLGLKRAPEFEDWLETMEITRGGKLLPQDKRQRLLALMESVA

SEQ ID NO: 5717 - protein, 265 aa, Chromobacterium substugae
MKDKNPITEDGWGELSRLTAARIALGRAGNSLPCRETLRFALAHAQARDAVHTPLDVSALAGELAADGHRVVEIHSAASSRAEYLQRPDLGRRLDNASREQLLAEQDKGCDLLILIADGLSSRAPAQHAVPLLRELLPRVRELGLNVGPLLIAREARVALGDEAGEIMQAKMTAMLIGERPGLSSPDSLGLYLTAAPRAGRSDAERNCVSNVRPDGLPYPLAAFKLAWLINAALRQPTGVALKDGSATDPRWAALLARQACLVKD

SEQ ID NO: 5718 - protein, 209 aa, Chromobacterium substugae
MTALQFELEAVLDTLADQGWIVIPHALSAELVANLRDACLQVWDEGRFHEAATGRAGGQARRAEIRSDSVLWLDQVAELPAVLAYNAAMDEIMLAVNRGLYLGLVELESHFAVYPEGAFYKKHLDRFRDDDARALTTVFYLNENWPADGGGQIRLYLDDACERFIDVEPEAGTLVLFLADRFWHEVLPAKQQRLSVTGWYRRQGGSLPW

SEQ ID NO: 5719 - protein, 407 aa, Chromobacterium substugae
MGVGPYSQTVAFSHYNNLSAQLPVDPMTGKLVAGGAKEQAEQCFRNIKAIIESIGHVMDDAVRITIFLKDISDMHSVSDVYSTFFQNYVPTLTVAAVAALPLDALVQVEALLSNGEGTIPNAPQAGDLVKIASNTNQAPTSALSTQSVAFSHYNNISAQLPIDPQSGKLVAGGAREQAAQCLQNIRAILESIAVPFDDIVKINIFLKNLSDIEQVNAAYRAFFPDSAIARAVAYVPARTVVEVAALPMDALVQIEAVVSHGDGTPPQAVEDRHGIVIKAHNTEKAPRCALATQTVAFSHYNHLSAQLPLNAETNEMVVGDVREQARQCLKNIKAIVESVGHAMSDVVKVNIFLTNIAEIDAVDEVYAAFFPGGVPARRTVGVSALPRGAMIQIDAVVANAEGTPPQA

SEQ ID NO: 5720 - protein, 306 aa, Chromobacterium substugae
MEKLQQDLFVPVGDGERLYLKRICGREGGAPVLMVHGVMANGRTFYTESGKGLAHFLADAGYDIYVADLRGRGRSTPKIGPDSRHGQTETICEDLPALHDFVRRKSGGQQVHWIAHSWGGVHMTSCLVRFPDIAAQVASAVYFGSKRSVRVRNLNKLIEVDFMWSTAVRWLIKACGYLPARRIRLGADDESDKSHLQSKLWAEPKPWVDSDDGFDYAAAARAGHLPPVLYFAAANDPCRGHPEDVRRFRDESGPHLSRLHLLGRRAGHLHDYNHVSLLTHPDAPRDHFPLALDWLAGRYDAVAENY

SEQ ID NO: 5721 - protein, 391 aa, Chromobacterium substugae
MLSSFLLSLSRAVIMPLLVLTLARQLGLSLQATGGLLGAVLLASALFGLYGGYWLDRLPRGPALRAAAVLMALGSVLLPYGRGYTLVVAALAAGELAMTLYGIAVKAILSDLVAAPQRARAFSLRYTLANVAWAVGPLLCSGMLMWRELAPFWLGGALALAGLLVQPRLPAAARDASELPDGFAATVRTLAGDRVLVWFTLSSLLAYVVYGRFSSYLPLYLLTRMGEAEAMRWMSALISCNAVVVVLLQYPLGRWLQPKRLVHAVVGGFLLIGAGMLWLGGVDSLPWMCAAIALFTLGEVVLVPAEYLYIDAIAPEALKGSYYGAQNLASLGGALGPALAGALLAHGPAWTLFASLALLCGLGAGLAVFSERLRLRRQDAGAAFPLPGSLS

SEQ ID NO: 5722 - protein, 552 aa, Chromobacterium substugae
MRLQQQYQRLYLAYGDAPAQPGLPQLAELWQCGERNARLQLARMRELGWLAWQPGRGRGKRSTLRLLRRPDELEWQRLQRLLARGQLEQAFSQLEPARQQQLLSALPAHLGASDSGRSLRIPIPHAPLTLDPQQVNSRLEAHLVRQIFDRLCRHDKQGRELRPALAHSWESGAAGRRWRFWLRPGLRFHDGSALDADTAAASLLRLKQADNPCQALYAHLLQVDVHDALSFSCQLAEPDQLWPQRLAAANASIVPLRRDADFARLPVGSGPFRVELHSPQRLKLAAYEQHYRERALLDAIELWIIPSPDEQDFHLRLEYGNQRGATMLQSACTYLLLRPGGASIPDGQRLPLMSFLAAPHPVAASEERAPALGLQPGWIHPRPAAAAPPRLSRGKLTLFHYDLPCFPPLAAALAERLSALEIKLDIRCLTRRDFFNSAAWLEQADLILCSELLHDDRDYGMFEWLSGCSTLQLGLSPAASSRLAGDMRGLQGEAAFAAREDGYRRAGDWLVAEGWLLPLSHETLGHDASPQLAGLQLGGNGWTDFAGLWLRG

SEQ ID NO: 5723 - protein, 141 aa, Chromobacterium substugae
MSMLPARHSLFDEFFRDFTPGFFIKPLHGDAPPAQIKMDVRETGEAYQVEAELPGVGKEDIHVEIDGALVTIRAEVKQFDQQGQDERALRSERYYGLVSRSFQLPQEIDREAAAARYENGVLNLTLPKRRNGGGGQRLRIE

SEQ ID NO: 5724 - protein, 872 aa, Chromobacterium substugae
MAQQPEVKYRKDYQAPAFLIDRVDLVFDIEDNATRVHSRLVITRNGQSQAADLALSGSAKLLSVTLDGDRLDDSRYALADDTLTVRGVPDSFILEVETELDPAANTSLMGLYASGGNLFTQCEPEGFRKITYYLDRPDVMAKFTTTIKADKQKYPVLLSNGNKVGEGMVDKKRHWVKWVDPYRKPAYLFALVAGKLVALKDKFTTMRGREVALEIWTEPADQDKTQHAMDSVRHSMKWDEERYGLEYDLDIYMIVAVGDFNMGAMENKGLNIFNTKYVLARQDTATDTDFEGIERVIGHEYFHNWTGNRVTCRDWFQLSLKEGLTVYRDQEFGADMNSRAVKRIEDVKGLRVSQFPEDAGPTAHPIRPDSYIEMNNFYTMTVYEKGAEVVRMYETLLGRDGFRKGMDLYFKRHDGQAVTCDDFRAAMADANDADLEQFALWYSQAGTPRLAVSSSYNPAERSYTLTVKQSCPATPGQERKLPFHIPLALGLVGADGKDLPLRLKGEAEAAGASRVLDVKAAEQSFTFVDIPAEPVPSLLRGFSAPVKLEYDWRDDQLVFLMANDSDSFCRWEAGQTFAERLFKQLIADAAAGRELKLSETFVAAFRAVLKDHAADPAFKALMLTLPSEAEILEMVDVADPAVIHQVRDFVLDQLAQALRGEWREAYELNLTRDYKPQDAGKRSLKNRALWMLNRLDDAWPAEMAAKQCLDADNMTDQMGALLALRDRDGEERDACFTAFAARWNDDALVMDKFFSLIGGSQLQGTLQHVEAALAHPAFSMKNPNKVRSLLGAFGGNMAVFHAADGSGYRFLADRILELDPINPQGASGLTRAFRRLKKLEPGRQALMLEQLRRMEKAELSKDVYEIVSKILA

SEQ ID NO: 5725 - protein, 37 aa, Chromobacterium substugae
MTNRGDLNFFPASQSAEKKSAAGNRSISKLNQVLDLY

SEQ ID NO: 5726 - protein, 474 aa, Chromobacterium substugae
METQSTYNYKVVRQFAIMTVVWGIVGMLVGVIIAAQLVWPELNFGPWFHFGRLRPLHTNAVIFAFGGCGLFATSYYVVQRTCNVRLISDKLAAFTFWAWQLVIVLAAITLPLGFTFGKEYAELEWPIKLLIAVTWVVYAIVFFGTIAIRKVKHIYVANWFYGAFILAVALLHIVNSAFVPVTLWKSYSVYSGAVDAMVQWWYGHNAVGFFLTAAFLGMMYYFVPKQAGRPVYSYRLSVVHFWALIFTYMWAGPHHLHYTALPDWTQSVGMVFSLVLLAPSWGGMINGIMTLSGAWHKLRTDPVLKFLVVSLSFYGMSTFEGPMMSIKTVNALSHYTDWTIGHVHSGALGWVGFITIGSMYYLIPRLFGRDSMHSVKLIEAHFWLATVGVVLYIAALWISGVTQGLMWRALNPDGTLTYAFVEAVKATYPYHFVRFLGGALYLSGMLLMAYNTFRTVSSGRAVDAKIPALTAEAH

SEQ ID NO: 5727 - protein, 204 aa, Chromobacterium substugae
MDKIQKLIEEHVGWLIVLTLLVVSVAGLVEILPLAFQKSVTEPVAGVKPYTALQLAGRDIYVREGCYNCHSQMIRPFRAETERYGHYSVAGESVYDHPFQWGSKRTGPDLARVGGRYSDEWHRVHLNNPRDVVPESNMPAFPWLAKNLVDAEVMPLKMEALRKVGVPYSDKDIAEAKAQVEGKSEMDALVAYLQGLGLALTNKR

SEQ ID NO: 5728 - protein, 51 aa, Chromobacterium substugae
MVCFAFFIVVLIIAYSKRSKGRYEEAANLPFLDDDKVQEAGQEQASNGARK

SEQ ID NO: 5729 - protein, 309 aa, Chromobacterium substugae
MNQYLSDFWSIWISVIVLGGLIWLTLLVFTQSKTTVKKGEEVEITGHVWDGDLAEYNNPLPRWWMLMFYITLLFAIVYLVLYPGLGNFKGLFGWTSVDQYTVERNKAEAKYRPLYDKYLKQDLKTVAADPQAQEMGKRLFQTYCVQCHGADARGAKGFPNLVNHDWLYGGEPATIKTTIMGGRHGQMPAWGATLGEEKVKDVANYVLSISAKARKYDAERASRGKETFAALCSVCHGVDGKGKQEMGAPNLTHPSGSWLYGGTEKAIIETITNGRNGQMPAWKDFLGEGKVHLLAAYVWSLSNNPKAPQ

SEQ ID NO: 5730 - protein, 477 aa, Chromobacterium substugae
MSDSLKKIPIKVENSGQDTATVSLYEAQKKIYPRAVKGVFNNLRILFVVGTQLLYLGLPWLQWNGRQAVFFDMVGRKFYLFGLTIWPQDFVYLAALLMCCAFGLFTWTTIAGRLWCGYSCPQTVYTEIMLWIEQWVEGDRGKRMKLDAAPMSLAKFRLKFTKHFIMLAFSLWTGFTLVGYFTPIRSLVAAIPSFGYGPWETFWMFFYGGFTYLFAVFMREQVCKYMCPYARFQSVMFDADTLIISYDEARGEPRGSRKKGADPKEQGLGDCINCSICVQVCPVGIDIRNGLQYECIGCAACIDACDDVMDKMSYPRGLIRYTTENALEGKYPEKAIPSRLKRPRVVLYSLVLLIIFTAAITSLALRKPFKVDIIRDRASLVRETDEGWLENTYIVKIINTTEQSQRFRITAEGLPGIRAKAEKPEIRVDATQTEAVTVHVEADPQYATKGSHPIRFAIQSINNPSLRVEEKSSFIGE

SEQ ID NO: 5731 - protein, 176 aa, Chromobacterium substugae
MQHTAHPPRPWYREPWPWILFGIPLVSIIVGIGFLAAAIKSDDGLVTDDYYKKGKAINMELRRDKAAARMGLTAQLMLGSDGRSLRLVTSSKAPLPDTIALSMIHPAQDDYDLSAEMTLAGPNLYQGILPKTPVIANHWYIQLEDHAKTWRIQGEWKPGEGPMVQLGQPKLEPAAN

SEQ ID NO: 5732 - protein, 401 aa, Chromobacterium substugae
MSAVSSLSLWRQPVFAGLFASTALLALGGQIYQLALPLILYELTHSLAAMSNLRAVEFLPNLLLAAVIGVWVDRVCRRRWAQRALLAMAALLGVCALALAGGWMAAWLFYPLTFCVMLCNYVTAICRMALVKESVPPAQLVQANGYLGSLFDVFAVSGPVLSGLLIAWARPHWSLGVPALMFLLSALLMARVPAPGRGQAGERRFGAELAAGWRALRGNPALWQLSWVVVLANGAAGVAEVLFLFRARDQLGFSPGQLGLLFGCAGAGGIAAGLCVARVRKALGLGRMICLALLLEAAGMAAQAWLGDLRWLAAAMALQSFAVVCGNVGVWSYRQEATPTALIGRVSGLTGSLFKLLMPLALVLGGALSADMPLRDLMLATAVWQAGAALLCGLSRVRTLV

SEQ ID NO: 5733 - protein, 558 aa, Chromobacterium substugae
MRLLQHYQRLSLAYPAHDGPARLADIAAALHCSPRHARELLQSMADNGWLRWQPGQGRGHASRLRLLAPASQLEREAARGFLANGDIEKAMRLLPAAARRQITELLPAYLGVAPSEPQTLRLPFYRPLHSLDPVQINRRTECHLIRQIFDGLTRYDRARGQIVPALSHHWRHDGEWRNWRFHLRPGVVFHNGRALDGEDVRQTLLRLRDEAGPHQRLFAHLADVNLPAPLTVHIRLTRPDALLPRRLADSAASILPRECWPQADFGRFPIGTGAFRLEANNDYRATLRAFDRHWKERPLLDAVDIWVVDDPEVKARLDARFCHPGEPGGQPSLRRLEAGCSYLAANPARLDSVQRRALADWLHPAVWQAPLPGEAALGMLPQWRHRPAPIQPPAPRLPATLRLATYQLPDHIELAEAVARRLRDAGCRIELTVMPYPDFARCDWLDGADLLLSGEAMADDVDFGVYQWLCQDAGYHCWLEAAARHRMRAAEQQLAMEPDAERRWQGYEALARALVAEASLIPLRHHEQAMAFAPQLQDVTLAQCGWMDFDQAWLAAPD

SEQ ID NO: 5734 - protein, 114 aa, Chromobacterium substugae
MAGASEPLAGYARAIMGGAGAERIVGREDKQDSWREADCEVTLRERVYRFDNGVAIRRSIEVDDYPSELVCAESWITYEVLELGGSPGIEPMRKSFDNGCREAFWLRYHADLSI

SEQ ID NO: 5735 - protein, 158 aa, Chromobacterium substugae
MFERLRQLLTAGGARYRVIEHPAEGNSRKVADVRGTEAGQGAKAMLCKVADQTGQFVLAVLPGDERVDFAKVAAAIGARKVKLADAAEAEAATGCVIGSIPPFSFSPVIRLVVDPQLLARYSEIAFNAGRLDASIVLNGDDYRRLAQPLLADIRKESA

SEQ ID NO: 5736 - protein, 191 aa, Chromobacterium substugae
MLKLNLGCGHDRRPGFLNVDSQAACHPDLVADLEQFPWPWDDNSVDEILMSHVLEHLGASSATYLGIIKELYRVCAPGALVTIIVPHPRSDNYLADPTHVRPITAAGLHMFNQELNRQWMAEGSSNTPLGVYLGVDWVMESSDVKILEPWATRFNSGQVNEGDISMAVQNFFNVIGECTFHMRIRKPATAI

SEQ ID NO: 5737 - protein, 206 aa, Chromobacterium substugae
MSKELVFYTNPQSRANIVHWMLEEVGAPYRPVLLEYGAAMKAPEYLAVNPMGKVPAIRHGEQIVTEGAAICAYLADAFPEAGLAPAPAARGDYYRWLFFVASCVEHAWTNQAAGFIPSAEQQRMFGYGSYEATMDTLAKAVAGRRYLAGDRFSAADVYVGRTIGYGIEFGNMRDRPELVAYWNGLKDRPALLRASEQAERWQAQQP

SEQ ID NO: 5738 - protein, 462 aa, Chromobacterium substugae
MARRIPEPYRIKMVEPIHQTTPQYRRQALDAAGWNPFLLRSEDVYIDLLTDSGTGAMSDRQWAGLMTGDEAYAGSRSFFRLADTVRELFGYAHTIPTHQGRGAEQILFPELVKRCRGARPLFLSNYHFDTTKAHVELAGARAVNVLTPQALDTAAPYDWKGNFDVPRLAAIIADEGAANVAGIIVTITCNSAGGQPVAMDNIRAVGKLAREHGIPLVIDAARFAENAWFIRERDPAYAGSSIAAIVREMFSHGDMFTMSAKKDALVNMGGLCCFKDDEALFRAVQVNCVPMEGFVTYGGLAGRDMEALAIGLREGMDDAFLGYRIGQVAYLGERLREGGVPIQTPTGGHAVFVDAARLLPHIPAERFPAHALACELYLEGGVRAVEIGSLLLGRNPASGLQEPSPFELMRLTVPRRVYTNDHMDYIADCLVEVKRRAAEVRGLAFDYEPPILRHFMARLRPA

SEQ ID NO: 5739 - protein, 40 aa, Chromobacterium substugae
MTNQLYTVNDSHHEEKAWQPIKSPNKNHQKNKANALIITM

SEQ ID NO: 5740 - protein, 458 aa, Chromobacterium substugae
MSTQSHPKGLYLLFVTEMWERFSYYGMRAIFTLYMIKALLFDKAHASDIYGTYTGLVYLTPLVGGYIADRYWGNRRSILLGGVLMAIGQFMLFFSGSLHETNVGAASWLLYGGLGFLIAGNGLFKPNISSMVGQLYAPGDKRVDSAFTIFYMGINAGSLFAPLVCGTLGDTGNPADFKWGFMAAGCGMLLSLVIFSLFKNQYLVTPEGKPIGLAPKRHHDSGEKVVHAPLTSIEKQRLAVILIVSAFVIFFWSAFEQAGASLTFFAEEQTNRNLLGYTVPASFFQSINPISVVLFAPLFAWIWTKLGNKGMEPSSPAKMALGLFFLAIGYLVIAFGVDGLQPGVKVSMLWLVSLYMLHTFGELSLSPIGLSLVVKLSPARFTSLMMGIWFLSNAAANKFAGTLSELYPDPAKPVPHFLGYAVNNLHDFFMLFVFMAGASSLILFALSSVLKKMMHGRQ

SEQ ID NO: 5741 - protein, 489 aa, Chromobacterium substugae
MKNAASSNWRKHAVYALIALLLIRLAALWAIPLTDTTEARYAEIARKMLETGNWVTPLHDYGVPFWAKPPLSTWLSAASMGLFGVNEFAARLPALLLALGALWLTAGLMRRRGGDEAATAAALLLGGGLLFYGAAGTVMTDPSLLFCVTLSQVAFWHALHGGGKAWRYAFFVGLGLGLLAKGPLDVVLVGMPIFFWVLIRNEWKRLWTELPWISGTLLAAAIALPWYVWAEIRTPGFLNYFIMGEHVSRFLDSGWKGDKYGFAHATPRGMIWPYAFGALFPWSIAMLAWLASQARRLPAIVRAGENDGWLLYLSLWTVMTLLFFTLSGNIIFPYSLPMLPGAALLMAELWRRGRGERAGRALPWLALSSGILVLAGIGLQRYDGAKYFRTQKPVIAAWQQQSPAAAAILIYWDSRREFSAEFYSQGKVRTTAKPEALAALLAAHPGSFIVTEQRDYASLPAAVSAAYAKAAEFPVMKDRMLLLRPAASR

SEQ ID NO: 5742 - protein, 337 aa, Chromobacterium substugae
MTDTRKPGFVPPYLLELHAAERPRDPLVSCIIPAYNESENIVPMLETLHRLLTQHGLRHELVVVDDGSRDDTVPKVLEAGQRLPVTLIQLSRNFGKEIALTAGIDNIAGDVAVLIDGDFQHPPEMVPVFLEKWRQGYDMVYSVRANRDNETLAKRAFTRVFYALLNSGAPLKIPENTQDFRVLDRSILDALRQMPERNRFMKGLYNWVGFTQLAMETETQERRAGKSSFNFRSLFGLGLTGLTAFSNMPLRIWTLVGCVISMLSIGYAIWEFIHTLLYGNRVSGWPTLAVAVTFLGGVQLLSIGILGEYVGRIFNEVKGRPTYLISRISKPQAGRGA

SEQ ID NO: 5743 - protein, 129 aa, Chromobacterium substugae
MSRQLFWFGVVGVSAMLLHFMLVALVMVPLGLPPLAANVLAFLAAFQLSYWGHRHFTFEARHVPHRQALPRFFGVSCLSFCVNEAMYFLLLRFTALDYRLSLCIVLFSVAVLTFVLGKLWAFAASPQTN

SEQ ID NO: 5744 - protein, 270 aa, Chromobacterium substugae
MTKRLTLCADDFAQSGSISAGILQLLDAGRLSATSVMSQSPHWPSLAADLKARSQRADIGLHFNLTHSFDAPAKPLSHWLMKSQLRQLSLPALRDEALVQIDRFAEHFGRLPDFVDGHQHVHALPVIRDALFDAIQRRWQQLPLPYLRAPDKLGHPGDNRLKSLILRSVCINFDEQAQEAGFATTPWFGGMYSLTPQADFSGLMQAWLARSPEQALIMCHPGLPASDADDPIAASRSREFDYLSGDAFAEHCRQHKVEIVRFQPAAVAAA

SEQ ID NO: 5745 - protein, 224 aa, Chromobacterium substugae
MYTLIHQDPRFYLVDKRAGASFHREGEEDGLMDALRAGLGDDALWPVHRLDRITSGLILVARSAETARQLGEALAGREVEKYYLALSDRKPLKKQGKVSGDMAKGRGGAWRLLASQDNPAVTQFFSYSVQPGIRLFLLRPRTGKTHQLRVALKSQGAPILGDALYGGGAADRGYLHAYALRFALDGEAFSFVCPPSQGERFADLACRALLAELAEPWTLSWPGA

SEQ ID NO: 5746 - protein, 159 aa, Chromobacterium substugae
MNEQAQGQRELVMSVLMTPDMANFSGNVHGGVLLKLLDQVAYACASRYAGRYVVTLSVDQVLFKQAIHVGELVTFLASVNHVGRTSMEVGIKVVAENIQQRSQRHTNSCYFTMVAFEDGKAVAVPPLALDTPDQQRRFRGAEMRKQLRIEMQQRKDAIA

SEQ ID NO: 5747 - protein, 235 aa, Chromobacterium substugae
MSISSVAGGSSSYGISMHGANCQCPACQALRSQAAAVASAPSSPAQTANAAAPAAGGQAGADASGQNGSGNAKNAQQANPAAPKAPDGKPLNDAQQKEVEDLKARDTDVRRHEAAHQAAGGALAGAASFTYQQGPDGKQYAIGGEVPIRLSQGNTPQETIQNAQTVRAAALAPSDPSGQDRAVAAEASQMEQQARTQLLQQQNGNQHLSPLQKAQQAATPGGSPQAKGGNIDTYA

SEQ ID NO: 5748 - protein, 690 aa, Chromobacterium substugae
MDCPTEAKLIEKALAGMDGVVALEFNFIERVLLLRHDLPQLDEVKRAIAKVGMQAMELEADAKMLAPQGHGRRANLLLLVSGLSAAAAEAAAWSLGDGKPVVAALALASILLGGIPTLKKGWIALSTRTLNIHFLMSVAVIGAMLIGQWPEAAMVLFLFAIAERLEAMSLAKAGEAVRALMALAPETAWVAAAGGWRETAAAEVAVGSRVRVRPGERVPLDGRIADGHSSFNEASITGESLPVDKGPRDAVFAGSINGAGVVEIETTASASGSVLARIIATVRDAQASKAPTQRFIDRFAAVYTPVVLVLAALFAVAAPLSGLQPWHQAIYSALVMLVIACPCALVIATPVTVVSALASAARHGLLVKGGAPLEMAARIDTVCLDKTGTLTQGEPRVTRVTALAGQDEDTVLAWAAALDGHSTHPLARAVLDAAAARGVSAPAASQVSELIGRGVSGWVAERHLQLGSRRLADEQGAMTPLLEQTLQALDAAGEGALVLLDGGQALGVLAVADQARPEAAATLARLKRMGVETVMLSGDSPQVAQAVARQTGIGAAYGGLLPQDKLRHIERLQQGGKVAMVGDGVNDAPALARADLGIAMGAAGSDSALETAGVALMDDKLSRLADLIAHARRTARVLKANIAVALGIKLLFFGLALAGVASLWMAVFADVGTSLIVIANGLRLARRVQA

SEQ ID NO: 5749 - protein, 86 aa, Chromobacterium substugae
MAMRAARGVFVVVVVGMIMRIAVIVGTRRAGLRRLLAMILAASATSVAMRLGFQSQRGFGLGRAAIAAVGMLAVLVRCSLAVTRRA

SEQ ID NO: 5750 - protein, 168 aa, Chromobacterium substugae
MLIGELARQTGCEVETIRYYEREGLLSAPLRSASGYRRYTAEQLGELNFILHCRSLGMSLADIRNLAAFKADHQHDCEDINQLIDQQIVKVHQQVEALRLLEQQLLALRDKCHESHPAADCGILQTLVEAAEGSPCVCHTPFGQDNHGHSHDYDHAGKKNGRPHKGRP

SEQ ID NO: 5751 - protein, 227 aa, Chromobacterium substugae
MEHEIALVSFVLTVVLYGLVKKYYLKTRSWWSTPILAVPLLVIGLVVLARVPYPTYFADTRWLTWLLGPATVAFAIPIYEQRALIRKHWLSLSCGVLVAIPVAVFSSVWLARWLDLSEMMQKSLAPRSISTPFALAAAHTLGGSADLTALFVVVTGVFGMMAGQLMLAVLPVRSALARGALFGAAAHAAGTAKAAELGAEEGVVASLTMMLAGVATVFAAPLIGYWI

SEQ ID NO: 5752 - protein, 147 aa, Chromobacterium substugae
MASRLFHRLAPLLQTFSQVLLLSLVWLAASQLSQRFLPAMPAGVLGMLLVLAGLWSGLLPLKWFKHGARWLLAEMLLFFIPAVVAVVQYPQLVLSSGLRIVLVIGLSTMLVMAVTSLVVDRCYRLELMLRRRGSNRKAQLKAEVHGA

SEQ ID NO: 5753 - protein, 298 aa, Chromobacterium substugae
MEMDIRALRYFVELVKCHSFTKAADALFVTQPTISKMVKQLEEELGMPLILREGRSFRLTDAGRVTYERGLDVLSAMNQLKHELADLASLSSGELVVGLPPMVGVAFFAPVVSHFRRRYPQIELKMVEDGALGIESRIKSGDLEIGVAVLPVDSQLFDHYSVVRDPLCLVAPAGSRWHGRSLVQLTDIADQPLVLYPDDFTLSRRIGDAFRELGKPLNIVGRSAHWDFIVELVAANLGITLLPRCIVSRLNPEQYDVIPLYDPKLYWHLALIWQRGGYLSHAARAWLALTRDVLGGQE

SEQ ID NO: 5754 - protein, 249 aa, Chromobacterium substugae
MSNKRLIHGFHAINARLWQNPKSLLEIWLAGGRHDARAKAVLDKAGEEKIKLHIVDKERLDSMSGNARHQGVVAMIDASMNYVDLDDVLENLSEPPLLLILDGVTDPHNLGACLRVADAMGAHAVIAPKDRSATLNATVSKVACGAAEVVPYITVTNLARTLRELKDHGVWIAGTTMEADTDLYHFEAAGPLAWVMGAEGEGMRRLTREHCDVLVSIPMFGTVESLNVSVSSGMVLAESRRQRVVKAQG

SEQ ID NO: 5755 - protein, 1083 aa, Chromobacterium substugae
MEELLVFLGFAACLALWPRSPQAVLSLASFAPHGLFCWQLLARGARRSWWWPLAAALIASEAASPLWALALAGSLFLILPGLRLGGLLRARARPATPGELRHLLLTLIAYPALLVALLLGAGAWLAGGQRLPPWSWTWQCWAAASSALFLCAPLAWPPRQRLVLPLRIELALILALVAGGAMLLLSSQAALNIPSQLLFFPLILWAACRTGLGGAALTAGMVTLALSLAALSPDWPLHPGIGNASTDLLLALALNVSGLLVAILMDGHRADEETLRTFRARIESLVNNSPTMMSLKDMEGRYLLVNAAYARRVGVSAQSLLGRRPEDVFDRADAAQIREQDQQVLNLLAPRQFEEHFSLNGLETYLLASKFPLFDAAGRPAGVGSVDTDITLSKREQKAKREAEERYLALVEQSLVGIYILQDERLVYVNPKLADILGYEQEQMTGMTMGQVLAPGEANRLRQQVLRRFRDNIAVMHYSTRALRRDGVLVDMEVHSRLFELEGRKAIIGVVMDISERLLADTNLRLAAKVFENSAEGILILDAAARIIAVNDAFTRITGYAEEETLGRASRIFSLGQREREAMQEALATLGHWQGEMQDRRKNGEWYPAELSISALRDEDGQLSNYVAVFSDITQRKEAEERLQFLANHDPLTRLPNRSSLTARLDEALAQMASQGGQLAVMFIDLDRFKLINDSFGHQAGDQLLCEIALRLSRVVGERGLLARLGGDEFTLLMSGFDKHKQLAEMAGDILAELGRPLSLEAHEVFITGSIGISVFPHDGQDARTLLKNADVAMYRAKDSGKNTYQFFDIGMNTQTFERLLLENGLRMALERGEFELHFQPQLGAGSRRLEGAEALIRWRHPQLGLVPPVRFIALAEETGLIKPIGDWVLHEACRQLAAWDREGVRVPRLAVNLSPRQFGQPSLPAKVAGALQAAGLAAERLELEITESMIMQSPTEAVSLLSELKALGVWLSIDDFGTGYSSLSHLKRFPLDTLKIDQSFVDGLPADEDNAAIAEAILAMAKKLKFHVVAEGVENEEQAAFLQNKGCHTLQGYHFSRPLPAQEFAALAAGWQLRDQAAGIPA

SEQ ID NO: 5756 - protein, 62 aa, Chromobacterium substugae
MPDLADRRSTAAAARAAAMDTFLFLIPQWHYALYFFMPKYSGLEPNAYDSRDSRRPPASDRR

SEQ ID NO: 5757 - protein, 1131 aa, Chromobacterium substugae
MDTLPIIPPRGQKTRCVRLPDGLDSQTVAALARQRQPLLILTADAQSAQRLQAELPFFAPELSIALFPDWETLPYDHFSPHGELVSERLATLWQIRQRECQVVIAPVSTALGRLAPVSYLLGRTFFLKAGQQLDVEKLRGDMVTAGYQHVTQVMAPGEFSVRGSLIDLYPMGSPLPYRIDLFDAEIDSLKTFDPDTQRTLYPVPEIRLLPAREYPADESGVTAFRQRYREKMEGDPSKSRVYKDVSQGLWPAGIEYFLPLFFDETATLFDYLGEDALLVLHHDVQDAAETFWRDAQGRYDMARGDLERPILPPADIFLRPDELMARLKPYARIELSADEAAPGLALPELAVDRRADAPLHRLQSYIAQGGRRILLAAESLGRRETMLAFLADNGIKPTPVDNWADFAGGKAALALAVAPLYSGFALPEQGIAVVTESELYQHVARSHTRRKANRAGSDAMLRDLAEVKAGDPVVHEAHGIGRYVGLVTMDLGEGETELMQLEYADGATLYVPVSQLQLISRYAGGATDDIQLHRLGNPAWEKAKKRAAEKARDTAAELLNLYAQRAAREGHSFQLSHADYAAFAAGFGFEETPDQAGAIEAVIQDMCSGKPMDRLVCGDVGFGKTEVALRAAFVAVMGGKQVAVLVPTTLLAEQHFQNFSDRFADWPVRIAELSRFRSGKETKAALAGLADGSVDIVIGTHKLVQPDIEFKNLGLVIIDEEHRFGVRQKEQLKRLRANVDVLTLTATPIPRTLSMALEGLRDFSAITTAPSRRLAVKTFVSPLSNGVIREAVLRELKRGGQVFFLHNEVDTIENMREKLAELIPEARIGVAHGQLRERELEQVMRDFLQQRFNLLLCSTIIETGIDIPNANTILINRADKFGLAQLHQLRGRVGRSHHQAYAYLLTPDGMTRDAQKRLEAIQLSGELGAGFYLAMHDLEIRGAGEVLGEGQSGEMQEVGFSLFTEMLKQAVRDLKKGRAPDLDAPLGVTTEINLHSPALLPDAYCPDVHERLLIYKRLASCETEAEIDGIHEELIDRFGLPPQSVKTLIESHRLRLVAKELGVQKLDASEVAVQIAFIKNPPIDPVKIIMLIQSKKNYRLAGQDKLRVEQPLPEVAQRIVKVKEVLKELSA

SEQ ID NO: 5758 - protein, 256 aa, Chromobacterium substugae
MSAIPKFAFAALLACGAAGYGFAEPDADALALVTGEFPPYTGAALPQGGISAVLVREAFLAAGQPAPSIVFLPWKRAYSETEQGRFAASFPYARDENREKAFLYSEPLHQDRFSYFARQDDEDARKGRWQGKRLCLPLGWTTAYVDADVRKYQLRLERPPTLENCLKMLNSDTVDLVSCNDFVADYAMRRLFGPHVPFAIADIGKAQSSELYLIVSRRRPDAERLIRQFNQGLAALRDSGRYQLLLRQYREQPPSR

SEQ ID NO: 5759 - protein, 263 aa, Chromobacterium substugae
MKTLSARLASLPVLTCALLLTAQAGAAELRVAFSSSRPPFSFHDDKLGDTGIEVELMRAALERMGYAMKIMIVPNSRLRRAVAAGSADIASAVHERGPDGKGVYYSDDFIEYRNVAIGKQGRQLDIRSLLDLGGHSFAIWQNGWRDLGPVFQAIYQPDPSGRFRHNYHESASQENQCRMFWANRVELLIIDRAVFDWFRGKLAASLPTAEAVRYYDIFPQTTGYPAVFHDRALRDRFNLALRQLRQNGDYQRIERRYRSGERD

SEQ ID NO: 5760 - protein, 172 aa, Chromobacterium substugae
MPLRNIRMLVRYSAWANQRLLGALAALPETELLKPRATVFGNILSTLNHNLVVDRIWQAHLQGRAHGYASRNTERTPSLAELAVDQAELDRWYIDYADALDPAAHDQVVDFAFVDGGRGSMRRGDMLLHIVNHKNYHRGFVADMLYQIPALPPATDLPVYLRDAHDEAELLG

SEQ ID NO: 5761 - protein, 425 aa, Chromobacterium substugae
MADNPAAPWRAEPAGAAAALHPTSMSNQTIQNIQSILDFKATLLSTTGYTVMLTGVAVLFWLYNRKERALLTLGMGGAFAVCGTLLAYLPPILPPWPMLMLDTLLLLLFHPLALIATQQMLGRSGSWGYAALSVALVMAAFAYWGGVENYGRRVMVTSGSHLLYWGLIFRLLLQERKQGTPAGHRLAMGLAAVMLTISASRWSVACYAGDPDFGRHWSMFNLFSSLGLFWCTFCFSLNMLLISYERLLLQVRLQAQQDGLTRLYNHRAFHEKAEGLFLRALEKRAELALLLIDLDHFKSINDRHGHQAGDEVLRQLADCLRGEARHGDLLGRHGGEEFVVLLPQTGRIDAYNTADRLRGAIANLAPQVNGQPLRISASIGVACLRPSEHSNLASLFLEADVLLYQAKHKGRNRVEIERERVVEPL

SEQ ID NO: 5762 - protein, 124 aa, Chromobacterium substugae
MRFRHFLLPMAFCSAPLAAKTLPSYDFALQAKPAAAPRINMAAPAKPLQVQPALQLRDLDAPLQLTPRQQQEMLQRMENRQPQALPGQPPRAPWERPQPLPRFDPQTGKPRAIPMHELPKLPGR

SEQ ID NO: 5763 - protein, 341 aa, Chromobacterium substugae
MLMSLSTSGAMAMQKRTLGRNGPQVSALGLGCMGMSAFYGPHDDAESLATLDAALDLGVNFLDTADMYGPHTNERLLAKLLARRRGEVVLATKFGIVLDPADPMKRGVNGRPEYVRASCEGSLQRLGVDHIDLYYQHRIDPAVPIEETVGAMADLVRAGKVRYLGLSEASPATLRRAAAVHPIHALQSEYSLWTRDPEDGALAACREVGASLVAYSPLGRGFLTGAIQSPDDFAPDDFRRHNPRFQGENFQRNLDLVAKVKALAADKGCSPAQLALAWLLAQGEDIVAIPGARKQANLRDNLGALSVSLDGGERDALAAVFADGGASGARYAPDVMQLIDR

SEQ ID NO: 5764 - protein, 300 aa, Chromobacterium substugae
MSRPQHDALQAFALIARLRSFTQAAAELGVTASALSQTMRQLEAELGVPLLIRTTRQVAPTEAGDALLERLAPALEQIRQALEDARQLQGQPAGTLRLTLPHSAAQIALYPHLVGFQRRHPAVALELDISDGLVDIVGQRFDAGIRFSDRLQPGMQAAQISRPLRFVAVATPEYLARHGAPQRPDDLLRHACIGYRFGASGPQYRWQFVEDGQPRQLALRGPLLTNDNQARLLGARGGIGIAYLAETLVRDDITAGRLLPVLESYLPPAEALYLFYPQQRRLPARLRVLIDFLREANGVV

SEQ ID NO: 5765 - protein, 463 aa, Chromobacterium substugae
MPGEQQTLHRGLEERHINLMALGATIGVGLFLGSATAIKMAGPAIMLAYGIGGLAIFMIMRALGEMAIHNPVAGSFSRYAQDYLGPLAGYLTGWNYWFLWLVTCMAEITAVGVYMGIWFPDVPSWYWVLAAMLAMGGVNLIAVKAYGEFEFWFALIKIVTIVLMIAGGFAMIIFGFGNHGVATGIANLWAHGGFMPHGFSGVLMSLQMVMFAYLGVEMLGLTAGEAKNPKKALARAVDSVFWRILIFYIGALFVILSIYPWNELGTRGSPFVMTFESLGIPAAAGIINFVVLTAALSSCNSGIYSTGRMLFNLAEQKQALPLFAKVSKSGVPLPALLLSIAALLLGVLLNYLAPKEVFTWLTAISTFGAVWTWLIILLAQLRFRRSLSAEQLAGISHRMPLWPYGSYLTLGFLALVIALMAYFPDTRVALIVGPGWLVFLVAVYYLLGYHKQDAAWRLAQQGR

SEQ ID NO: 5766 - protein, 887 aa, Chromobacterium substugae
MAVSNQIELDALVARVKKAQQAFAQFTQEQVDHIFRSAALVAADARIPLARMAVAETGMGVMEDKVIKNHFASEYIYNKYKDEKTCGVLSEDDTFGTITIAEPIGVLCGIVPTTNPTSTAIFKALISLKTRNGIIFSPHPRARRSTCEAARLVLEAAVAAGAPQDIIGWIDEPSVALSNQLMHHPDVNLILATGGPGMVKAAYSSGKPAIGVGAGNTPAVIDETADIKRAVASILMSKTFDNGVVCASEQSVIIVDEIYDAVRERFSRHGGYILSKSEAEAVRKVILQDGSLNAAIVGQSAAKIAAMAGIEVPPTTKVLIGEVTEVSENEAFAHEKLSPTLAMYRAKDFLDACDKAAALVTMGGIGHTSALYTDQDLQEERVRYFGDKMKTARILINTPSSQGGIGDLYNFSLAPSLTLGCGSWGGNSISENVGPKHLINKKTVAKRAENMLWHKLPKSIYFRRGSLPVALEDLAGKKRCLIVTGQYLFENGFVDEPIRLLKKMGLEVETFFEVPADPTLAVVRKGTDLAHAFKPDVIMAIGGGSPMDAAKIMWVMYEHPEVHFADLALRFMDIRKRIYQFPKLGQKAMMVAVPTTSGTGSEVTPFAVVTDEVTGVKYPIADYELTPNMAIVDANLVMDMPKSLTAFGGIDAVTHALEAYVSVMANEYSDPQALQALKLLKEYLPSSYQNGAKDPKAREQVHNAATIAGIAFANAFLGVCHSMAHKIGAEFGLAHGLANALLISNVIRYNAADVPTKQTAFSQYDRPKSVARYAEIARHLGLEASRDHERVEKLIEWVDELKKTLGIPASIQAAGVAESDFLAKVDELAEAAFDDQCTGANPRYPLISELKQLLLDSFYGRPYKEAWEREEDAAEAKPAKGKSKAKA

SEQ ID NO: 5767 - protein, 39 aa, Chromobacterium substugae
MKLPGIYLFVFSCLFSKTKKLAEKPAADAQTARTPFKLV

SEQ ID NO: 5768 - protein, 352 aa, Chromobacterium substugae
MALPLLLALQSAWADDAPGAPEPQVQQVIKLPLRPGKPAQAPDGAAAAPPQSASPSGANSPKPGKPAEAGKKMDAGKGGAKADVQAAPEKMAPSVPMGKPPARDLSQPSPEVTAPGGRPHAARKARAKARHPARAAATVAAGEAGQVKSVVGSILKANGAYIAKHSPGYLAKLGGRQTPRATVVTCSNPGGQVGMLGGDADGELFVISNLGNQLATSEGSVEYGVRHLHTPLLMFISHTGCGAIKTAAGDYSNMEPAIQRELDNIEIPKGIDATNGALININNQVEGSILKFSGEVEAGRLAVLGGYYDYNNDLKQGRGRLVITNINGETDPARIRELTRSGQYFKYGFMGR

SEQ ID NO: 5769 - protein, 287 aa, Chromobacterium substugae
MPYLALTLAMFLWSSAFIVLKYVFQFYHPLAVLFARMLIASLCLLPLAMSGRIRWRYRRGDWRWLLAMGLAEPCLYFLFEANALTYTSASQAGVITATLPMLMAVGASLFLGERQPRQVWLGIALSFAGVIWLSMDSRSGPGAPDPLLGNALEFCAMVCACGYVLIAKRLSTRYSPLAITGIQALAGSAWFGLAMLTPWGQWPQRLLLAPSLWVLYLGAVITLGAYGLYTWAVSRIPVARAGAFNNLIPVFTVLLAWWLLGERFEAWQGLAGVLVFAGVWLSQRKQA

SEQ ID NO: 5770 - protein, 130 aa, Chromobacterium substugae
MVLGFLQEVRSGVNPDAVSRYMATSVAAHQLESENPRTLARSPANYAEHVREFKRLFGDFQLRIDELLVDGDRAYARWTQLGRHLGELDGHAASGRPLALVDSACYRVADGKIVEYWIQADRMGLARQLE

SEQ ID NO: 5771 - protein, 45 aa, Chromobacterium substugae
MSTLLIMLRQWRDWWWQGMAIHARHVCRDEMEALQRIRNLMEGRR

SEQ ID NO: 5772 - protein, 39 aa, Chromobacterium substugae
MISNVLIFASTVQSFIMRHIVYTLVLLKKPIRHDTLFMK

SEQ ID NO: 5773 - protein, 321 aa, Chromobacterium substugae
MRTNHLPDAQAMLAFDALVRRGSFTAAAEELDCTKSRVSQLVKALEKDLGSVLVLRNTRRVALTEAGQRLAAHARELRGLLERARLDVNETEGEVSGPLVISSITSFAQYLLAPILAELAVLHPGLQLKLQVENRLQDPIAEGLDFCIRTRNVHDDALVAKPLGFVREWAFASPDYLAKAPPLEAPDDLIHHRILLDTSRPKLRDAPEWLLEKDGAQKLIRVQPVLSSHQYAPLLSGAIAGSGIALLPPYVAAEHLKSGRLAPVLPGWSHDCWPVFLVYPYRHPLPRKYEAFIQHVVPRMRALLENSLDPGQGGAAAPSSE

SEQ ID NO: 5774 - protein, 396 aa, Chromobacterium substugae
MEHRDIVIVGGGMVGSALAAALAGNGLSICVLEREAPAPFDPEQDPDLRVSAISPASARFLAGIGAWDKVLAMRAAPYRRMQVWEGEENRAALFDAAEADVEQLGHIVENRVAQLAATAALRDKGDVDYRCPAAVSGIVYRPQATQLTLSDGSQLQARLVVAADGARSLVREAAGIGVTGWDYPMHALVLACRTDGGQQDITWQRFTPDGPQAFLPLCGDAASLVWYHRPEEVKRLLALPEAELIAAVAQAFPRKLPGIVRIAARGSFPLTRRHAQRYVRDGVALAGDAAHTIHPLAGQGVNLGFQDAAALADVILSARGQGEDWAGAATLARYTRARKPANLAMQAGMDAFCYGFSNDIAPLRLLRGLGLRLADKAGPLKRGAIRYALGLGPLRR

SEQ ID NO: 5775 - protein, 380 aa, Chromobacterium substugae
MKLPILPALLALVLAGGVRADETLARDLGEEVLQLPVRLPGGIHAMTITVYHPSGPGPHPLAVLSHGRATTPAERARPSRVRMLDAARYFVRKGFVVIVPTRQGYGASAGGADPEDSGPCRDKDYADSLRPAVSEILAALDYGRRLDEVDSQRMLLLGQSVGGISTVAAAAENPPGVMAAINFAGGAGGDPASHPGIPCAEPQLRRLFAEFGAQSRTPMLWVYTRNDHFFGPEYTQEWARAYREAGARLDYRLLPAFGDNGHLLFADGPDIWMPLLEAYLGSLGFRQPDIPPRPAPSGFAALNDSERIPYLKPEDRRDAYARFLSSPFPRAFAISPDGHWGYAHGGDAAGRALGFCQNHSPSPCSLYAVDQDVVWPGGQP

SEQ ID NO: 5776 - protein, 333 aa, Chromobacterium substugae
MKLAILGAGAWGTALAIAFARHHQVTLWARDAGQAAQMGEERVNRRYLPDCPFPEGLALTADLAAALQDAELALIVTPMAGLRPTLKALKALKSLPPVLWACKGFEAGSSLLPHQVVAEELPADHRCGVLSGPSFAREVAQGLPAAVTIASDDAEFAARVARELHSPLLRLYANDDLVGVEVGGAVKNVMAIATGVADGLDFGLNARAALITRGLAEISRLGVALGASPQTMMGLSGMGDLILTCTGALSRNRQVGLKLAEGKPLEQALRELGHVAEGVATAREVLTMAERLEVDMPITAAVCGLLYQGNDPQQVVAGLLGRSPKSESGAMLD

SEQ ID NO: 5777 - protein, 146 aa, Chromobacterium substugae
MKRLVITLLLALGVAQAAQALEFRSVKETGVALYEAPALSAKKLFVVSRYYPVEVLQSQKEWARVRDATGGIAWIPAAALSKQRWLLVVSTQAGVRDKAGEDGKLLFTVPKDGVLELMEAPQAGWAKVRHRDGSVGYARITDLWGL

SEQ ID NO: 5778 - protein, 150 aa, Chromobacterium substugae
MSEQQELQPAFSIEKIYVKDLSLEVPNAPQVFLEQAQPEIDMQLASAGQQLDDGFYEVTLTVTVTAKLPEKTMFLCEVAQSGIFQIRNVPGEDLDPILGVACPNILFPYAREAVSSVVNRAGFPPVLLAPINFEALYMQQRAQQAEAGNA

SEQ ID NO: 5779 - protein, 85 aa, Chromobacterium substugae
MKPVTMYTTAVCPYCVRAKQLLASKGVSGIQEIRIDLDPEQRDKMMAITGRRTVPQIFIGDTHVGGCDDLVALNHAGKLDTLLAD

SEQ ID NO: 5780 - protein, 465 aa, Chromobacterium substugae
MNMTGKLILLAALTASAAPVQALDLHGFQPDEIAVWAAPVEGGSPVAEYRADQAVNPASTMKLLTGWAALNQLGPDYRWKTALLSEAPVRGDTLKGDLYWLGGGDPRFDNGNLLSLLYSLRLRGIRQLDGRLLLDKRAFSRVGGADDFAGDAGKAFMVSADSHLTNLKVAWLTFYNDDKGARVVLDPPLAGVSLQAELKPGGDEPCPDVRRFVAIRNDGRHVGVQGSVPAACDGARAFVSVLEHDDFAGQDFTALWRALGGVGPLAVGLGTAPAAARELAVWQSQPLTVALSDTNKYSNNTMARTLFLTLGREAGGEDTAAAAERALRGQLAQKGIADAGALALENGSGLSRRERVSARLMGEVLLDAARGPYAGEFLASLPIAGEDGTLKKRFAGLGPRLRLKTGTLRDVRAVAGYWLAADGRQLAIVAIVNSPRAPEMAKALDAVVADVVGAFDAAARSSANR

SEQ ID NO: 5781 - protein, 686 aa, Chromobacterium substugae
MCGVVVAPIPGEGVAEVDAAKLRCIESVLDGLPALPEEFLALARFASGYYHYPLGPTLFTALPTGLREPRDVIRPDRRSFLLTAAGLAEAPPARQRARLALWQALQDGPLDLAAAKAVTPQAGKLLADWLAEGKAARATPEPAPLRLGEAPALNAEQQAALDALRASQGFQPWLLHGVTGSGKTEVYLQLIADHLAARRQVLVLVPEINLTPQLINRFADRFPGSRIVVQHSHLADGERMHGWLDAWHGDAEVVIGTRLSVFTPLPRLGLIVVDEEHDGSFKQQDGLRYHARDLAVWRARRAGISIVLGSATPCLETVANVEAGRYRKLALIRRAHGAARMPDVRLVDTRRRRLAEGLDEGVVEALRARLARREMSLVFINRRGFAPVVACTACGWLSGCPHCSAKLVVHLLERKLRCHHCGWEEPVPRACPDCGDPDIKPLGEGTQRLEAALQRMLPEARVLRIDRDTTSRKDAWDEVYRKVHGGEVDILVGTQMLAKGHDFGTLSLVAVLGADGGLYSADFRASERLFSQLMQVAGRAGRAEAPGEVLIQTQWPEHPLYQALAAHDFDGYASSLLDERRQAGFPPSVFQALLRADSPELAQAAAFLKEARALLEPLADGVLISGPAPALMARLAQRERAQLVLEAPRRAALHSLLAQAQALLDPLARCHGRGLRWSLDVDPQEL

SEQ ID NO: 5782 - protein, 73 aa, Chromobacterium substugae
MLVPRPVRGAPAWCARMLLNEFLFLFKQNSYLLCRKPVEKNRGFLRIYCACRIEALGGRQGIDARQTGFRFCF

SEQ ID NO: 5783 - protein, 354 aa, Chromobacterium substugae
MTQLSNDTFLRALLKEPVEYTPIWMMRQAGRYLPEYRASRARAGSFMDLCTSPAFATEVTLQPLDRFPLDAAILFSDILTVPDAMGLGLYFAEGEGPKFERPLRDEAAIRALRPAPLDKLRYVFDAVASIRQALNGRVPLIGFSGSPFTLACYMVEGGGSDDFRHVKAMLYSRPELLHHILEMNTQSVIAYLNAQIDAGAQAVQIFDTWGGALSHAAYREFSLSYMQRIVAGLKREADGRRVPVIVFTKNGGQWLEDIAGIGADCVGLDWTTDIGLARARVGAKVALQGNFDPNALFASPEAIEREAGRILASYGQGSGHVFNLGHGISQFVDPAHAGALIEAVHRLSRPYHSQ

SEQ ID NO: 5784 - protein, 281 aa, Chromobacterium substugae
MVRVLSIWLLCCLLPMAQAAGMSINYALVSGDNDPHWPYMQALLQLACSQMRERCVLLAARDMNQGRATEQMLRAGGSVDLFWGMTSRERESKLLAVKVPLDKGLIGWRVPLISADRPQLFKGVKTRQQLMAFRAGQGQDWPDTQILQHAGLPVVTSVDYPNLFSMLRQRRYDYFPRSVIEVRQELESPNSKGLMLDPYLLLHYPTAFYFFVSPKRPELARMLEQGLERSVADGSFEQLFKSFNGDHLRGLNLAARTIIELDNPLLPEDTPLRRRELWFHP

SEQ ID NO: 5785 - protein, 171 aa, Chromobacterium substugae
MILLVLLWHFSLMSLLAVGGANVLLPELQRLVVAEGWMSAGQFAELFAIAQAAPGPNVLVVSLIGWHVAGLAGALVCMLGMCLPSSLLSFYVSRWWEANQGGELARLLARALLPLTVGLVGASACLLLQAANRDAAGWGVSLAVAWIAWRRNWNPLWLLLLGGLAGGLGWL

SEQ ID NO: 5786 - protein, 185 aa, Chromobacterium substugae
MNSDLILPSRRELFAGFFSIGVSGFGGVLPQAHSMLVLKRRWLSEADFAEQLGLCQVLPGPNIVNMAVSIGARFHGPSGALAAVCGLLLAPMVIVLLLASVYGRYRQLPLVEHVMHGLAAAAAGLLLAMALRLLSRLERRVWSALVVAATFAAIAVFRLPLLWVLLASAPLALALAWLNRGRAAT

SEQ ID NO: 5787 - protein, 294 aa, Chromobacterium substugae
MDRLLSMELFVAVVEKGSFTAAADAHRLSQPMVGKHIAALEARLGGKLLVRTTRRQQLTELGQHYFQRCRAILAELAAAEDAAALLRAQPRGVLRINASVTFGTLRLAPLLADFMARYPDIGVELELSDQLVDLVADGYDAVFRIGHLADSGMVARRLRPYRMMIAASPAYLAARGTPATPADLAEHDCLGFSRWRRDDGWEALAQRHGLRMRASRFLCNQGQALRQLALSGAGIALQAEALLAGDVAEGRLVSLLDGYLPDPKPMHLIYPADRQPLPKLRVFVDFIAERLGEL

SEQ ID NO: 5788 - protein, 198 aa, Chromobacterium substugae
MKILLVGASGTLGRAVHQALSHHQVITAGRGSGDLRVDITDSASVQWMFEQAGRLDAIVSATGSVHFAPLAEMTAADFRIGLNDKLLGQIDLALTGQHYLNDGGSITLTSGIISAQPIRQGANATAVNRALEGFAAAAALELGRDRRINVVSPNALQESWDGYAPFFPGFEPVPAARAALAYVRSVEGIANSQTLTVW

SEQ ID NO: 5789 - protein, 198 aa, Chromobacterium substugae
MKILLVGAGGTIGRSVSQALSHHQVIAASRSGGEVRVDLSEPSSIRALFERIGKVDAIVSAAGSLHLGSLTEMSSEQFRIGLDGKLLGQVNLALIGQHFLSDGGSITLTSGMGNEIPIRHGSNACAVNAAIEGFVRGAAVELAAGQRINVVSPGVLQESWEALKDLFPGFEAVPAARAARAYQRSVEGVETGQVFKVW

SEQ ID NO: 5790 - protein, 237 aa, Chromobacterium substugae
MKAILWGGLALLLCPLFPHAEPIPAYSQAIEPWGDPASGDGLTPRFLGWLAAQSGLRLAQDTRPLPRLVEDLKAGRDALALITASPERDAFGLELCRPAAIRLSLIHRQASRPLRPEDFRRRPVGILRGTHTLDAFLTASAAAPVRVADMRQGFGMLRIGRLDAMMCVRPGCGRVLRELSSPADKWTELPISSEPMAVYVSRAHPLARDAATLEKLRAACVSAAGRREMAALLARYD

SEQ ID NO: 5791 - protein, 654 aa, Chromobacterium substugae
MSQQYDESSVRVLKGLEPVKERPGMYTRTTDPTHICQEVIDNAADEALGGYARKIAVTVHQDGSLTVEDDGRGIPVGLHPQEGVPVVELVFTRLHAGGKFNKKDGGAYAFSGGLHGVGVSVTNALSTRLEVEVKREGGVHRLVFSGGDVIEPLARIGDCGPRTSGTRVRVWPDGKYFESPRYSMQELERLLRAKAVLLPGVAVTLTVEKSSGDEVKVWQYPEGLKSYLAELCGDDEPVAPLFAGEAYIGDDHEQFAKGEGAQWAMAWFEDGASGESYVNLIPTPVGGTHEAGLRAGVFDAVKSFVDHHNLLPRGVKLMAEDVWSRVRFVLSARVLDPQFQGQTKDKLTSRDALKLISGLARDPVELWLNQHVEAGKKIAELAIRQAQSRLKSVKKVEKKKGSGVAVLPGKLTDCESEDIERNELFLVEGDSAGGSAKLARDKEYQAILPLRGKVLNSWETDKDQLFSNAEIHDISVAIGVDPHGPNDAPDLSGQRYGKIAILSDADVDGSHIQVLLLTLFFRHFPRLVENGNVYIAQPPLFRVDVPGQGKTRPPRKLYALDEGEMAAILDRLRSEGVRENAWSISRFKGLGEMNPEQLKDTTMNPDTRRLSQVRVREGQLQQTLDTFVMLMGKGEAASRRSWMEAKGNEVEADI

SEQ ID NO: 5792 - protein, 37 aa, Chromobacterium substugae
MLAHILGLALSATRACAAPARAAGKKTAGIGPPCGYS

SEQ ID NO: 5793 - protein, 174 aa, Chromobacterium substugae
MLDRDGYRPNVGIILTNSRNEVFWGKRVREHSWQFPQGGIKPGESPEAAMYRELLEEVGLLPQHVKILGRTRDWMRYEVPTNWVRREWRGSYKGQKQIWFLLRLVGRDSDVCLRATSHPEFDGWRWNDYWAPVDAVIEFKRDVYERALSELSRFLRGVESHHAYQARTGAQSEH

SEQ ID NO: 5794 - protein, 446 aa, Chromobacterium substugae
MAFLLTRPTLSRLPWLPLRPEDFSTLLQTSEFRLRLLAGIAAAEQRIYLCSLYLENEEAGREILDALYQAKQRRPSLDIRVMVDWHRAQRGRIGEDQSHCNAAWYRDEAARRELDIPIYGVPVQTRELFGVLHLKGFVIDDTVYYSGASLNNVYLHKLDKYRFDRYHLIRNPELADAMAGFMAEQFFNDPAVFRLDKPAPSTRSIRKEIRQLRDKLVHSQYRLAGGQAAPDQLSVSPIVGIGKGNRLNRAILDVIASTERKLFICTPYFNFPRSVVLEINRALRRGVEIDIVVGDKTANDFYIPPKQPFRVIGALPYLYEMNLRRFAKRQRQFVNRGELRVHLWKDGDNTFHLKGMWGDERYILLTGNNLNPRAFRLDLENALLLRDPQRQLQAQSQAEQQSILRHTTLLKHYRQLEDVRHYPEQIKKLLTRLSRVRIDRMLNLML

SEQ ID NO: 5795 - protein, 596 aa, Chromobacterium substugae
MATPKVETRNLDVSHDYAEKWQQVLDLLARIVSIPAALIMQVQPPRIKVFLSSHSAGNPYEEDEMADLGTGLYCETVMSSRNELTVPNALTDPDWCDNPDIKLGMISYMGMPLTWPNQDIFGTICILDRVENAYTPIYRQLLAQFRSMVERDLKQIYNDKARAQEDAALRADEAERVRREFELLRAGEQKALRALRESEERWHFALEGAGDGVWDWNIANGEIFFSSRCQQLLGLSRPADIADFQLWQTGIHPDDLPTVLADLASYLRQPQGSFVTEHRFRKDQDWIWLLGRGMVVSHDAQGQPLRMIGTYSDISRRKHAEGELQLLNSHLEERVASRTAELKKAMHQISIAEKQTALARMVAGMAHELNTPIGNILLCSSQIQADVADIARADADKQLSRKGLQDFLLKAGETCELLQRNSEQAGDLIGRFKQIAVDQLDQPKRVFSPGEVIGQLLKALLPPEHHPHLLVEMHAPAHLMIENYPSALEQLVSHLVANSLTHGFEGRNQGCIAITISQSQGDITLRYEDDGKGIPAELHGKVFDPFFTTRMGQGGVGLGLAMVHNIVQVILKGQIRLESEPGHNTAFIITFPPNPA

SEQ ID NO: 5796 - protein, 304 aa, Chromobacterium substugae
MVSRSSKPVRRILAGDRSLFIHSMPRHSLHDLYHYCMTISWPRFYLFIAAAFLALNLLFAGFYQLQPGGIANQFPQGFLGAFFFSVETLATVGYGDMHPQTLYTHWISMLEIFIGMMSIALITGVTFARFSRPRARIVFTSLAVVRPLNGEPALMLRAANARNNVIIDASARLRLLQHEVTAEGTAFRKLYDLELVRDEHPMFVLGWTLVHKLDERSPLYRRDAESLAAVKAQLILSISGIDETTIQPMVARHTFSHLDIRWNHVFADLIYTDEEENDHVDYQLLQEVRPLRADGGQSDEAERR

SEQ ID NO: 5797 - protein, 88 aa, Chromobacterium substugae
MKKSKFTEEQIAFALRQAESGTTIAEVCRKMGVSEATFYNWKKKYGGLGVSELRRLKQLEEENARLKRMVADLSLDKQMLQEVIQKKL

SEQ ID NO: 5798 - protein, 278 aa, Chromobacterium substugae
MKPARKRELANFLIDAYRVSIRRATAVIQLRQATYFYRPHPRDDRAERQRILEIAATRIRYGARRIYVLLRREGWRIHHKKTYRIYCEEGLNLRRKRPKRRVAAAHRHARPAVSNLNACWSMDFVADQLFNGQKIRALTVVDNFSRESLAITVDFALKAADVVATMQHVQALRGTPQRIQVDNGSEFISLALDQWAYEQGVTLDFSRPGKPTDNAFIESFNGSLRDECLNVHWFLSLDDAREKIERWRQDYNEFRPHSSLGDQTPSEFRLAHLEAGNL

SEQ ID NO: 5799 - protein, 497 aa, Chromobacterium substugae
MSTGTINWQKKAEQLHFEGRAYIDGAYRKALSGKEFTTINPATGKVLASIEWCGEEDVELAVRAARRAFDGGAWSELAPRSKMEILKRFASLIQDNIEELALLESLDVGKPIANALSVDISNTAYCISWFAELIDKVPGEVVPVDPALLGMVTREPVGVVAAIVPWNFPLLMASWKFAPALAAGNAVILKPSEKSPLTAIRIAALAEAAGIPPGIFQVLPGAGNVGQALASHLDVDCVAFTGSTAVGKQIANYAAQSNLKRVWLELGGKSPNIILADCKDLKAAARAAAGAICYNAGQMCTAGSRVLVAREIREAFLSELKVAMADYRPGDPLSPETNLGAVVDQRQFDKVLSYIAQGQKEGATLLQGGAAVQAIHPDGLFIEPAIFDCPQPNLTICREEIFGPVLSVITFDDVDEAVQIANDSQYGLGAAVWTQDVSTAHKVARQLRAGTVWVNCYEEGGDMNLPFGGYKQSGNGRDKSLHALEKYTELKSTLIKL

SEQ ID NO: 5800 - protein, 431 aa, Chromobacterium substugae
MESVPAIAAKKITVRIVPWLIICLTMAYIDRTNLAFAQFSLAKSFGIDPLVFGTAAGVFFAGYIAAEIPSNLLLLRFGARRWLARIMISWGVVTMSTYYVHTDTQLYIVRFLLGVCEAGFYPGVLFYLTRFIPIENRAKTNFLFISAIPLSAVIGSIFSGWLLETISKSHYLGLAAWQWLFWTEGLMTIFIGIALLYVLPESIKSVKYLTDAEKLQLSAHIQAQEETKAVIGSPLKALLDLKVWIYAIVTSASAFSMYCISFWLPQIIKSFDVADILHIGLINAIPWGLALIALATSFLMIGTIKRPVFVLSLLYGVGCLSFSAILINGISVTTKLGLISIATTAIMLTYPVFWSLVNFLKGKAAAVIFAVINSIGSLAGFVSPIMMGYVIKATGSPQLGIVIMSSFMGLAVILLFVIHIAFTENKRAAAF

SEQ ID NO: 5801 - protein, 80 aa, Chromobacterium substugae
MEFDMSHLVETMAYVGQIPWHGLGNCLPAGQPVEVWQREAGLDWSIQEAEVLFNNTAADAIHIRAHSDAKVLYRRIRWRR

SEQ ID NO: 5802 - protein, 154 aa, Chromobacterium substugae
MDEQCYQRLILPYLIEHDIPLLFVVNQVDKIEPCREWDFIHSMPGPQQLTHISRKQMQISQLFNAPVTQIFIISAMEGYGLQILIEQIIHRLPKEKKWSVTRETRAEYVTPAMQRESIGGLWDTIKEAAKTILRETWTTISHRVESWFSKRFGW

SEQ ID NO: 5803 - protein, 206 aa, Chromobacterium substugae
MSRRMTLLLELLVNFLLPWLCYRWARPHWGEMGGLLLSAAPPLMWSGWELWRSRRVDAMSMLVLLGIALSLLGMALGGGEKMLLLRESLLSGLFGAAFLLSLLFPRPLVFFLARAALERQRQDGREHCEWLWAQAAFRRGMRFMTAMWGLGLVSEMLLRSWLAWHWPVERSVLLLPWISYGVMGLLCGATWLLRRRLTVAMQLAAA

SEQ ID NO: 5804 - protein, 61 aa, Chromobacterium substugae
MKISQLKPGYKVFEHKDSGSVVHYEVVSIRQVGKMFEVTFKSALGLASAMYPANGFIQAAA

SEQ ID NO: 5805 - protein, 686 aa, Chromobacterium substugae
MTKRKILVTSALPYANGAIHLGHMLEQIQTDIWVRFQKMRGHECYYVCADDTHGAPIMLAAEKRGISPEQLVDEVRALHVADSQGFLIGHDNYYSTNSPENKELAEQVYKALRADDKIAVRTIEQLYDPEKQMFLPDRFVKGECPKCSAKDQYGDNCEVCGATYNPTELKNPYSAVSGAKPVLKTSEHYFFRLGECADFLKQWTSGASRRADGVEQPHLQQESLNKMNEWIDGGLQDWDISRDAPYFGFEIPDAPGKYFYVWLDAPIGYMASFKNLCDRSGLKFDEWFAKDSQAEMYHFIGKDILYFHALFWPAMLNYSGLRAPTGVFAHGFLTVDGQKMSKSRGTFIQAKSYLDCGLNPEWMRYYIAAKLNGRIEDIDLNLNDFVARVNSDLVGKFVNIASRSAGFIAKRFDGQLAASVSDLDILAKLQAAAEDLAAAFEAREYAKALRDVMALADMVNVYVDANKPWELAKQEGQDARLQEVCTVLINAFRLLTIYLKPVLPKLAEGVEAFLEVAPLAWSDAQTLLLGKKINAYQHLMQRIDPALIDKLIEANKENMQATQDTPAAAAHEPLAETIKIDDFAKVDLRVGKVLECGFVEGSDKLLQFKVDLGFETRNIFSGIRKAYQEPEKLVGRHVIVVANLAERKMRFGVSQGMIVCASGTDDSEGLYLLDVDAGVKPGMRIG

SEQ ID NO: 5806 - protein, 419 aa, Chromobacterium substugae
MQSKHAKLTWSNLLFPLALVLFEFAVYICNDMVQPAMLSVTREFLVDASWAPTSMTAFLVGGALLPWLTGPLSDRIGRRPVLLFGVAYFTIACLATYLVSSIEAFIALRLLQGVGLCFINAVGYASLQESFEETAAVRVTALMANVALIAPLVGPLAGAALLELAPWRSGFLFIAGLSFLALVGLYFRMPETVAPSHEKLPLSSMGRDYLKVFGHSRFVLAALCIPLLALPLMGWIALSPVLLVRDLHMSAVAYGLMQIPVFGGLIAGNLALAVIADRWPLGRSALVGMWPIVGGLAVMVGGVLVSSLPQYWMVAGMSLMAFGEGLAFGVLYRFALMSCDVAGRGTISASMSMISMAGYAVGIELFRQVYQASGLTGFAVLALCFSLAYVLLGRKMVGIAMAERAAPAVEDGRLASQGA

SEQ ID NO: 5807 - protein, 406 aa, Chromobacterium substugae
MAGAMRAAANPTKILGNHHPERRMFSKLTRLFGGQADQATQNETMAQLESQILDTLKPLIDANTGKGYVAAKNVKNLQIDDKAIRLDVTLAYPAKSQFDAVRQQFETALAPLAEGRAVEVRVDSQIVSHSAQRGVPLLPGVKNIIAVASGKGGVGKSTTAANLALALSAEGARVGLLDADIYGPSQPLMMGLQGQRPESADGKLRPLIGHGIQTMSIGYLVDADQAMVWRGPMVSQALQQLLNDTRWDDLDYLVIDMPPGTGDIQLTLSQKVPVTGALIVTTPQDIALLDARKGVTMFQKVNVPILGLVENMAIHICSNCGHAEHIFGEGGAARMAADFGVELLGSLPLELAIRLAVDAGKPSVAADPAGTPAELYRAIARRVAVKVGEKAQDFSGKFPKIVIQNN

SEQ ID NO: 5808 - protein, 258 aa, Chromobacterium substugae
MIAMYDSGLGGLSVWRAVRAALPAWPITYLADQAYCPYGQRSRREIIERSLKVGHYLVSQGATILVVACNTATTAAVSSMREQLPIPIVGIEPAIKPAAAMSRTGRIAVLATEYTLASDRVKALLDAHAGDVEVLRRPGHGWVEQVEAGELDSERTRQLVRQVVAPLLGQGIDHIALGCTHYPFLAPLIRELTGDGIQLYDPAEAIARRVCDLLRQHGCDSQGDGYCRFISTADGNDMALRLPQLIGRSDPVESVPLD

SEQ ID NO: 5809 - protein, 149 aa, Chromobacterium substugae
MKRPLSLLAALLAAISLNAHAAPGCFNVAGDIARQTGNRLDRQELTEVLQSLSRSGQLPPKFVNKKQARAAGWQPGRSLWSVPALQGKSMGGDRFGNYEKRLPAGQWQEADLGYKGGKRGAYRLVFSHQGQRYVSVDHYNRFIEVPPCQ

SEQ ID NO: 5810 - protein, 92 aa, Chromobacterium substugae
MPVKVCELRHIVSQEQLFDELSRQLRLPPHFGRNLDALYDCLANDASGPFELVWRDTAESKQALGADLYATVLEILETVAEARGDVTLDIHH

SEQ ID NO: 5811 - protein, 414 aa, Chromobacterium substugae
MKSKKLTALILVGMLLGILVGYLFRQHAGNDAAAIKSFVDGMSILTDIFLRLIKMIIAPLVISTLVVGIAKMGDAKSVGRIGGKTMGWFVSASLVSLTLGLIMVNILKPGVALNLPLPDLHADSGIKASAISLKDFVTHAIPKSVFEAMANNEILQIVIFSVFFGSAMAALGERSKALIDVIDVVAHVMLKVTSYVMNFAPLAVFGAIAATVAKEGLSILGTYGKFMAQFYLSIGILWVLLIAVGVLIVGPRLLHLMGMIKEPLLLSFTTASSEAAYPKTLEQLERFGVSNKIASFVLPMGYSFNLDGSMMYCTFAVIFIAQAYGIDLTLAQEISMLLILMLTSKGMAGVPRASLVVIAATLSQFNIPEAGLLLLLGIDHFLDMGRSATNVVGNSIATAVVAKWEGELKPGKHA

SEQ ID NO: 5812 - protein, 61 aa, Chromobacterium substugae
MTAAVPAPPVYRYTQRRDGAVIYVGPEPPTPEPGTSCTRMEWVAVPGMEWGGQWADPEIVF

SEQ ID NO: 5813 - protein, 278 aa, Chromobacterium substugae
MQPLTQLADAARAAIAVGDLPDSVIEATAEAIGKDAYDCVRVWSAWGVGTMGPDDFVPIADDGDLVAEIARAAIESYLAAMQPAQAATEQSGEADRMGELPKVRRDSHAAAIGNLRDMASSMLERDESVGIFADEDQHALLMALADLLEEAEGNTPVALYTCPQPAPAVPEGWRDVLFGNFDALDAAADSIDARGMNCHAEGIRAVAHALKQLAATPRPRDAARWRYAAENGFPRSFRQIHPTRGPREWHIGEHVPGALTYETPEAAIDATMAQQDQS

SEQ ID NO: 5814 - protein, 43 aa, Chromobacterium substugae; identical to SEQ ID NO: 5675

SEQ ID NO: 5815 - protein, 94 aa, Chromobacterium substugae
MIRIELMRLYGDERADEWKAGAAFCTCSNSTKLVNLPPTEKMLAAKRTGPKPPNLAEAYKFFTGQDLLGAHNAMVDVAGCREVYFGILRHREAA

SEQ ID NO: 5816 - protein, 88 aa, Chromobacterium substugae
MKKSKFTEEQIAFALRQAESGTTVAEVCRKMGVSEATFYNWKKKYGGLGVSELRRLKQLEEENARLKRMVADLSLDKQMLQEVIQKKL

SEQ ID NO: 5817 - protein, 433 aa, Chromobacterium substugae
MSRFCHALALCAALAGCAMSPRGGELCSFSGAAQSARPGAVIVNLYALGEGLPELAAQQVLPQGGEWRLAAAPGRYLALAFQDEAGDQQWSGGESWGEAGGGEPLVCAGGRPLRGLDIDLGSRQPGGEVRKMLQESRPGPLALPQGRALSVGEVGRMDDPLWTPEYGQQGIWHPDLFMRQAHPGIYFLHPYQEGKIPVLFIHGMGGTPRNFDTLVQSLDVSRFQPWLAFYPSGSDLTVSAQMLHVVLLQLQRRFHFPSLVVVAHSMGGLVARQLLLDMAVDRSAVTVPLLLTLATPWAGDGGAGVGVRRTPAPWVVDSWRNLAPDSVFLRQLFVRADGSPKTLPAATRHVLLFGFQRGRWMSREPGDGRVALSSQLRDEAQSQASRIKGYQQSHAGILHADEVSRDVSAALASYALPAAGQPDGGRRPPMLRR

SEQ ID NO: 5818 - protein, 255 aa, Chromobacterium substugae
MVISPAKTLDYQTPPASAQFSQPSLLEHSAELISELRRKSPLEISQLMSISDALANLNVGRYADWQPPFAPNNAKQALYAFKGDVYEGLDAGSLSPDATGYLQQRLRILSGLYGVLRPLDLMQAYRLEMGTRLANPRGKNLYEFWGRIVTDALNAQLEQLGQSVLVNLASEEYFKSVKAKQLNAAIVTPVFQDRKNGQYKIISFYAKRARGLMARWAAEHRVLQPEALRDFDSEGYAFDASASSELTWVFRRDLE

SEQ ID NO: 5819 - protein, 150 aa, Chromobacterium substugae
MRVLVQRVSQAEVTVAGEVKGRIGEGLLLLVGVEEADGGDDIGWLVRKISQLRIFGDENGVMNRSLLESGGQALAVSQFTLHASVKKGNRPSYSRAARGEISQPLFDRFVAELAAALGKPVPTGVFGADMLVSLVNDGPVTIWLDSRNPE

SEQ ID NO: 5820 - protein, 351 aa, Chromobacterium substugae
MNKLPWRVLVVPYYLNRYARQVHVLRVALAFLFGLLLTLWSGMPHGGWMLVTILIVLGGAPHWGGVQRKALERMGGSLLGALAGLAAIVLHGWSPYACYAWMAAVVGLSTWHAQGRGGYLALLTGITLVIVGGLGDEPIAEALWRSCNVLIGSLIGMAAAATLPLRAIDSWRFLLADNLREAALLYNRIARRLPVEGDAALAEFNARLILMRGLLPAVTQESSLAHGRLEQVQRCQRGMWTLLDRMAEVAAATPALAEERSPRRAIVRTLLRAAHALRFNQPQLLEQPLPAADNPSRMQWPSHCHWLVAELTLTVEELRQNLRQTLPQLIAVPPPARSLVRRMLGLGRGMK

SEQ ID NO: 5821 - protein, 565 aa, Chromobacterium substugae
MAAGLDMMLQNSSLLRNGDDVWKRAREGFRLDEVNADTVRRQERFYASRPEYFKRTLDRSRKYLFHIMNEVERRGMPTEIALLPMVESAFVPTALSRVPAYISPTGASGLWQIMPATGRQYGLEQTWWYDGRRDVMESTRAALDYLQNLYAQFGDWNLALAAYNWGEGNVARALAKAQAAGQPATYESIRLPNETRNYVPKLLAVRNILLNPEKFGVRLDKFPNKPYFVAVSASKHMNIDIAARLAGISVAEFKELNPAFNLPVFAYKAGRQMLLPAAKADKFQANLDKWNQPLLTWEVYIPKTDESANSIASSHGMSAGQLQAANRLNSPTLKAGQPVLVAMNKTLNDGQPLESTDAQIGDAPAGATLLAKADTAAAPQPAPAVAQATPAPVIMTATAAPAAPQAQDAAPRQTVVIASAGVQDGAAKSLATRDIGSYTVASGDTLYSIARRNNLAVEELKSLNRLDGNMVQVGQQLQLQSVEQGETQLASAGPSDRDADPALIQVSDSRPAPARHSTEYTVKRGDTLFSIARRFGVKHDDIQRLNGSRQASRLQPGQKVKIVGL

SEQ ID NO: 5822 - protein, 255 aa, Chromobacterium substugae
MPAKFSVTPVGAFSDNYIWVLRLDDRAVAVDPGDAAPLLAFLRREKLRLEAILITHHHADHCGGLAELSRDWPDAPVYGPPGISGVTAAVKEGDEVPLAFGPAEVLAVPGHTLDHLAYRIGDHLFCGDTMFAAGCGRVFEGTPAQLLASLKKLAQLPPRTKVYPAHEYTLSNLRFALAADPLNPVLAMRQSRDQALREQGLPTLPSTIAVELASNPFLRCQEPAIRASLLAQGGRADDAEADSFARLRAWKNDFR

SEQ ID NO: 5823 - protein, 255 aa, Chromobacterium substugae
MKNSFGGWLTGTELGRYLLAREQDYFERAVADVFGYHAVQVGVPEMDCLRGNRIPWQCRVAEAGEVDVRCDPAFLPFENRSLDLLVMPHVLDFTTLPHQVLREADRVLMPEGRLILTGFNPLSLWGVRRLIQGRESVPWNGSFLTQLRVKDWLTLLDLELEEAAFMAYAPPFARGDWLCRCDFMEDAGERWWPLAAGVYGIEAVKRQRGMRLITPNWKQKQAKNKGALGVVAGNERQHTHKRPDATERDGAPSCH

SEQ ID NO: 5824 - protein, 147 aa, Chromobacterium substugae
MTTEDKVEIYTDGACKGNPGPGGWGALLRYKGREKEIFGGEPGTTNNRMEIMAVIRALASLNRPCQVVVYTDSQYVQKGISEWIHGWKARGWKTAAKEPVKNADLWQQLDAERNRHLAVEWRWVKGHAGHEFNERADQLANKGVETV

SEQ ID NO: 5825 - protein, 239 aa, Chromobacterium substugae
MRQIILDTETTGLDPNQGHRIIEFAGLEMVGRKLTGKHLHLYIHPERDIDPDAQRVHGISLEFLAGKPVYRQVAQEIADFLRGAELIIHNAPFDVGFLNAEFAKLGLEPIDKLCASVIDTLREARDMFPGKRNSLDALCDRFEIDRSNRTLHGALVDCELLSEVYLWMTRGQESLAMDIDVELPGDAGGAIQFERKPLTVLAASEAEQAEHQAYLDALDKAVKGQCLWRSLEQPAQAEG

SEQ ID NO: 5826 - protein, 228 aa, Chromobacterium substugae
MARYIALVPAAGSGSRFGAASPKQYLQLNGKPLMWHTLATLAAVSAIDEVAVVISPQDEWFDDFAWDLPKLRVCRVGGASRAESVGNGLAALGCDADDWVLVHDAARCCLSVAAVERLIATLSGHQVGGLLALPVPDTVKRADSEGHVGATVPRNGLWLAQTPQMFRAGVLEKALREQPADDITDEASAVERAGLKPLLVEGDAQNFKVTYPRDLALARAILAARDGQ

SEQ ID NO: 5827 - protein, 158 aa, Chromobacterium substugae
MFRIGQGYDVHQLVEGRPLILGGVRVPHEKGLLGHSDADALLHAITDALLGAAALGDIGRHFPDTAAEFKGADSRALLREAAARVRAAGWRPVNVDSTLIAQKPKLAPHIDAMRANIAEDLGLEIGAVNVKGKTNEKLGYLGRCEAIEAQAICLLMPA

SEQ ID NO: 5828 - protein, 219 aa, Chromobacterium substugae
MLTQDQLKLAVAKKALEFVPDDAIIGVGTGSTVNLFIEELAGIKGRIKGAVSSSEASTARLKAHHIPVFDLNEVEKLTVYIDGADEINHHLHMIKGGGAALTREKIVAGVADEFICIADENKYVAMLGAFPLPIEVIPMARSYVARELVRLGGHPELRQGVTTDNGNVIIDVHGLQIMKPVELEETINHIAGVVTCGLFARRRADVLVLGKQGGVEVLR

SEQ ID NO: 5829 - protein, 234 aa, Chromobacterium substugae
MADHISKQFDLELETIRTRVLQMGGLVEQQILSAIEAMMSGDIARLDKVMAEDALVNAMEVGIDDDCLHIIARRQPAASDLRIVFTVIKIITDLERIGDEAAKIARMGKTIHQAERYQMPRFREIEKMAAVALAMLRRALDAFARLDTSAALELAEEDERLDENFAAELRQLITFMMEDPRTISMSIDTLFISKAIERIGDHSKNISEYVVYLVKGKDIRHTTLEDKKRETLGR

SEQ ID NO: 5830 - protein, 497 aa, Chromobacterium substugae
MTHATPPHTVLATIDLGSNSFRLQVSRVVDDQLYTLDVMKETVRLGAGLTADKYLNDDTRERALACLARFGERLRGFVAGQVRVVGTNTLRVAKNAAGFIAEAEERLGFPIEVIAGREEARLIYLGAAHSLPDTKERRMVVDIGGGSTEFIIGSHYKALVTESLPLGCVSYTLRFFPDGKLTRNNFRDAVLAARNEIQRIRHEYRPSEWQLAVGTSGTARSLRDVLEINDWSRADITLAGMERLRAVLIEQGSMDAIKVNGLKADRAPVLAGGLAIMIAVFEELQVEKMIVTEGALRDGVLYDLLGRQREKDMRDSTVALFKRRYHADTQQAERVNLLSERLYRMVAGEDVDQDMLKRLSWAAKLHEIGLTIAHTAYHKHSAYILQNADMPGFSKREQATLATIVLGHRGDMGKMAQYIGQPALWQAVVALRLAVLFYRSRINVELPGRLDLRQHARGFTLSLSKSWLSDNPLSASSFRQEVGQWKNVGFQLDIVQE

SEQ ID NO: 5831 - protein, 354 aa, Chromobacterium substugae
MRHPELKERLPTLGEQAGTLLSVGEAKHAGTKLSLFDFCADEAIELAELPLANLASYRRRGEVLWLNVYGLSDAAAIQAIGERFGLHPLVQEDILNARQRPKLEDYDDYLFLACRVFDYQQGGRLQSDQMYLVLGDGFVLSFQEKPTGVFEQVRERLRKGRGALRRRGADYLAYSLLDAIIDDYFGVLGQFNDKVERTDGQLLAGRDNGVLRQIQRLKRDCLKLRRALLPLREVLLSLNRGDEERFGEDTRVYLRDAYDHVVHVLESLEMNREMVGDMMDLYLSTQSHRLNLQMRVLTVITMIFMPLTLIAGIYGMNFEYMPELKWHYGYFIVLLAMGGISACMSWWFWKRRWI

SEQ ID NO: 5832 - protein, 199 aa, Chromobacterium substugae
MIVVDVQNSFCPGGALAVPGGDEVVPLINHLALLFENVVLTQDWHPAGHVSFAGSHPGSKPFQTIDLPYGPQTLWPAHCVQGSVGADFHPELETQHARLIVRKGGNPQVDSYSAFVEADRATRTGLAGYLDALGVKKVWLAGLATDFCVAWSAIDARAAGFETFVVEDACRAIDIDGSLADAWMKMRQAGVKRLRSDEV

SEQ ID NO: 5833 - protein, 779 aa, Chromobacterium substugae
MTQSLLTLPVAGMSCAACAARIEKQLNRLDGVQASVSFANESAQLRYDPNQTQPGQLVDAIVRCGFEVPRQTLLLGIGGMSCAACAARLEKALGRLPGVEASVNFAAESARIDYLPGLADRDRVLDAVRKAGFEPSLREDGGGEAEARYRRELAWFAASALLTLPFMVEMAAMFAGGHHGWLPRLWQLALATPVQFVVGWRFYRGAWQALRGGVANMDVLVALGTSMAWLLSAAVTLLGLEGEHVYFEASAAVITLVLLGKLLEARAKGKTSAAIAALAKLAPRTARVERDGELFEVAVEQLQRGDVVVVRHGDRLPVDGEVVEGQAWLDESLLTGESRPVAKQAGDKVYAATRNQDGMLKVRATGVGGDTQLAEIVRMVAAAQGSKAPIQRLADRISAVFVPAVTALALLTFALSGWLFGSWTTALIHAVAVLVIACPCALGLATPTAVMVGVGNGARRGILFRNAAALEQAGKVDVLLVDKTGTLTEGRPTLRHALALDGDENRLIQLAASAEAGSEHPLAHALLQRAKERELPLLACERFRADVGSGVEAALPGVGTVKVGVPSWIGLDLPAEAADWPQEGNTVVAVSLDERPLGLLALADPLRDSSKGAVEALRSLGIKVVMLTGDHESTARGIAAEAGIDEWRAGMKPQDKADVVKYWQQQGRKVAMLGDGVNDAPALAAADVSLAMGAGSDVAIAAADITLMHGDLAHAADAIRLSRASLAKIRQNLAFAFVYNVLGIPLAALGMLNPVIAGAAMAASSVSVVSNSLLLRRWR

SEQ ID NO: 5834 - protein, 69 aa, Chromobacterium substugae
MTELVLNIDGMTCGGCVKSVSGILGTMAGVAEVQVSLEEKRATVDYDAAVVSPQELAAAVADAGFDVSF

SEQ ID NO: 5835 - protein, 339 aa, Chromobacterium substugae
MCTHFLLQSQDKQVVVGRSMDFSRPLTPAFYVQRRGERFSQPVWAGAEFRKMADAEAWRVRHGYVGVCSSHLPLPGISQRIVTDGLNEAGLSVSLLWLPNARYQEFSSLGTTVLAPLFADWVLAHCASVADVWEMLPSRQFWLPAWLAKSLPLHAAIVDKDGRSIVVEFQDGQQKIYSNPAGVCANAPWFPWHLDNLGHYLGLTPDDPPPREFGNLQLQASGGGGLANLPGGYSSPARFVRAAYLKQFADPAADLGAAYALAAQLLGAVETPRGAIRDGAAREHTQWTVLTGLASGEIALRAYGGMRYCGLRLADIDFAAVKSGEIPLPGLDDIAFMRA

SEQ ID NO: 5836 - protein, 105 aa, Chromobacterium substugae
MQGYQLSFFTQQGHRHHGVPLAEWILQEAHRLGIGGATLFAASEGFGNDRRIHAARFFELADQPEEVTMALSAHEAERLLERLREEGVKVFYVKTPVEYGTLGAD

SEQ ID NO: 5837 - protein, 255 aa, Chromobacterium substugae
MHIRILGASACVGHPGQTTCFQVGQDTLIDCGTGCGSLDTEEMLAIRRVLLTNSHIDHCALLPLLADVHAGYRGSGLEVYGLAETLNILRQHLFNGAIWPDYTRLPSPECPWLRMMPVQVGDTVPLVDGLATALPAQRHVPAMGWLIEGPWRALAFSGDSAPCPAFWHWVCGVPSLTDVICEVTYSNDRQHEADEQSHMAPATLAPLLANLPANVHLWISHAYPCCRDMLLQEMQGGAPAGLRVCPLKEGTLIEL

SEQ ID NO: 5838 - protein, 621 aa, Chromobacterium substugae
MQKQILTALAASLLAGSALAADIPLRDFFRNAEQSGFSLSPDGQSVAFLSPWESRKNIVVRRQGKPDQRVTAIKDRDLSGYFWKGNDRLVYVKDNAGDENFHLYSVDLASGESKDLTPFPGVRVDIVDGLVDRDDELLVQMNKRNPELFDVYRVNLKTGELKLEAENPGKVAGWLTDHDGNIRLAIESDGVNNTVLYRDEPGGPFRKLFTTNFRENFTPLFFTFDNQRFYAASSLGRDKAAIVEYDPKTGKEVREVYARQDVDVAGLGFSHKRKVITCADFETDKPGRQCFDAQSEALLSGLEAKLPGYQVDITSSNRDETRFIVTAWNDRTRGKSYLYDKSSGKLELLAELAPWLPEDKMAVMKPIQYQSRDGLTINGYLTLPQGKEDAKGLPVIINPHGGPWYRDSWHFNPEVQFFASRGWAVLQMNFRGSTGYGRQFWEASFKEWGGKMQDDVSDGVDWLVKQGVADPKKVCIYGGSYGGYATLSGITKTPELYRCAVDYVGVSNLFTFMKTIPPYWKPFLDSMYEMVGNPEKDKDLLRERSPVFHVDRIQSPLLVLQGAKDPRVNINESNQIVDALKKRGVEVEYIVKDNEGHGFHNEENRFAAYGAMEQFFKKYLD

SEQ ID NO: 5839 - protein, 456 aa, Chromobacterium substugae
MYPLEIFSAIAVGYLLLCGLLQLLGHWGARRWRQPLSQPRFKPGGFSAKVALFPHPFHAMHPTHAANDRGFWRILLVFLKLGLTSFGGPVAHLGYFRAEFVERRRWLPERDYADLVALCQFLPGPASSQVGMALGMGRGGLAGALAAWLGFTLPSALLMLSLALGLSHHAQAVPPGALHGLKLAAVAVVAQAVWSMARQLCPDRPRLTLMGASCCLALLMPAPWLSLAVIALAGAAGRQWLTPPPQSAPGLDDATAPSRRRGALWLALFFALLAGLPLLAAAGPSYRLALFDAFYRSGALVFGGGHVVLPLLETASVASGWVPRDAFLAGYGAAQALPGPLFAFAAFLGAAGDGSWQSGALALVAIFLPGFLLLAGALPFWRRLRAAPGAQSALAGINAAVVGLLLAALYHPAWTSAVRAPADFAAVLLALLALAAWKLPPWLVVGLCAAAGWLAL

SEQ ID NO: 5840 - protein, 246 aa, Chromobacterium substugae
MTPPAWLGHNWLEPHYLIWLGKGALLTGWLSLLVIAAASLLGVAFTALLDGAPRPLRLATRLFVGLHRNTPLMVQLLLWYFGVSGLLPDEAKIWLNTPRALELPLGLALPWPSFEFLAAFTALTLYSAAFISGELQAGLNAVSKGQRLAAKALGMSGWQALRLVVLPQAWQLVKRPLVGQYTAIVKNTSLTMAIGLAELSYASRQVETETLLAFQSFAAATALYLILVLITQLLAQRPEPEWRTLR

SEQ ID NO: 5841 - protein, 267 aa, Chromobacterium substugae
MKKTLALALAVALTSTAALADRLDDIKKAGVLRVAAFDSNPPFGFLDAKTRQISGLDVDVAQHIAKKLGVKLQLVATNPANRVPLLVSGKADIVAANFTVTDERKKQVDFSLPYFASGQQFIVRKGTLQKPEQLAGLRVGVDKGTTQEVYLREKYPKTTVVAYDDTPLAFTALRNGNVQAITQDGSKLAALLANAPDKAKYELAPFTLTREYQAIGLPKGEARLAKVVNDTLQQLEKSGDAAKIYDRWFGPKTKAPLPRDFKIGDAV

SEQ ID NO: 5842 - protein, 283 aa, Chromobacterium substugae
MLIHPQFDPVAVHLGPLAVHWYGLMYLLGFTLFLVMGKYRLKKGNDVLTVAQLDDMLMYGAVGVVLGGRLGEVLFYQPGFYFSHPLEIFMVWKGGMSFHGGFIGVLVAVALYGRKVNRSFWQLTDFVAPLVPLGLAAGRVGNFINGELWGRVASPDLPWAMLFPQARLDDVAEAQQSADLMNMLMQYGGLARHPSQLYEFALEGIALFSALWIYSAKPRATGKVSALFLIGYGLARFCSEFFRNPDAGIFGKSDVISMGQWLSLPMIIIGVALFVFFGKRKAA

SEQ ID NO: 5843 - protein, 42 aa, Chromobacterium substugae
MRHEASFICSKPVVVPSRQQGKLAAFGPWVPGGPNQKPSRRG

SEQ ID NO: 5844 - protein, 617 aa, Chromobacterium substugae
MPQYRSRTSTAGRNMAGARALWRATGMTDADFGKPIIAIANSFTQFVPGHVHLQNMGQLVAREIEKAGGVAKEFNTIAIDDGIAMGHGGMLYSLPSRDLIADSVEYMVNAHCADALVCISNCDKITPGMLMAAMRLNIPVVFVSGGPMEAGKVQWGNEVRKLDLVDAMVEAANSAVSDEDVDRVERSACPTCGSCSGMFTANSMNCLTEALGLSLPGNGSLVATHADRKELFLKAGRLIVELAKRHYEGEDYSILPRGIATKAAFENAMSLDVAMGGSTNTVLHLLAAASEAGVDFKMADIDRISRGVPCLSKVAPATQKYHMEDVHRAGGVIGILAELDRAGLIHRDVPTVHSPTLGSALEQWDVMRHGEGSEPHRLFRAAPGGVATTIAFSQSMRYPTLDDDRADGCIRDKAHAYSQDGGLAVLYGNIAERGCIVKTAGVDDSILKFTGRARIFESQDAAVEGILADQIVAGDIVIIRYEGPKGGPGMQEMLYPTSYLKSKGLGKACALLTDGRFSGGTSGLSIGHASPEAAEGGAIGLAQEGDTVEIDIPNRRIHLAVPDEELARRRAAMEAKGRDAWKPVGRNRVVSPALRAYAAMTTSADTGAVRDVSQVEK

SEQ ID NO: 5845 - protein, 39 aa, Chromobacterium substugae
MTYRDGMKKQPLAAAFFIFLNMYSTTVHTSGYLFDYDAI

SEQ ID NO: 5846 - protein, 106 aa, Chromobacterium substugae
MKTIYLLFVLASALIEVGANLMLEKSDGFRRKAWGFGAITLVWLAFALLGQAVKGMDLAIAYALWGAIGILGTALGARVLYKQKLKPIGWAGIAIVSAAVVTLSTV

SEQ ID NO: 5847 - protein, 122 aa, Chromobacterium substugae
MYKKISSPLFIAWALLMAAIGCEIVGTSLMAMAARSGSYLGYIWMAAALALSYYLLSLALRAISVGVAYAVWEGLGLAGLTAVSVWLFGEKLVPQEWLGLGLALLGLACVTLGETHDEEAAA

SEQ ID NO: 5848 - protein, 51 aa, Chromobacterium substugae
MRIVRKVQHRLWRFFYAFFTHMRPIPPICRFYLSRRPGTRPIGAESDPCLV

SEQ ID NO: 5849 - protein, 362 aa, Chromobacterium substugae
MPIHSLSLSGFRSIRKLTLELDALNVVVGANGCGKSNLYKAIKLLHDAAEGRLSPALAQEGGAQKAMWAGGPRRGDRAGAPRRMALSAKLSDFDYELQLGYPEPSLSLFALDPLVKEESLWLAGQGRRPSTLLLERRNQAAFLTGIEGERNAYPAALRAEESIFGQLAEPHRYPELSQVRETLRNWRFYHEFAVWPGSPLRALQVGIRSPVLSHDGANLAAAYQTIVEIGDGELLGSILSEAFPDSRFQADAQHGRFQLLMRRDGLLRPLEAAELSDGTLRFLCLAVALLSPRPPAFMALNEPENSLHPALLPALARLIAEASRYSQLWVTSHSPQLAELIERRRPIKQFALALQDGETVLQ

SEQ ID NO: 5850 - protein, 360 aa, Chromobacterium substugae
MDAVRHILPDPRQYHPQVSLTNRLIHHAQSALDAADAGERDMWRQALVGAMDEMLQRGELLSISVALAMVPTQACYQLVWDALRQAVEETGGARAQVFAMPLVLVAGSRNEATLPGEIADVAGLNALLRQHGVFAADGDVAISGALLHPDSLVGLDAIRLHQLARQDGASARAGLPSQAAPITVKEEGVFLRYLMGVAAQRDGEASPLRQGGSVGAWGMPLMKFLGEQLKTEGVTLFPIARPPLPAMQALVAGNFARFEVALQVFASSQIRRLRELDKEPVAIVSAHENGELHFTLSAKGDERNWEAFVWPLASLDNVKLIEENFRELMAECHVREVHVMAELQPESRDGIPLFFTADDL

SEQ ID NO: 5851 - protein, 309 aa, Chromobacterium substugae
MKRLPDLEAWAIFAKVAECGAFARAAEELGLSQATVSKAVSRLEDRMKTVLLHRTSRQLSLTTAGDAALERAARILAEGEAVEADIAEQSRALRGPVRMAAPMSFGLSHLAPLLPDFMARHPEVELDLRFSDEQADLVAERMDLALRIASPADSSLLARRLCAVRILLVGAPSYFARHGKPEHPAQLARHRALQYSNAPGGRHWRFRHADEGEFSLEMHAPLRVNNADALAPALHSGLGLALQPEFLVWRDLQDGRLETAMPDWQVDPIALYILTPPGRGRPARVQALIDYLARRLADSPWARTPAAAD

SEQ ID NO: 5852 - protein, 233 aa, Chromobacterium substugae
MIERRPYASLGAAQHGWLDAKHHFSFAEYRDAERTRWGRLRVWNDDTIAAGTGFDPHPHADMEIITYVREGAISHEDSLGNRGRTEAGDVQVMSAGSGITHSEYNREAVATRIFQIWIYPDRHGGEPAWGNKPFPKADRSGAFVALASGMDGDADALPIRADARVLGATLKAGESAGYRFGAARRGYLVLSSGEAQVNGVALQAGDGAAIAGEALIEVSASRDAELILVDTRE

SEQ ID NO: 5853 - protein, 415 aa, Chromobacterium substugae
MFAADQTIAKFDPELAAAIAAECQRQEDHIELIASENYTSPAVMEAQGSQLTNKYAEGYPGKRFYGGCEHVDIVEQLAIDRVKQLFGAEYANVQPHSGSQANQAVYFSILKPGDTVMGMNLGHGGHLTHGSPANLSGKMFNIVAYGLNDKEEIDYDDMERVAMETKPKLIIGGASAYALRFDFERMGQIAKKVGAYFMVDMAHYAGLVAAGLYPNPVPHADFVTSTTHKTLRGPRGGIILAKAEFEKSINSNVFPTLQGGPLEHVIAAKAVAFKEALQPEFKEYQQQVLKNAAIMAKTLAERGLRIVSGRTESHVFLVDLRAKGLTGKQADALLGRAHITVNKNAIPNDPETPFVTSGIRIGSPAITTRGFKEAEAIEVANLVADVLDNPNDDALIARVAEKATALCHRFPVYAK

SEQ ID NO: 5854 - protein, 228 aa, Chromobacterium substugae
MQVFQRAVALALLALPAAAFAQSDDAQFAVGAGLGTTGYDLMASYKVLDNLNVRGTLSGLNYSRDGDYNTDTHYNGKFKLFQTGVLADYFPFGNSFRMSGGLALNQTKLGLQASAGSSTTYRLNGNTYYSNQVGDLDGEAKWNKPALYLGLGFGNSVKNKGLSLSGDFGVLLTGKPDTTLTASCTSALSAAQCQQLQNDVGVEQNKLRDDTNKLNFWPVARLTLNYAF

SEQ ID NO: 5855 - protein, 152 aa, Chromobacterium substugae
MKCAFCGNADTQVIDSRVSEDGASIRRRRRCPVCDKRFTTFETADVRMPQVVKTAGHRSEFDIEKVRTSFLRALHKRPVSTTLVDEAIDRICHKLLQLGEREVSSRQIGEMVMNELARLDKVAYVRFASVYRSFQDISEFTDAIKEIQKSAH

SEQ ID NO: 5856 - protein, 174 aa, Chromobacterium substugae
MGIREADPARDAPALFALMASSRPTLAQWLSSTVRPQSAADMAALLLAQARSNQEGRAAHRLIEVDSEVAGVCSLHGINLAHGYARLGYWLADHHVGKGTMGLALRLLLAYAFDELGLHRLELGCAPENLRSCRVAERLGFKLEGELRDAQFLNGRFWNMRCYGLLADEWKNRT

SEQ ID NO: 5857 - protein, 367 aa, Chromobacterium substugae
MTDYSADDHLHMQRALRLAEAATRRAAPNPGVGCVLVRDGRVIGEGATLAVGSDHAEIQAIKDCLARGDTPRGATAYVTLEPCSHHGRTPPCAERLVAEGVARVAAAMVDPYHEVAGRGIAMLRAAGIEASAGLMETEARRTHRGFLSRVERGRPWVTLKAAATLDGKTALLNGCSKWITGAQARLDVQRLRAENCAILTGSGTVLADDPQLTVREVPVAAQPWRVVLDGALKTDPASRIYQGGRTLLASCVSDAGRLAAYRERGVETLALAGCAGEADLGDLLRQLAARGVNQLMVEAGAGLNGALLRAGLVDEIVLYLAPSLAGDAARGLFAWPALTDLADKVRLDIVDFGKVGDDLRLILRPAA

SEQ ID NO: 5858 - protein, 226 aa, Chromobacterium substugae
MADVASALGAYLHLIDRLGAKAEVVEQRRALLLRLLKRLESQARNAEAYHAAVELFVADCPPRERVLAMTCGREFYCFWLDDMKKVVEITARNGFSLHNPQMLNVGTFDHLVAQMRQKRFRHFPPSLGLYLGKLFEDGHPEEGIRQRDILLKALLFLLSPHPFHSTSYRMAVDALLLHLQDRAERQLLLPAVREYFPYWQAFPFARQRAQAEREAGGEPGAAQDKA

SEQ ID NO: 5859 - protein, 495 aa, Chromobacterium substugae
MGNQTAYQSLTQTFQRLHRFGHLSAIASWDQAAMMPAKGNEARAAAQAELQVLMHQLITAPELKTQLDAAAQEELDAAQRANLREIGREWRQANLLPAALVEAKALAAARCEHAWRSQRKNNDWQGFLPNFREVLRLAREEATLLAEATGVSRYDALLDKYEPGMTSANLERIFGDVKTWLPGLIAQVRDKQSGERVIQPQGPFPVEKQRQLGLEAMGLLGFDFDGGRLDVSSHPFCGGVPEDVRITTRYRDDDFVQSLMGIVHETGHARYEQGLPRDWLPQPVGRARSMGIHESQSLSFEMQLGRSRGFLQLIAPLIRKHFGDQPAFDADNLARLYTRVQPGYIRVDADELCYPAHVILRFEIERALIDGEIEAEDVPALWDEKMMAYLGVDTRGNYRDGCLQDIHWTDTFGYFPSYTLGAMYAAQYFSVLRKQTPDLDSRIAKGDLAPVFDWLNANIWSQGSRWSTDELVARATGEALNPAHYRAHLEARYLG

SEQ ID NO: 5860 - protein, 288 aa, Chromobacterium substugae
MKPSRSQYLTLNQRRCHIRRWGPEQAPLLVLLHGWMDSSATFQFMVDALAGDWQVAAPDWRGFGDSQWNDGSYYFPDYLADLDDLLRQLSPQQPVNLLGHSMGAMIAGIYAGVCPQRIHRLVLAEGFGLGATRPAEAPGRYGRWLRETSQAMAFEPMEPAQAADKLMARNPLLTGERARWLAAELTRPADGGVIYRADPRHKMVNPVLYRLEEAMACWRRIAAPTLWLLGERSFEHPAISGVMDTLDQRRSCFAHLDEVKIAGAGHMLQWEKPEQMAAEVERFLLRGE

SEQ ID NO: 5861 - protein, 175 aa, Chromobacterium substugae
MKQIVTAALIGLGLYSTGAMAADGTITVNGNVVAQTCTVSGNGASANVTVTLPTVGASALASQGQTAGATPFTIRLSSCPSGLNNAQTRFEVGPNVNSVSGNLLNAVGKTYASNVEVQLLNNSFTAINLNNNANSQIVSINNGSATMNYYAQYYATGAATAGSVNSSVQYSMTYQ

SEQ ID NO: 5862 - protein, 249 aa, Chromobacterium substugae
MKQAVRRAALALMLAGAALSGAAQAGVVISGTRVVYKADDREVTVKVNNPGKEPSLVQVWADSGNEKSVPDTADAPFLIMPPIFRVDPTKGQTLRLTFTGADLPKDKESVFWLNVLDVPPLPKLTAEQRNFMQVAFRSRIKLFYRPAGLAGTPDDAADKLSWTLLPQAGGKGYTLRATNPAAYHVSLNRAILLSGKHEFDTDGGMVPPGGSKDFALKDAKFKPEGGLKLNYESINDYGAPVMHSAPLAP

SEQ ID NO: 5863 - protein, 858 aa, Chromobacterium substugae
MKHLTTRRHDRRWALSPLSLLICGLFGGQAAWADAPAAASAPADDVQFNPVFINQNSNGQKVDLSRFNQTGGALPGNYRADVYVNDVWLGRRDVLMKEMAERKVLACFNRAMLDELGVDFARLGETAELPGRDEPGRCADIAAVVPGARSSFNSTDLRLDVSLPQKYLRAQARGYVAPEYWDAGAPLAGFLNYNANGYRYDNGASGKSTQFYFGANAGLNVGLWRLRYDGALTQQNSGNGQSQRNYQHASTYVQRDITGWRSVLTVGDYFTPSDLFGSVAFRGVQLSSDDRMQPESLQGYAPVVRGVAETNAKVSIRQNGNLIYENAVPPGEFSIDDLYNTGFAGDLEVTVAEADGRVRKFVVPYAAVPQLLRDGQSRYAVMAGQWRGASLSKLPVFAQATYQRGISNGLTLYGGLIAADHYQSALFGSGINTPLGALALDVTQSWASGLPYGGADSDMQGQSYRVTYSKLIESTRTNFTVAAYRFSTAGFLELGDYVNLINQQGAVFRAKNKFQLNADQALAKGWGHIFMAGSSQDYWNQQGRDLTYQLGYGNSFQSVSFNLSAGRTHDASGRNINQYMLSVSMPLGREPYAPLLSASASSSSDRSASGQLSLSGSAGELRNLSYNLYANTSRNSAGGNSSGGGGSVQYASSIATLTAGASSGGGSSQANVGLSGALVFHPGGVTAAQSLGESFAVVEAPGAEGAAVSNTSGVRVNSRGYAVVSSLMPYRQNEITLDPKGMSQDVELQETSVQDAPRAGAIVMLKFNTQQGKPVIVTLRRADGSHLPVGATIAADGGEDARAMVGQGGRAFLRGLEGKPLVARWGGEPDQRCHFRYALPQATGGAAYLQMDAVCAPQ

SEQ ID NO: 5864 - protein, 335 aa, Chromobacterium substugae
MIFNRGGIARRETMTMKKWITQGLRGWLLALCLAMPLTSHALGCWNGDDGSGGVTSTFNLPGNLYVAANAPAGTIIWQSPLQNLKLYCTQSIGENVYFWVNPQSQALAPGLQIGILFKGRTYTQSSGAIDTGIYVPWNGWINTTLQYSIVLLKTSGAPSSGTATVSQYSVFQLDGIGGINATPNINFNQLINGTVTFTPGGTCNLSANGQYTVNLPTVGSGQFAAVGSAAARTGFTIRATDCSDGVKTATFRFSGAQDKNNAVLFANSGSARGVAINLGSSDDGANIGANKTNNTRVVNVQSKSAQLGLFVEYMRTAAIVPGSLQTAITIDMLYQ

SEQ ID NO: 5865 - protein, 100 aa, Chromobacterium substugae
MKKVIITLAALAALQSGLALASDGGTVYFNGSIVKEPCAEAGSTLLSYATNPRQYQAARKIASGNACSGMDSTQSLSVSSVNMAGATASASGQLVTIVYN

SEQ ID NO: 5866 - protein, 538 aa, Chromobacterium substugae
MSNSIASSAAGAAGISRAERKVILASSLGTVFEWYDFFLYGAMAAIIGKQFFTGVNETTAFIFALLTFAAGFLVRPFGALVFGRLGDMVGRKYTFLATIVIMGLSTFLVGVLPGYSTLGIAAPLILVSLRMLQGLAIGGEYGGAAIYVAEHAPDHKRGGYTSWIQTTAGAGLLLSLLVILACRKLTGDAFNDWGWRLPFLLSIFLLAISTWIRLSMQESPAFLKMKAEGKHSKAPISEAFGNWSNLKIVLISLFGFNGGQAVTFYCAQFYSLFFLTQILKVDPQTANLMLIASLIVTTPLFLYFGHLSDRVGRKPVLIAGLVLGLILTFPAFRWLTDYANPDVAAAQASAPVTVVADPASCHFQFDPIGKAKLNTPCDQAKTLLAKNGVPYQQQAAAAGVTEIHIGATVLQGFDKKALQDGLKQAGYPEKADPAKINHLMVILVLVLLSVISALTYGPLAAMMVELFPTRIRYTSMSLPYHLGNGWIGGLMPTVAFSLVVYTGDILYGLWYPIIVYGVSLVVSLLFLRETFRNDIHKH

SEQ ID NO: 5867 - protein, 550 aa, Chromobacterium substugae
MLSGEFDYIIVGAGSAGCLLANRLSADADKRLLLLEAGGNDDYPWIHIPVGYLYCIGNPRTDWCYQTAAESGLGGRALGYPRGKVLGGSSSINGMIYMRGQAADYDHWEALGNPGWGWRDALPHFIAMEDHFDPARPLHGHGGEWRVDKQRLSWEILDAFRAAAAEQGIAPVDDFNRGDNAGCGYFEVNQKNGRRWSSARAFLHPVRHRPNLTVLTGAEAESLVVERQRARAISFLQQGQRLQARCRGEIILAAGAIGSPLLLQRSGIGPARLLAECGIAPRHILPGVGANLQDHLQLRLVFQIAGAPTLNQRAASWRGKLAMAWEYLWRRSGPMAMAPSQLGAFARSAPDVRWPDLEYHVQPLSLERFGQPLHPFPAFTASVCQLRPHSRGHVELGGAPLDAPPLIQPNYLSHPEDQRAAAAAIRLTRRIAASPALSRYLPAEYRPGLRYQTEDELVEAAGQIGTTIFHPVGTCKMGNDPLAVVDARLRVRGIAGLRVADASIMPTITSGNTNSPTLMIAAKAAQMIAQDNKQPGAFATPATPAKETSA

SEQ ID NO: 5868 - protein, 307 aa, Chromobacterium substugae
MFDWNDVRYFLALQRSGKLLGAARQLGTTHATVARHIAALEAVLGQPLFIQQADGYTLTAAGRQLLPLAEALENTASQMLDSGCKGHAEVSGVVRVGAPEGLGALFLARHMPALMARYPGLEIDLVAVPRFVSITSREVDIAIALERPQANLVVTRKLTNYCLGLYATPGYLAGHPPIAEREDLNGHAILAYVDDLLFTRELMYHHGLCRHPRMPLRNTSVVAQKEAALAGGGIAVLPYYMVYDDARLVQVLPELRIVRSYWISARSNIRRTLRYRVVWDYVVDLCQRMQWLLLQQPTQQNESIDAG

SEQ ID NO: 5869 - protein, 285 aa, Chromobacterium substugae
MRTLYRNGGPDSPYLWRMLRALDYLWRHLDGPLPLERLAEEACLSPFHFHRVYRGLMAETVGETRQRLLLHRAAGQLDGGSLPLSKVAARAGYGGTAAFVRAFARAYGESPGRYRQRRAFISRQDWETVMHEVTLLKQDKGLTVLMRRHAGSYMEIGQAFGALQAISPACAVGDAPGRAFGIYLDDPEQTEEAKLRAIACVTVPDAWQGGRCGFEWGEIPAGEYACVTHQGPYAELSTAWSWLYRHWLPGSGRAPGGVPCVEEYLNSPYDNPPTALRTRLMLSLA

SEQ ID NO: 5870 - protein, 487 aa, Chromobacterium substugae
MRIIEKAYTFDDVLLVPAHSEVLPRDVTLTTQFTRNITLKLPLVSAAMDTVTEARLAIAMAQEGGIGIVHKNMNAEKQAAEVSKVKRHESGVVKDPITIAPDMLVRDLVLLTRQYKISGLPVIEAGKVVGIVTNRDLRFETRLDQTVGSIMTPRERLITVKEGASIDEARELMHTHRLERVLVINDAWELKGLITVKDIIKTSEHPNANKDSQGRLRVGAAVGTGADTEARVAALVAAGVDVIVVDTAHGHSQGVLDRVRWVKQTYPQVDVIGGNIATAQAALDLVKAGADGVKVGIGPGSICTTRIVAGVGVPQLTAIHNVSEALKGTGVPMIADGGIRFSGDIAKALAAGGNAVMLGGMFAGTEEAPGEVELFQGRSYKSYRGMGSLGAMSQGSADRYFQDSSNAADKFVPEGIEGRVPYKGPIGQVIHQLVGGLRSSMGYLGCPTIADLHEKAQFVEITSAGIRESHVHDVQITKEAPNYHVDR

SEQ ID NO: 5871 - protein, 39 aa, Chromobacterium substugae
MRRTAKRARRFALFARRWARPYNRRHRDQAWGCQSCSHL

SEQ ID NO: 5872 - protein, 143 aa, Chromobacterium substugae
MQSSIVWTFLLALLLPGAAAAEVYTWTDANGKTVYSDQPPPHVNARKLNVRAQRPAGASAPKAEKKADSKPAANKQVASDNAAVAAANAKVKAQNCSAAQANLATLQQNGRIRMPGSTALATDAQRNELIRQAQKDVQTWCNK

SEQ ID NO: 5873 - protein, 601 aa, Chromobacterium substugae
MSKPEFDYQNVLQNLPALPGVYRMLDAEGKVLYVGKAIDLKRRVSSYFQKNDLSPRIRLMVRQIASIETTVTRSEAEALILENNLIKALAPRYNILFRDDKSYPYLMLSGHDFPQMAYYRGEPKKPSQYFGPYPNGYAVRESIQILQKVFRLRTCEDAVFANRSRPCLLYQIKRCSGPCVEHISRDEYAADVASAVAFLSGRQSELIEELNRRMMAAADSMEFEQAAELRDQIQALSRVQEKQFVSSNQSQQDCDVVAAVLKDGMPCVNLVMVRGGRHLGDKSHFPVGGEADTAQEILEAFLAQHYLTAGVPPALLVNGQLSDALHEFLQQQAGRKLAIASNPIGERRVWLEMAEKNAELAILQRQGSKATQTQRLAKLNEALELDDAGRFECFDISHTMGEATVASCVVYDKGAMQPSEYRRFNITTAKPGDDYAAMREVLSRRYGKLADGEGKLPDAVFIDGGKGQVGVALEVLAELGLALPIVGIAKGEERKPGLETLILPYLEKTLQLRQDHPALHLIQTVRDEAHRFAITGHRARRAKARTASTLEEIPGIGAKRRQQLLMRFGGLRGVAAANVDDLCQVEGISRTLAEKIYNALH

SEQ ID NO: 5874 - protein, 193 aa, Chromobacterium substugae
MPFNLPIFLTWLRVALIPICVAVFFLPDSILLLHSRNVVGAGIFALAAATDWLDGYLARKLGQTSAFGAFLDPVADKLIVAAALILLVQLGRTEGWMAMIIIGREITISALREWMAGMGTRGSVAVAYIGKLKTAAQMLAITLLLYDGALIPGLNARIAGNFSMYIAVILTLWSMVYYLRMAAKEFAGKKIDV

SEQ ID NO: 5875 - protein, 370 aa, Chromobacterium substugae
MPKPVSFTFDSEAEGDAYCARLEALLDRGIIPADLVDERPAIATIRDALRMYQASVALVDSDKQVQAALVDKVGEVLMRNVCYTWAESWVRDMKQVEKLAPSTIRIYVGSLARCFDYLTRLPDSTFVTNPLRLLPKRYATYTDADAAVLRASAKEGEAVEVPTNTERDRRLLEAEEAAIRRILDGCKPDGKQRPLACAWRGALELMLELALETAMRMREIYTLTLDQIDMERRTIFLDKTKNGDKRQVPLSSVALAALVRYREQVAAGERDMSGWNHEGDRLLPWWSGANSPDVLRKTTALLSRQYARIFEAAGCGDLRFHDLRHEATCRFFLKTKLSDLQIAKITGHKDPRMLARYANLRGSELADQLW

SEQ ID NO: 5876 - protein, 108 aa, Chromobacterium substugae
MTNDTMTLDDAATALNIGTETARQLADAGVLPGCKIGQGWVFLRDDVLTYLRDEIRRQTNARRAMADAVRTEGQSRKTERVKTAAGAAGVRSARRREHPNLDLVEKAA

SEQ ID NO: 5877 - protein, 126 aa, Chromobacterium substugae
MNTAAMEVQTNLYTRLMMAANGRYRAELDAVNSQLRNIERAERMARRLRDVEMNAEAQAGAGYVPFIVLRLSIEVMPMQHYALALAGNALERQLVPNGRDAQGRERFQILAAGDERTSLELVVEGI

SEQ ID NO: 5878 - protein, 62 aa, Chromobacterium substugae
MKSERTSSAVVVCRFLQDGELELARSALTKHFEPAEQRYSELVARMSELALKKNTNEQEQPR

SEQ ID NO: 5879 - protein, 751 aa, Chromobacterium substugae
MTWQSRLPLLDRFPRHLSRAIGREWCERRGRPLALLPWQDDVRQREADQWLRDLTAFMPRHALPLGACEMELVEFAKQRAFEADQLIGRGANIEQLEKYCARYGVAPPSGKTKAGRAARVACSLWWRRALRRTNARHSEHLSIQLGLVHRRHGLYASHDAIARRREQKRRNRGLLEAMAAINELGQEYTLQQLSELSVSNPTIRRAELMVRIAGFEHIAVGLEYAGEFITITSPSKYHPRHAKSGRRNAKYAGKTPIDTRDYLGGVWSRITAAMARAGIAPFGFRVAEPHHDGTPHLHALLFMAKDKVKKFRAIVARYAVREDRAELGLNYLQTKGEAMAAARQLRAAGAKGLLADIAARIGNEADFWANPPRWVWKGIKARVAFEAIDWKRGTAAGYIAKYIAKNVDGAKHNGDSVGIDFEAQDHAGQAGKDDGASKDQSAATDATVTARRVDAWASTWGIRQFQQVGGPPVGVWRELRRWDYQAADAEDVLMHAAIAADTGNWGRFVHLMGGHAIKRAAMPLGVARDSEPAENRYGEDGQRQVRGVVERESGQFAQTRVHEWRIGRKADGVEGGAAAPWTRVNNSTFLEVPPAAPAQPEWMFGTADRIQANVEDDDSELLTAEQLAARREWDAHQRYLRAFPEFVHEWAKRGIEAAELDAQRQREASIERVRLQRANSRLAANLGLTHRAGIAVISQVRAQAEAARAERAARPARASSTERHGPGITVSQQLAQATARARQWINQAGRI

SEQ ID NO: 5880 - protein, 152 aa, Chromobacterium substugae
MEARENYEYGEDFARHVMPALGDLCRAPLAPVAPRDIAMQALARMDERQAQARRPMLESVESLQAKVLNAIRKDALAQIQDAIQTLAETEAKINQLIAMHGLGLRALFMQQPGRMWYDIETMLDESNLAEVRLARGGLPLHAEPQAVRGQAA

SEQ ID NO: 5881 - protein, 71 aa, Chromobacterium substugae
MQQPAAAPQQLAALRVRKMRYVRFSNGAACYSAGYAAGRLRQFSSRREWLEYLGAALFMLSLILLQLYLPA

SEQ ID NO: 5882 - protein, 140 aa, Chromobacterium substugae
MCKAMPGGWAAMAAALGFSKDGLENRVYERKGQAVSVHEAMQMQAFSGSSIFAEAVAADSGGVFVPLPDIDTVDDAEIQRVYMELVDEVGCLAREWREATRDGEVDKRERQRLEAIRDAICAKVTQMNHLTFQVFCNKGV

SEQ ID NO: 5883 - protein, 40 aa, Chromobacterium substugae
MLEMTESNLGRELVDVALPIFLAQHGLTAWAEDTLKALTA

SEQ ID NO: 5884 - protein, 107 aa, Chromobacterium substugae
MTLEAIGDPSDLSRYTLMFGVPNDDQAAVLENAVYAAGILANTFPQWNGKKDNAIDWFTGAMRKLTRNVEKNRSEPKPITLTREGKQVKISAIPSMGMVFLSVDPLE

SEQ ID NO: 5885 - protein, 134 aa, Chromobacterium substugae
MLFPIAIEPGDADHAYGVTVPDLPGCFSAGDSIDEAIRNAREAIDFHLEGLDEDGADIPTASQVADHVGLPEFQGYIWAVVEVDIVRYLGKATKVNVTLPSNLIRRIDAFVETHTEYESRSGFLARAALNELRA

SEQ ID NO: 5886 - protein, 169 aa, Chromobacterium substugae
MDEYKILLESGGREEELATVRDPLIAAAAFRALLLRGDLRASRPLAILERNGRTLYEIPVDGRADAAAAALDLPQAALADVRQALLAAGVDAEALELGRAQLNDVYKGLLREVRDSELAGVLRRVGLPVSNSQILGWRVSPENRKFRPIAMGELYAVAVALGELRNGSA

SEQ ID NO: 5887 - protein, 234 aa, Chromobacterium substugae
MQYQIQFTASQTNHDMGDDAAQSFTTLAKAEQYAAELTEALRELVRDWSSDAGREPNYDDIRVEIVRQVFVDGVEVEDQDDQDIILALIAAAERAHPAVRWNSCHSAGGEGRARGWRLLICPRGTWEPVALARLESEAMFQFFHAQGLEYPCKVSRRLGSMQERQAREVAARNALLPVRQAAFQAARAVDELRRQLEIAESRLLDARRLQSEMEDRLAARLAAIAASSWSLPAM

SEQ ID NO: 5888 - protein, 414 aa, Chromobacterium substugae
MSLFDDAADVAGAAGDMLQQGADQLDNLAGQLGDAVGGLADSATNALGLSQPKRPACQLLLAGRDITAKLEPLLMSLTLTDNRGFEADQLDIVLDDSGGQLDIPERGVTISLAIGWTGAALVDKGSYIVDEVEHTGAPDTLTLRARATDLRAGIATKREKSWHKTTLGAIVKAIAKANGLTPAIPTWLARQKVEHIDQTSESDANLLTRLAKQYDAVATVKSGRLVFCKAGDAETVTGHPFPACLILRQSGDNHRFSVADRNAYTAVKAYWHDTRGAKKGEVIVNKDTKFERRATVTKLGRKSKRTKLTAIQAKGIEPSSENIKVLRHVYVSEATATQGAKAAWQKLQRGVAEFSITLAEGRPELFPELPAQVQGFKPVIDATGWVLKKVTHQLGDGGYTTALELEARLEDMAG

SEQ ID NO: 5889 - protein, 152 aa, Chromobacterium substugae
MLNIGPVKMPMMALGLFVFMMDTLPYQDFKQKYAWRWPANGRVGRRPAYQFLGADEETISLSGRLLPELTGGDTSLALLKLMADQGKAWPLIEGTGAIYGFYVVESLDITRQDFFSDGKARALDFTLALKRVDDSLLDSLGALARGVLELAL

SEQ ID NO: 5890 - protein, 956 aa, Chromobacterium substugae
MNSQLKLEVILAAVDKLTRPLKQAMAGNKELARAVKENRDQLKQLQATQNSIDAFRKLTKESKDTGQALQGAKQRLEDVRRQMEQAGGASLKLSREYAAAERAVDKLTLAHRKRLDAARAASGALQKEGIDTRQLSATETALAARIQETNRALGARQAKLDAVAKRQRQLNDAQQRYGRHLAIRDKVAGAGVKAAAGGAAIGGAMSLPVMAYAEAEDAATQLKGAMMRAGGVVPPEFEQINNLAQKLGDRLPGTTADFQNMMTMLQRQGMSAQAVLGGLGEAAAYLGVQLKMTPEAAAEFTAKLQDATRTSEKDMMGLVDMIQRGFYAGVDPDNMLEAYKGLGAAMDMVKVKGLAGAKAFAPFVVMMDQAGMRGESAGNAIRKVIAASLSVDKIKKVQKELRKKKGIALDLDFTNGKGEFGGLDKMMAKLSQLKKLNTVNRIAVLQDIFGTDKETSEVLSKIIEKGKDGYQDVVQNLAAQASLQARVNQQLGTLKNLWDAASGTFTNAMVRFGEAIGPEMKAAAEWIGTLSEKLGAWAKENPELASAIMKTIAITGLLLAGLGALALAAAAVMGPFAMLGLVMSKASIVMGSLGGVFGLLRGALSLLGGGLGMLGKVFMWVGRVFLMNPIGLVVTAIAAAAYLIWKNWDWIGPKFAALWEGVKAVFSTVCGWITGYLMNWTPVGFIVRHWEDICKITAALWDKLKGIIVAAAGVITDWFLNWTPAGRVIKHWDVIQSATQVAWDWISAKATGAGKVIADWFLNWTLPGLVIKHWDTITGFLGGMGARLAELGRMAIDGLIGGVMSRLTALRDTLGGIGDTMVSALKSALDIHSPSRVMAQLGGYTMAGLEQGIDKGQAGPLASMRDTAKRLTAAGAGIALTAGPALAGSLDNRPPLSARAPAMAAPAPAITINIHAAPGMNEQQLAALVQRQVAQALATSASQQAARRRSYLGDID

SEQ ID NO: 5891 - protein, 98 aa, Chromobacterium substugae
MNENTIKLDAPIQRGETLIDTIELRRPGAGELRGLKLADVLQMDVDAAIKLLPRLSMPALTEEEAKRLDPADLLQCATVVAGFLLKKSELQASPSPAA

SEQ ID NO: 5892 - protein, 170 aa, Chromobacterium substugae
MAALPRTLRKFNLFNDGMSFIAECLSVKLPALKMKTEDYSGAGMIGPVALLRGVEKLELEHTYNGPIPEIIATFGADKHDAAKLRWMGSYANEATGESHAVEIVAAGRHNDLDPGDAKAGENGEFKVKTDLTYLKWIMDGKELIEIDIVNDVFKVAGQDRMAQHRANVGL

SEQ ID NO: 5893 - protein, 389 aa, Chromobacterium substugae
MKDFHHGVRVVEATAGTRTIRTISTAVIGMVCTADDADADAFPLDTAVLLTDLKAAIGKAGSKGTLRRALTAIDANARPLVVVVRVKTGKDEAEQSALTIGTTTPAGQYTGLRALLTAQQRVAVRPRILVAPGLDSLPVATEMAAIAAKLRAFAYVYAWGCKTKEDVAAYRANFGQRELMLIWPQFLAFDSAAAADAIVPVTACAAGLRAALDESIGWHKTLSNALVQGVTGISQDVYWDLQEPATDAGYLNEKAITTLIRRDGFRFWGNRTCSADPLFAFESYTRTAQVLADTIAESHMWAMDQPMTPVLVRDILDGINAKGRDLVTRGYLLGFSAWLPADLNSKDTLKDGQLRISYKYTPVPPLENLQFQQEITDEYLMDFAAKAAA

SEQ ID NO: 5894 - protein, 65 aa, Chromobacterium substugae
MHSRDDAHILNPLIGQDPRETLENLCVCLAHLGQTLASHHEDPSIHFIATSAAAALRFEAGQIAA

SEQ ID NO: 5895 - protein, 205 aa, Chromobacterium substugae
MADKKIVYCYSADTGEYVGQTTAQRSPLELEEEVYLVPAWAAADAPPPAASRQAAAWRTDDGRIPAHCILGGGWQLLPDWRAVPLWDTATAQPIAAQLGDTPQALGATELAPPPFGVWDGASWRVDHAAALAAQRAAAESDIAARRGQADAAIVPLQDAADLAIATPAESERLAAWRRYRVELSRVPLQPDYPATITWPPAPAAQ

SEQ ID NO: 5896 - protein, 526 aa, Chromobacterium substugae
MADLKEPAEPKFPPVYQLELTDRVRAGAGGISNRQAEQLVERTGFLKKRIDDLVSGALAAKSAERADRLASPRNLAMTGDGAWSVTFDGSGNASGALTLANTGVGAGSYGMVTVDAKGRVIAGRQMAAADVPALDWGKITGRPSTMEGYGITDTAWRDPAKRVWGAAFRANKGDPADLGGDTATAGFAFDEDGDTGLFAAQSSRPGSGSSKLMLKIDNIEALAVGASGEIYSKKYGWLHEKFAAASVVSDQAGQVANKADKATTLAGYGITDALPLQADIAAPVDLDTLIASGIYHNPANDNASKGKNWPCPQAGQLTVRAAGEMVYHTYQAFADGGFWHRCRYQGRWNPWRRLADAAAIQDGIAAATPPGQIAYFARDTPPPGWLICAGAQDVSRTAYAALFAAIGDRFGAGDGRTTFGVPDLRGEFVRGWDAGRNVDASRVFGSGQASQNLWHDHAIPTPGSTTGGDTVRTDNGGTGLDAGARHTSNEFLTEFGTGRQLRYATYGSGGSESRPRNIALLACIKI

SEQ ID NO: 5897 - protein, 186 aa, Chromobacterium substugae
MSRQLLPPNRTPLEAALADMLALDLNTTALRGLADSARCPPALLPWLAWERSVEQFDAARTEEERRALVASSVDVHRRKGTLSAVRQVFRDLGLGEVQIDEGTGGYRYDNTVAYDGFASYGDPDGWAEYRVRIDKLLSVEQAAAARALLADIAPARCLLWGLDFGGAELIYNDMAAYDGGYTFGVA

SEQ ID NO: 5898 - protein, 296 aa, Chromobacterium substugae
MTIDLAALPPPAVIEPLDYETLFEQKKAKLLAAVPADMRAAIAAALQLDSEPVTMLSQLAAYIELTARQRINDAAKASMLAYAEKSDLDHRAADYGVRRLLVRPADPTTTPPTSAEWETDARLRYRAQMALEGLAAGGPRGAYRFHALSASADVADVDIDSPAPGQVRVWLLGRDGMASQALLDTVAAALNAETIRPLCDTVTTAAATPLAFDIRADITYQPGGEALSGGAAGAAQRLAKMLAARRRIGGGVPRSAIDAALHVDGVERVAIVSPAADVLGQVGRYPDCASIMVTPA

SEQ ID NO: 5899 - protein, 118 aa, Chromobacterium substugae
MSSYTGMNPQTGHAISDADHIRQSIARILTTPRGSRIQRREFGSLLPELMDQPLNGRTRMQAMAASVMAVAAWEPRIELSAIRLMVGQGDAAGALTIHIAGRRRDSGKPLAYDIPIRS

SEQ ID NO: 5900 - protein, 223 aa, Chromobacterium substugae
MDDIADLIRRIESLIRYGTIAEVDHDARRVRVKSGELASNWLPWSVGRAGETREWNPPTVGEQVVLLCPSGDPAGGFALLAIYSDQFDAPSSSPDEHLRVYPDGARILYNHATGALSVTGVQTAQVQAAQRVTVDCPESLFTGNVTINGRLIVLGDVLAKAKATIAGLFSYLAGMAGSGGAGGASTTISGTITHSGGALSSNGVTLHSHTHPDPHGGNVGKPQ

SEQ ID NO: 5901 - protein, 164 aa, Chromobacterium substugae
MEWLTECHRVLKDGHLIAVFIDWRQLPTLTDAMQMAGFIWQGVAAWDKTNGGARPRQGGMKQQAEFIVWASKGKMRKADIYLPGVFQGRKPTKTYHITAKPVAVMEELCKLAGNGGHVLDPFAGGGATLVAARNLGLSATGCELEPDIYHQAQLALEDGQPLAA

SEQ ID NO: 5902 - protein, 148 aa, Chromobacterium substugae
MSLARLDAELGALIHQLDTGARRSLAREIGHALRQSQQKRIAAQQNPDGSGFAPRRPQYREQKGRIRSQMFTKLRGARWLKIEASVGGVEVGFLRQVERIARVHQYGLRDRISRHTTREAQYPARELLGLSQPDFELIHSKVLDHLAK

SEQ ID NO: 5903 - protein, 152 aa, Chromobacterium substugae
MNKPADLRRAIEAALPELRDNPDRLIMLVEDGGIVTAPGRLNFGYRYKLKITVIDFAGHLDQLIIPLRAWIEQNEPPLMQNPEALERGFRFAVEWISATTVDVQFTLQLSEGVRVEVGEDGNITATHYGEPPAPWEGDAMAGRLVIVAEAQP

SEQ ID NO: 5904 - protein, 68 aa, Chromobacterium substugae
MTDFYDRAQALEQRQRDEALARQFANLAHGASLSHCEDCAEPIPEARQRIVAGCTRCVQCQEDHEQAR

SEQ ID NO: 5905 - protein, 170 aa, Chromobacterium substugae
MIADALLTFARRVLAVVLIAATLLAGFALWQQHALLQRQAADLVAAQRDAATLAERNRAQGEQLAAQDIDIKLQIAAGRELAGQLSALSRQHAAAAAKLEAAIHATPDAVAWGSAAIPGPVARLFDTTGRAAAPAADPALPDGDGLRAAGAGADDQPTAGQQLATTPGGA

SEQ ID NO: 5906 - protein, 263 aa, Chromobacterium substugae
MDLMKKGAHGLEVQALQQRLVAVGAKLAVDGWYGDATEAAVASFQRRAGLVVDGIAGGKTLAALAGQVGPRRQLGEADLQEAAERLGVEVAAVKAINAVESRGSGFLSDGRPVILLERHVAYQRAGKQADSLAAQYPAVCNKARGGYAGGAAEWARFASLAIMGGEQLAIESCSWGAFQLMGYHWQRLGYASAAEWRLAMESGEPAQLDAFVRFILAEPALLKALQAKRWADVARLYNGPAYRENLYDAKLAAAYARAERLAA

SEQ ID NO: 5907 - protein, 88 aa, Chromobacterium substugae
MLLAFQRGPSQHRPWASLLAYLLTVAAGAVAVLRLFGRPELAELPQLFINLALLLALIAQRGNVVELYRNAGPRQSRLAILLRKARWI

SEQ ID NO: 5908 - protein, 122 aa, Chromobacterium substugae
MAEPVSSTATSATLATIAGLALTPGIDAAVVLGAFAGAAVFVLSSDSLSLAKKAGFFVASFIAGCLAAVSVAGVLARWLIADISPGVCAMLAAALAVKLLQWLIKSADDPAAALRNLKGGGK

SEQ ID NO: 5909 - protein, 71 aa, Chromobacterium substugae
MRAVRAIQGDTVDAIAWRVYGQTRGMVERLLQHNPGLADLGVVLPSGTLVQLPDLPAAAPATAKTLINLWD

SEQ ID NO: 5910 - protein, 160 aa, Chromobacterium substugae
MQINSVNTVNASPTNAPAPGDGPAIQTSRFWPDVEPGHFRAAMRYDGTVTAVRLRHALVEAVAAVNGELFGWRVASGAQRLADIEAEQIDGESILVQRWRRAIYATAAADLAERYRSFDATGAGRQRADDLDDTADQLRADARAAIRAILGAGRVTVELI

SEQ ID NO: 5911 - protein, 224 aa, Chromobacterium substugae
MSYARAHFQRASAAKASALAVEDGPINCTAYELMLVKLAEDKRRLKQVQSMEGKAAVKREVLPDYAPWVDGALQGGKGQPDDVLMTVLMWRIDAGDYNGALDIAEYALPHGLPLPDQFSRTTATAVAEEIADAAKRARDGKQPFELQTLTYTSELTDKHDMPDPVRAKLLKETGLAMAEAEPAAALEHLRRAQQLHGAVGVKKDIERIERTIKNSAPPPTSGQA

SEQ ID NO: 5912 - protein, 344 aa, Chromobacterium substugae
MKTDTRNVFTQLLEQIAKLNGVSAAAVEKSFSVQPTIQQKLETRIQESSEFLSRININGVDELEGEKLGLGIFGTVAGRTKVTPTNPRRPRNLGDLNSHKYRCEFTEFDTAIPFVQLDAWAKFPDFQTKLRDVIVKQQALDRMMIGFNGVSVAEQTNREKFPLLQDVNKGWLQQYREHAPERVMAEVKKGSGKVMIGAKEKGGDYANLDALVMDAVAGLIDPAMAGNPDLVVVLGRDLLHDKYFPIVNQDNKPSEQMAADVVISQKRVGGLPPVSVPYFPAGAMLITPLSNLSIYYQSGSRRRHLREEPDYNQVANYESNNEAYVVERYEAGCLVENIEMVNAA

SEQ ID NO: 5913 - protein, 270 aa, Chromobacterium substugae
MASKAKKFRVATEGATTDGRNIERSWIEQMAKNYDPKKYGARVNMEHIKGYTPDSPFKRYGDVLALSAEKVEDDKLALFAVIDPTDDLVKMTNDDRQKVYSSIEINPKFADTGEAYLVGLAVTDDPASLGCDMLKFSATAKSNPLAKRKFDPDNLFSEAIEFTLELEDDNAGALAGFSDKIKGLLGKFSSRQTADTAELSAAVQTIAESQAGVLEQFSGLPTAAEFKKLGEQYGQLKTDHDALVAKLSSESATAPRSAATGAAAEVVTDC

SEQ ID NO: 5914 - protein, 588 aa, Chromobacterium substugae
MDTQTLISELDLDPRRLARALYWQGWRIARIAEHVGARPATVHSWKRRDAWDDSDPADRIASTIETRMQQLILKKDKEGKDFKEIDLLGRQVERLARVGKYSQTGKESDLNPNIANRNAKPKRQPERNPITDEHKAQLVAAFLDGMFDYQKHWYRAGQQERIRDILKSRQIGATYYFAHEALITALETGRNQIFLSASKAQAFQFRSYICDFVKDVTGVELKGEVIKLPNGAELSFLGTNSRTAQGRHGDLYVDEYFWIPRFLELRKLASGMASQKMYRQTYFSTPSAMSHEGYKVWTGEHFNRGRPKAEHIKLDVSHQALAGGVRGPDGRWRQIVTIMDALAGGCDRFDLDQLRPEYSPEEFLQLFMCQFIDDGASVFSFAALQRAMVDAWEVWDDFKPFAARPFGHRPVWLGYDPSHTGDSAALVVLAPPAVPGGKFRILERAQFKGMDFAKQADFIRQQTQRYNVEYIGIDTSGLGTGVYQLVKQFRPDAVAISYSVEVKTRLVLKALDVINSGRLEYDASHNDIAAAFLSIKKTSTPSGRGVTFAAGRSEETSHADLAWATMHALAHEPLEGATSTNTSFMEIF

SEQ ID NO: 5915 - protein, 354 aa, Chromobacterium substugae
MGKPRRSHNHSQTPAAPAAPSAPASTPLAFSFGEPVPVLDRREIMDLLQCVDNGRWYEPPVSWDGLARSLRANVHHASALMVKRNVLVSTFKPHRLLSRSAFSAWLMDYLVFGNAYLQAITNRLGGVMELKPARAKYVRRAKDLAGFWWVPGFDQEQQLAGQVLHLMDADINQEVYGLPEYLAALQSAWLNESATLFRRKYYLNGSHAGFILYMTDPANNEQDIDNLRKALRDSKGPGNFKNLFMYAPNGKKDGLQLLPISEVTAKDEFLNIKNVTRDDVLAAHRVPPQLLGVIPGNAGGFGDAPKAAGVFYENEIKPLMMRLQEVNEWAKLTLGLGEDIIQFGEYALAAAAAA

SEQ ID NO: 5916 - protein, 125 aa, Chromobacterium substugae
MSLYAELVRKAADQYRSQLDAIYAQQKLINRADHIAGLLLKAGLQAKAQADDCYHPFILLQLSEELQPLQKTVLLYVSNVLECQIEENGSRDGLDCFLIPPGGDTGQARLPLLVESAQSVILPTG

SEQ ID NO: 5917 - protein, 227 aa, Chromobacterium substugae
MQPSFTIVFALYPRVTQLDFTGPHEVLAQLPGARCVLASAQGGNIRTDSGITFAELARLQDIAGCDLLCVPGGLGTIAALEDQDFLAQLRRLSASARYTASVCTGSLLLGAAGLLKGKRAACHWAWRDSLAAFGAQPDPARVVVDGDIISGGGVTAGIDMALTLMAEIAGADYAQTVQLALEYAPAPPFAAGRPEDASPAILAAARTRLDALRDQREAAIIQAAARL

SEQ ID NO: 5918 - protein, 310 aa, Chromobacterium substugae
MAHRIAVLIFPGFQLLDASGPTAVFEAAGRYRCDAYRVRAVARQAGLVRSSSGLTLQAEACDAVSLPDTLLVAGGEGVAAACRCPQTLAWIQRCEAAGCRVASVCTGAFLLAEAGLLAGRRATTHWAHAADFARLYPDTMLETDRLFIREGQIWTAAGVTAGIDLALALVADDLGAEVARQSAQRLVVYCQRPGGQSQFSSLLEMQQPGGRFAGLLDHVRRNLGSAWTVAELAERSCLSPRHFSRLFLEEVGVPPAKAVERLRVEAARGALESGEASLQRLARQCGFGEVERMRRSFLRILGAPPSALKR

SEQ ID NO: 5919 - protein, 120 aa, Chromobacterium substugae
MIADHIYGKFDVFRQFRPLALGIHESLIAALSQFEPALISRVVANHCRKPRYLKSLARGGKRFDLNGKPQGEVSAEEKRAAELQMQPKNQPAADAAVAEPVAAQVEMSAVAAEQPGQAES

SEQ ID NO: 5920 - protein, 634 aa, Chromobacterium substugae
MPTMSAQKETLGFQTEVKQLLKLMIHSLYSNKEIFLRELISNASDAADKLRFEGLAKPELFENDAELKIRIGFDQDARTLTIADNGIGMSRDEVVSHIGTIAKSGTKAFFEQLSGDEKKDAHLIGQFGVGFYSAFIVADKVTLTTRRAGETEAVRWESQGEGEYTLETVEKAERGTEIVLHLKEGEDELLNDWKLKGIVRKYSDHISIPIEMKKGNSYGENGEVIVSDDMEAVNSASALWTRAKNDISDEQYQEFYKHVAHDFTEPLAWSHARVEGRQEYTELLYIPSRAPFDLYDRERKQGVKLYVRRVFIMEDTEKLMPHYLRFVRGVIDSNDLPLNVSREILQESKDIDAIRNGCVKKVLGLLEDLSANQPEKYAAFWKEFGQVLKEGVGEDHANKERIAKLLRFTSTASEGSEPTVSLADYIGRMKEGQDKIYYITADTLAAAKNSPHLEVFKKKGVEVLLLVDRVDEWVTGSLFEFDGKALQSVAKGALDLGALEDEADKEAQKQVEEASKPVVDKVQKALGEQVKEVRATARLTESPACLVAGEHDMSAHLERMLKAAGQKVEGSKPTLEINPEHVLVKKLAGETDEARAADLAQVLYDQALLAEGGKLEDPASFVKRINKLMLELSA

SEQ ID NO: 5921 - protein, 138 aa, Chromobacterium substugae
MSEIRALPGAYPCLCYDDAVAALAWLERVFCFQRRFAAIENGRVHHSELSLGNAVVMVSSPNPDRNWIGAGSLPGLAQALCVYVADPAAHYARASAQGAEIVQGLKKEDYGAHGYLARDLEGQQWYFSDYLPGEYWES

SEQ ID NO: 5922 - protein, 199 aa, Chromobacterium substugae
MPALLKFATAEPLLLLIDMQQAVDHPSWGPRNNPQAEQVCAKLLAAWRERGLPIIHIRHDSTEPDSTFRPDRPGHAFKTETLPLAGETVVAKQTNSAFIGTGLEAMLRERGWRELVVAGVSTSNSVEATVRMAGNLGFAVSLVEDGCFAFDKTDWQGRPRRAEEVHAMSLANLHGEYCRVCASADALAALGNNAEAGLS

SEQ ID NO: 5923 - protein, 467 aa, Chromobacterium substugae
MDLHGLGGELRRLSGLETAEAAAALLRLLARWEEAAPNTAALRALLLAGVDLQRRSEDAGGHGALTCPLWRRLHEACKRLAAAAGAQPAGLFDHGRPQQEALALAFSSAWQSLRAHVLGYSPLCAGFWRDCHRLFAMAGQRGWERRAPGDGAVALGDWYRRLLLLGMSASNRLDAQRQHLLLDWVETCGSALKLTPWRGEAPEQPCWLVPAEADMPGRFVDGEREAPGDARWLADAGPALERLRGQAERRRQQLGMVEWQMLARLEAEWRSPPQRRHPRLNQRNGQRVALLAGFDACWRLARAGLPPDAAEAADLLLGNLSASGMRLCGDFGPQEVQAGSIAMVKRRGFGWQLGLVRWISLPGGEQPAECGIEFVGKRPMAVEAAAVTSHPDGGMENGLLLHGERDFRQRGVLALAGRRYQAMRQFKVRGAGGEWLVRAQRLLQQTGSCQLIEVRLEETLARRDAAS

SEQ ID NO: 5924 - protein, 141 aa, Chromobacterium substugae
MPPHKPPLLPCLFFLLSLLAGCHTDSAPGVAELAADQPRPAEPDRRHFWRKREIEEVSRRIIERELGHREALRFAADRDGGDGRYRFRLIAPPRGRLGFASDEAAFAVQADLANGRIISIHCRQNDGSQRMCYPYRDPARS

SEQ ID NO: 5925 - protein, 315 aa, Chromobacterium substugae
MAARWRCLKGKPVGARGGKVQPPRAALAGILVAMNAVPDTPASADGPDFQLTAPELPPSVPIAHVFGQPVLEVPQDLFIPPDALQVILESFEGPLDLLLYLIRKQNLDVLNIPMAAITVQYMSYIDVMQQGRLELAAEYLLMAALLIEIKSRLLLPRPQLDEDGEPDDPRAELVRRLLEYEQMKLAALELDKIPQADRDFAWLAVLVEQSAEQRLPDVSAGDLRQAWMAILSRAKHHRHHKVEKDELSVREQMSWILRYLDGREYVPFEELFDIAKGVAHLVVNFIAVLELVKEGLVKVSQDAPYQPIYVRIALA

SEQ ID NO: 5926 - protein, 264 aa, Chromobacterium substugae
MVLAQQPAPEDASRRMPLLRQWCGEAAAAGGHLLLLPELWSTGYAPEKMHEVHAWDDDAPDLDGVARLAADFGLAIGFTYLARRGGALRNRLRLYGADGRLALQYDKVHICGFTDGAETALQGGDGFVCADIALGGETVRVGAMICFDREFPEAGRALMRQGAELVLAPNACPMRDDAELGDARLQQLRGRALENRFAVALCNYPAPQYDGGSGLIDARGRLLALAGSEPALTLAELDLAALRRWRAEQDEVWGEAALRPDCYR

SEQ ID NO: 5927 - protein, 155 aa, Chromobacterium substugae
MAQHQAEVIWRRGEQDFLDRRYSRKHVLKFDGGAQVAGSSAPQVVPPPYSDPAAVDPEEAFIAALSSCHMLWFLDIAARAGFRVDEYHDVAVGEMGKNEAGKAWVARVTLQPGVSFSGDRLPTAEQFEQLHHAAHAECFIAHSVKTEVLCRPRLA

SEQ ID NO: 5928 - protein, 153 aa, Chromobacterium substugae
MKKLLILLTLLLGSAAALAGDWPYDEKADAQAELRQTLAAAQQSHLPVLLILGANWCEDCRALDAALKSGKSAELIARAFKVVKVDVGNFDHNLDIDAAYGHPIAKGIPAAVVLSPDNKVLYATRAGELADARRMSETGIYEFFERVSRQAAQ

SEQ ID NO: 5929 - protein, 134 aa, Chromobacterium substugae
MAFDDTFRLSAHAVITDAAGRVLLLKATYGDLAWGLPGGALEPGETIHECVARECREELGWEVSPRYLSGVYYHSAYHSQAFVFRCEAPAGTEPRLSAEHSAWRYFALDELGAVQRRRVEDCLNYAGAAVSGRF

SEQ ID NO: 5930 - protein, 274 aa, Chromobacterium substugae
MDPILLLHSLIMGLVEGITEFLPISSTGHLILAGDLLDFLDKDKRDVYEIFIQLGAMLAVVWEYRAKIGHTVAGAARPGGERNLLLGIVIAFIPAAIAGLLFSKQIKAALFNPVCVAIAFIVGGLIILWAERREHKIAVETVDDLSLKDALKVGLCQCLALIPGTSRSGATIIGGLFLGLSRKAATEFSFFLGIPTLGAASLYSLFKHRDALSADDIGVFAVGFAASFVFAFLAIRALLRFISTHSFAVFAWYRIAFGLIVLASWQTGWVNWSA

SEQ ID NO: 5931 - protein, 542 aa, Chromobacterium substugae
MLHQLTVRQKLLSGFALLILLLCAVVLIAYSKLVTIQNNVSEIKEDRYPKIVLSNRLSLNLLQIGREVRDGVLARDPQAIERHIRNVDAIRAANQADLDKMEPLLGQPEGRALFAKIRDAQNQQRPLFEPLYALMRSHQSDAARELLDGKFAPANNAFISALQSLRERQQGRLEKSMDIAQDSSQQAINILLTTALVSLLLAIAVALFISDLITSPLRKSASLVHQIREGDLSGVSEPIPDARDEAMVIARDIQEMREGLRAVVLSIQENAHQVSDSARALSGMAQQVATGAQTQAEATTSAAASIEQLTVSINQVADNSSEASEQAQTAGQLANRGGSEVLESVGKIRFVTTSVDDTAKQMNSLTKEVQQIGNIVTVIRDVADQTNLLALNAAIEAARAGEMGRGFAVVADEVRKLAERTTTSAQEITTMIGSIQQGVGQVVHSMGQSLDCVEGVSGTAEQASHSMREIENSADTIMRTIHSITGALTEQRSTSLSLAQDMEKVSRMAEENNATVQELATTSSQLSTLSANLQNVTTRFRL

SEQ ID NO: 5932 - protein, 483 aa, Chromobacterium substugae
MAASPYAAPPMSNHTFFWHDYETFGAVPRRDRPSQFAGIRTDAELNEIGEPVMLYCRQAPDYLPTLQACLLTGITPQLCQQRGVDEHEFAGVIERELATPGTIGVGYNSLRFDDEVTRFLFWRNLIDPYAREWQNHCGRWDLLDLVRATYALRPEGIVWPEHEDGRTSFKLEHLSAANGLAHEAAHDALSDVRATIALARLIRQRQPKLFDYYLTLRKKDAVKVQLSLHAPKPVLHISGMYGAERGNLAVVWPLAAHPTNANEVIVWDLAHDPAELRGLTAEAMRQRLFSRGEDLPEGVARLPIKTIHINKSPFVVANLKVLSAERAERWGVDMAAIARHAEAARALPDLAPLWRGVFQREAGEARDVDENLYGGFVSNNDRKVLQKMRRLSALQLAGEMGLFEDPQLTELLFRYRARNFPATLSGADQARWRQWCRERLQRAAPAFHEELAALQASDLSAAQRQLLQQVADYAASLQASLQA

SEQ ID NO: 5933 - protein, 262 aa, Chromobacterium substugae
MGNEAVLLSVNKQGVATVTLNRADLHNALDDETISLLAATLETLAEDNDVRAVVLTGQGISFSAGHDPDWLRRLSQFSASELNRYAQQTARLLHTLDTLPKPTLARVQGSAFGLGMALVACCDIAISVSEALFSLSDVRFGQIPALAAPYLIRAIGERPTRRYCISAERFNAGKAKRLGLIHQVVENDELDAAVEHMQGQLLLNSPAAMRAAKHLIGEIGQHDITPQVMQQCIEHSLTVRMSDEGREGMLALIEMRKPAWME

SEQ ID NO: 5934 - protein, 262 aa, Chromobacterium substugae
MPYAQIDGRQVYYEESGHGGQTLLLFNGITMSTVGWTLMLPQLEPHFRLLRMDFLGQGQSDHPPAEYYQLTEQADLAAALLELLGIEQVYLVGLSYGGMVAQHFVHRHPERASRLFLAGTLAWADSVNGHIGDSWIAANQQGGLDLRYQVSIPWLFSSRFLASNAAMLDDLKMLAGMVDWDAVIRLIDGVRQHDARTWLPELQLPVHILVGDEDRLTPLYQAKLLHSLIPDAELEILPGAGHVLHIEAVEAFARGIIQFSPR

SEQ ID NO: 5935 - protein, 608 aa, Chromobacterium substugae
MQSCVEPLLSPGAAGWCQELEEIIGRRRLQPVFQPIVDLDAGSILGYEGLIRGPSDSALHSPMMLFEAAERCRMTLPLDLACLRACAERFAELALPGLLFVNLHPETLLLQGQRPASILGFLGQIGLDSKRVILELTETRPNGGYLALREVTAACRQGGLRIALDDLGEGFSNLRLWSELRPDFVKLDKHFVQNIHLDPLKEQFVRSIADIARQSGALLVAEGIESAAELRTLCRLGVRYGQGYLLARPQANPAHALPLPAHALPWAGNRRQGLRNQPLARDLLLEVAPLEARVPNETAYRRFADHPDCFAIPVVEDGVPVGLLRRHHLLESFAKPFNRELYGKKPCHLMMDKQPLVVSADLNVHELSSLVVAAEQRYLVDGFIITENGRYLGMGTGFALMRKITELQLSAARYANPLTGLPGNVPINEAIDRLLGMKTPFVAAYADLDHFKPFNDLYGYAAGDSLIELVAHLLLEHADPERDFVGHVGGDDFVVLMQADDWEARLQCVLEAFGRLAAPHFSDRHREAGGFEVAARNGETVFQPLTTLSLGVVRVKPGQFGSHHEIGAVTAEAKKQAKKIPGNSLFVERRQPAATVAGCRCGLAEGGG

SEQ ID NO: 5936 - protein, 391 aa, Chromobacterium substugae
MSEAIAATKHVAAIPAVGAVSGVSGNEEAPYLKIAGVVKKFGEHLAVDHIDLDIRKKEIFALLGSSGCGKSTLLRMLAGMETPSAGRIILDGQDMHGLQPYQRPVNMMFQNYALFPHMTVEENVAFGLKQDKVPRDEIAERVAKMLDLVQMRKFAGRKPHQLSGGQQQRVALARSLVKRPKLLLLDEPLGALDKKLRQQTQLELVNTIEAVGVTCIMVTHDQEEAMTMASRIGIMSEGKLLQVGTPTEIYEYPNCRFTAEFIGETNMLEGAVAVDEPDLVEIHSQELGGVIRIEHGITGPKGMHVWASVRPEDVRLDKQPLPPGPNRAAGTVQDIAYLGSYSIYHVKLAGGKVVKSIVPSSRWCDANETPPTWGDPVHVSWRSDAPVVLTQ

SEQ ID NO: 5937 - protein, 429 aa, Chromobacterium substugae
MLRFAHQPHPPSYYAATAHAWDPQPPLRGEASCDVCVVGGGLAGLSAALNLREKGFSVILLEGSQVGFGASGRNGGQVIAGYAGDIDGIRRQLGDEAARALWDMSVEAVEIIDERVRRHAIACDWQRGYVNVAVKPRHLRELEDWQREAEQRYGYGGQQLWDRAALRGKLASERYQGGLFDPRSGHLHPLNYTLGLARAALGAGVAIHEQTPALRIEQGDAPKVFTEHGVVRCRQLVLACNSYIGALAPQLERRIMPAGTYVIATEPLGEARARALIADNMAVCDTNFVLDYYRLSADHRLLFGGKVSYSGHEPRDLAGAMRADMLRVFPQLADARIDYAWGGFCDITANRAPDFGRLSGNVYYLQGFSGHGVNITGLAGKVVAEAIAGTSSRLDLFGKIRHRDFPGGKLLRTPALVLGMAYYRMRDYL

SEQ ID NO: 5938 - protein, 323 aa, Chromobacterium substugae
MMDVSLQEPIMRLLPYAVLLAALARPALAANELPIALDTASGRIAGSLLLPEPPGKAPVALIIAGSGPTNRDGDNPGLPYGSGGYLKQLAQALADAGIASVRYDKRAIGESRAAGLDEAALHFDDYVDDAAGWIAKLKTDPRFSKVAVIGHSEGSLIGMLAAQKQNAAAFVSLDGPARNAADFLRAQLAPRLPEDLAKQSERILQALRQGREADNVPGPLLVVYRPSIQPYLISWFRYTPTEAIRALKAPTLIVQGGADHQVPKAEGETLHAAKPDSLLQNIPGMNHLLRDDDPQHQASYGATPQPLSPTLAPSVIRFLKQAL

SEQ ID NO: 5939 - protein, 632 aa, Chromobacterium substugae
MKRIQRLPDHLVNQIAAGEVVERPASALKEMLENSLDAGSTRISVDLAQGGIKLIRVTDNGAGIAADDLPLALDRHATSKIASLDDLESVGTLGFRGEGLASVASVSRLTLVSRPQDADHAHQIIAIDGTLHPVEPAAHPHGTSVEVVDLYFNTPARRKFLKSENTEYAHCVATFERIALAHPHVEFLLRHNGKVAWRLPSQSAEDRVAALLGKDFVAAAIPLDSQAGPLALTGFVASPTYSKASRDAQYFYVNGRFVRDKTAQHALRQAYRDVLHHDRHPAYALFFTLEPSGVDVNVHPTKIEVRFRESQAVHQFLFHSVHKALAGTSAGAAPTVQVEGAEPAAPQLPRGESAPLFASPAPRPASSGAPAPQAFQYHQQQSIPLNVAREAVGVYDKMFGGLREEERALSRAEPAMPSPAAPLPHPAMLAMPAHDENGIPPLGFALAQLHGVYILSQCAEGLILVDMHAAHERIVYERLKTALESDAIPQQPLLLPVSFAADRMEVATAHEHGEEMKRLGVELAPLSPTQIAVRGVPVWLKDGDPVDLARAVLKDVREFGLTQVLTERRNELLATMACHGAVRANRQLTLPEMNALLRDMEATERSGQCNHGRPTWSRLTMRDLDKLFMRGQ

SEQ ID NO: 5940 - protein, 214 aa, Chromobacterium substugae
MEVLTFLIDFILHIDTHLAQLVADYGPWIYAILFLIIFCETGLVVTPFLPGDSLLFVAGALAAMGKMDVHALTATLIVAGVLGNTANYTIGRYLGKALLQRYPRLIKQDYLDKTHAFFARHGGKTIIFTRFAPILRTFAPFVAGIGAMGYRQFTIYNVAGAVIWVASFVYAGYFFGNLPFVRKNLELLVLGIIFVSFLPAIIEFARHKRAAARS

SEQ ID NO: 5941 - protein, 311 aa, Chromobacterium substugae
MELFRIKRDIPFMSYGRLTTAISLVTFIVAVFFLAARGLNFSVEFTGGTVLEVQYQQSADLDKIRDTVDQLKLGEATVQNLGSSRDVMIRLPNKPGTSSAQLSDKVMGQLKAADSSVQLRKVDFVGPSVGAELVSSGLTAVILVCLGIMAYLALRFEWRFAVAAIIANMHDVVIILGCFAFFRWEFSLTVLAGILAVLGYSVNESVVVFDRIRENFRKPGMRGQAVASVIDNAITSTMSRTIITHFSTEMMVVSMLVFGGPALHGFAMALTIGILFGIYSSVLVASPIALWLGVTREHMIKPVKPKEEAVV

SEQ ID NO: 5942 - protein, 616 aa, Chromobacterium substugae
MNRYPLWKYLVIVVALILSAIYTLPNFYGETPAVQVSSSRQSVPVDTAVMARVEEALKAQNISPDGVFLDAANSLKVRFKDTDTQLKARDAIQHALGDNYIIALNLLPASPAWLTALHANPMFLGLDLRGGVHFLLEVDMKAATDKTMERYAGDLRRELKNKQVRYGAIKRNGNTLEVQLRDGDTLKSAQDVAYRTLPTLAVQTDDASNRLLLTLKPEEITKIQSDAVKQNIMTLHNRVNELGTTEPIIQQAGPNRIVVQLPGIQDTARAKDIIGRTATLQVRMVEDDQGKLSDAVNGNVPSGYELLDDVSSRGHSKILLKNDVELTGDNINDANPSFDQFGAPAVSITLDSAGAAIFRQLTAENVGKRMAMVLVEKGRKEVVTAPVIRQEIGGGRVEISGSMNAAEANDTALLLRAGSLAAPMNIIEERTIGPSLGQENIEKGFHATLWGFAAIVAFMVLYYGLFGVFSGLSLAINVFLLVAILSALQATLTLPGIAAIALALGMAIDANVLINERIREELRNGVPPHSAIQAGYGHAWATILDSNVTTLIAGLALMIFGTGPVRGFAIVHCLGILTSMFSAVLVSRGLVNLWYGRRRKLTSLAIGQVWKPENKG

SEQ ID NO: 5943 - protein, 107 aa, Chromobacterium substugae
MFISPAFAAGSGSPAGFDLMGFLPMIVIFVLFWFLMVRPQQKRMKETQKMLSEIQKGDEVVTQGGIVGRVAKTSEQYLTLEIANGVEITVQRGAVSAKLEKGTMKSL

SEQ ID NO: 5944 - protein, 371 aa, Chromobacterium substugae
MLKFTVHKTSGGARRGTLELNHGTVETPVFQPVGTYGSVKAMSPVELKDIGAEIILGNTFHLWLRPGLEIVEQFGGLHEFIGWDRPILTDSGGFQVFSLSDMRKLTEEGCTFQSPINGDKLFLSPEISMKIQTVLNSDIVMQLDECTPGQVDHATAQKSLQMSLRWAERSRRAFDDLKNPNALFGIVQGNLYTDLRQESLEGLLQVGFDGIAIGGLSVGEPKPEMYRMLTELKDMLPADKPHYLMGVGTPEDLVHGVANGVDMFDCVMPTRNARNGWIFTQWGDVKIKNARYKDDKRPLDEACECYTCKNFSRAYLHHLHRVGEILGARLNTIHNLFYYQELMRQVRKSIEDDRFEDFRLEFAANRARGVN

SEQ ID NO: 5945 - protein, 633 aa, Chromobacterium substugae
MPDIRLPDGSIRSFDKPVTVHEVAASIGAGLARAALAGRVDGKLVDTSFQIDGDADLAIITDKDADGLSVIRHSTAHLLAYAVKELFPEAQVTIGPEIENGFYYDFAYKRPFTPEDLVAIEKKMAELAKKDIPVERYELPRDEAIAYFKSIGEAYKAEIIESIPQGEVLSLYREGEFTDLCRGPHVPSTGKLKVFKLMKVAGAYWRGDSKNEMLQRVYGTAWAKKEDLEAYLYMLEEAEKRDHRKLGVQLDLFHLQDEAPGMVFWHPKGWQLWQSVEQYMRDKLNREGYKEIRTPMMMDAHLWERSGHAANYRENMFITESEKRDYAVKPMNCPGHVQVFNSGLRSYRDLPLRYAEFGSCHRNEPSGALHGIMRVRGFVQDDGHIFCTEDQINQEAKDFHRLVMEVYDRFGFDKVSIKLALRPEKRIGEESTWDKAEEGMREALRACGVEWEELPGEGAFYGPKIEYHIKDALGRSWQCGTLQLDFMLPERLDAEYVADDNSRKRPVMLHRAALGSLERFLGILIENHAGAFPLWLAPVQLVVMNITEAQADYAVEVAKSLEKQGFRVALDLRNEKIGYKIREHSLQKLPYQIVIGDKEKAGGLVAVRARGEDLGQLTLDAFIARLKAEMPEA

SEQ ID NO: 5946 - protein, 136 aa, Chromobacterium substugae
MALAEEGDVDLVEISPTAQPPVCKLMDYGKYKYEMSKKRHEAKQKQKQVQIKEIKFRPGTDDGDYNVKLRNLVRFLTEGDKAKVTLRFRGREMAHQDIGLALLKRVEADLAEVGTVEQFPRLEGRQMVMMIAPKKK

SEQ ID NO: 5947 - protein, 65 aa, Chromobacterium substugae
MPKMKTKSSAKKRLKVLGGGGFKRAHAFKRHILTKKTTKNKRQLRGTSMVDATNVASVRAMMPYA

SEQ ID NO: 5948 - protein, 119 aa, Chromobacterium substugae
MPRVKRGVTARARHKKILALAKGYRGRRKNVYRIAKQAVMKAGQYAYRDRRQKKRQFRQLWIARINAAARENGLPYSKFMNGLKKAGIEIDRKVLADLAVFEKAAFAQIVEKAKASLAA

SEQ ID NO: 5949 - protein, 328 aa, Chromobacterium substugae
MNNVDAILQAGQAAVAAAADLIELEQVKARYLGKSGELTELLKQLGKLAPEERKAAGATINLAKQAFETAHNDKRDQLNAAKLEAQLAAEVLDVTLPGRGLVGGGLHPVALTLERIAGLFRTMGFEVADGPEIESDFYNFQALNIPENHPARAMQDTFYVENGDVLRTHTSPIQARFMESHRPPIKIVAPGRVYRVDSDATHSPMFHQMEGLWVDEGVSFADLKAVVTDFLRRFFERDDLQVRFRPSFFPFTETSAEIDVLDEQGRWLEVGGCGMVHPNVLRIANIDPETYTGFAFGIGLDRFAMLRYGVNDLRLFFENDLNFLKQFN

SEQ ID NO: 5950 - protein, 785 aa, Chromobacterium substugae
MQFSEQWLRSWVNPALTTDELSHLLTMAGLEVEETQAAAPAFSGVVIAEVKECVKHENADRLRVTKVDVGSGELVQIVCGAPNVAVGVRIPCALPGAVLPGDFKIKPTKMRGVESGGMLCSGKELGVPDDVDGLMLLPDDAPIGQNIREYLGLDDQLFTLKITPNRADSLSIRGIAREVAALTGAELRPVAIEAVKPSIDDVRPVKIEAREACGRYLGRVVRGVNAAAATPAWMRQRLERSGLRSISAIVDITNYILLEQGQPMHAFDLAKVEGGIAVRMARAGESLLCLNEKTVELKPHHLVIADDAKVLAMGGFMGGEHSGVTAASQDIFLESAFFAPAAIAGRARELGFGSDSSYRYERGVDFQLQREAIECATRLVLDICGGAAGPVVEEVAELPQRQEVKLRVARVAKVLGVALSAEQIADILSRLSLPHTLENDVFTVQAPSFRFDIEIEEDLIEEVARVYGYNSIPSDAPRSGMSMLKQPEEQRPVDQLRHLLAARDYQEVVSYAFVDERWERDFAGNDKAIRLQNPIASQMSVMRSTLIGGLVDTLAGNINRKHPRVRLFEVARVFLRGEQGFEQPEKVAGLAWGPRLAEQWAAKAERVDFFDVKADVEALLHPLKAEYRKAAHPAFHPGRCAEVLVDGKLAGVIGELHPQWVQAYDLPSAPVLFELDLACAIARDRIKAKPVSKFQPVRRDLALVVDEQVTVAQLMAAFAPKRAQIVTDIALFDVYRGKGVAEGKKSLAFSVLMQDNSRTLTDEDVEPALQALLDAVSGLGAQLRV

SEQ ID NO: 5951 - protein, 100 aa, Chromobacterium substugae
MTLTKAELADLLFDQVGLNKREAKDMVESFFEEIRLALESGDSVKLSGFGNFQLRDKPQRPGRNPKTGEEIPITARRVVTFHASQKLKGMVEQYHANKQG

SEQ ID NO: 5952 - protein, 117 aa, Chromobacterium substugae
MLTSKADLPSIPSKRYFTISEVGELTGVKPHVLRYWEQEFSQLRQVKRRGNRRYYQHHEVLLVRRIRALLYDDGFTIQGARQRLGMGEVSERPITAQEVRAELESILNWLDSGIGKP

SEQ ID NO: 5953-5962 - skipped (10 entries)

SEQ ID NO: 5963 - protein, 57 aa, Chromobacterium substugae
MLALYVQCTNGHQLGDITSCLVGMLVCGLCVQLGKGISLARIHGVKKHQLPLSHFDA

SEQ ID NO: 5964 - protein, 120 aa, Chromobacterium substugae
MDDTIDGLTALLDSTSAPIIVWENEHFGPVERNGRRFRDSSVYHENRERIAGIVTLHRPNADLAGRDIAELSIKGQTFAEALTSPEWGIMPKHRLQMIWADYLQQIKPILTQGLPEELAA

SEQ ID NO: 5965 - protein, 43 aa, Chromobacterium substugae
MPENQLRSAHGQSLEAMADNLDSSLSWLNEAIAELSQAIDEME

SEQ ID NO: 5966 - protein, 37 aa, Chromobacterium substugae
MADQSSRMLLIMLATTVQARNYRVEMRAVSLRFVKER

SEQ ID NO: 5967 - protein, 54 aa, Chromobacterium substugae
MYIFIIILRYVRLKLSALILINSNQRWFRALRCLTFRDITLPTSCTPAHVLFIT

SEQ ID NO: 5968 - protein, 96 aa, Chromobacterium substugae
MSDETVAKVRRWYRQRIWFARRDACLKAALYRCATPGCVNRATDCDHIRPHRGDWSLFIESSNHQALCHSCHSRKTAREDGGFGNRRREVGQGVGG

SEQ ID NO: 5969 - protein, 269 aa, Chromobacterium substugae
MRAGSGVMPKPPAFLTSKRGRDVWKYTINALDSAGLDWTSALLQIALLADKVDDWRTHVEELDRYGHRYDEDANGGSLETDESRAERRARGEVMKDLDEGGLTVMAAGQVRALDRMLTADLFASDPFAVMDQLGEGGANLPKKPPWSMTKAEARAWREIQPLLQASGFDYSSAGIALGLICAAIADWQACKQWILDNRGKIFAAAKETGRRYEVSASYNRAKIAKQMRELLKRNGMTVASCARTKALSKGRVISEDLAELLGYINDRPD

SEQ ID NO: 5970 - protein, 552 aa, Chromobacterium substugae
MDVLEGRIKVGRYVRLAVERHFRDLQQQEARGLVWRPEMAAHALAFFPRYCRHFEGEWSGQPVELAPWQAFWIAVEFGWYNRDGRRRFRTFYEEVARKNGKSTKLAGLGLYLFAADKEAGAQVYTAATKLEQAKITHAAAEMMVAKSPALRQLVQNHKNKLWIPGTANKFVPLGADAKTLDGLNVHGAIIDELHAHPSRDLWDVIDTGRGARRRSVMHAITTAGFNQEGSICLEQRNYLIRILENQGKDPALEDDSFGGVIYTLDPEDDWFDESVWCKANPNLGVSLFLEELRTQAQKARVVPTALFNFLTKRLNIWTQAVDSWISLDEWDKGTAAVDPELLRHRRCFGGLDLASKTDIAAWVLLFPPEKPGEPWQVLPRFFVPADNMLARDKSDRVSYSTWARQGYITATAGTRIDQEVIRAQILADARQFDLQAIGFDEWNAGKLATELTEDGLQLVALSQNFQNLSDPTKELEALIKSQALAHGGHPVLRWMAGNVVVLRDSNDNYRPNKGKSREKIDGIVALVMALNRALYHAPAGSFVSAYEDEVCL

SEQ ID NO: 5971 - protein, 46 aa, Chromobacterium substugae
MLVGLAGVAAVTVGMSLLHAAAGWMVGGGFALAWSWMTARSAGRAR

SEQ ID NO: 5972 - protein, 416 aa, Chromobacterium substugae
MFMSQQFGQSAASPDPGWLSSLLGGGARSAAGVAVSPDKALSITTYQACITTLAESLAQLPCELYRRNGDQRERVTDHPVAQLLRQPNGWQTPFEYTEGAQIAAAHDGNAYSYIERDEAGRPVALLPMEAGKVAVLRGADLMPYYRFDGQEPMPAHQVHHVRWFTRNGYTGISPVQLHCDSLGLALATHGHASAVFANGTHLAGVLERPAVIGGQDVKPLSAERVLQIKAAWKREYAGRGNAMKVALLQEGITFKPLSMTNADAQLIDARKLSALEVAQIFKMPPHKVGLLDRATNNNIEHQGIEYVIYCLMPWIKRHEQARMRDLLLPSERGELYIEFNVSGLLRGDTQSRYAAYAIGRQWGWLSANDIRRLENLQPIPGGDVYMQPLNMVDTRGASLQGKPDARALVEIDRILA

SEQ ID NO: 5973 - protein, 41 aa, Chromobacterium substugae
MQPIDSELARETGEQIIEAVREGRCDVMDWENPVSVWGPNE

SEQ ID NO: 5974 - protein, 50 aa, Chromobacterium substugae
MNVSNYTPPEAVIGGQGGSLLAAVLIGALSRHPVAASLPQLATPSAKAGQ

SEQ ID NO: 5975 - protein, 318 aa, Chromobacterium substugae
MRGQFLLSQLFNQPHMVLPDVLHEAVAWAGERAGIELRQLGVHVAAALQPAAWRDDGGRASMANLAEQRMQSAQQTGLLVIPVQGLLVAREANVNLCATQTSYEGIRSQIQAGLNDPRVSAMVLELDSPGGAVVGCFELVADIEAAKAVKPIHALVHFNAFSAAYAIACACSDITLSESSGVGSIGVIMKHADFSQQLASSGVAVTTFYRGARKNDMASDSPLSDDARAAVEKRMDAYYDKFTGVVASNRGLSVAAVKATDAGLFFGAEAVLVGLADRVESQQLAINRLAAEVAASRSPPLAPSRRATAAAMAMAAQL

SEQ ID NO: 5976 - protein, 439 aa, Chromobacterium substugae
MSVVLELKKRRADLSAAVNQLAALEATGAALNAEQVASIDAMQKEFDDIGAKIARAEAAERMTAATAQPVDSSQGPRAGAAPIHATPAAPTVKGGGMARMAAALIEAQGNYRQAANIADERGYGQEVAAALNTGSPSAGGVLVPANMAREVIELLRPKTVVRKLGARSLPLNNGNLTIPRLRGGATVGYIGSDSDAPVTGAQFDDLKLSSKKMAALVPISNDLLSNAGISPNVDQLIVDDLTSSVGAREDKAFLRDDGSGNLPKGLRHWALANSVFTAPDLGAIDATALQVLENFLNKLILALEGVDANMTMPGWVMSPRTFRFLEGLKDMKGSKVYPELAGKTLKGYPVGVTTQVPNNLGKDGDESELYFADFGDCFIGEDQSLVIDFSKEATYKDTDGQMVSAFQRDQTLIRVIAKHDFGPRHQESIAVGVGIKWGK

SEQ ID NO: 5977 - protein, 67 aa, Chromobacterium substugae
MIAVKFVKPYGIYTPGDIAGFEGQARVDELIARGMAALDDEDGEGEPAPGETKPVAKSKAKAQPGGV

SEQ ID NO: 5978 - protein, 193 aa, Chromobacterium substugae
MAAEVIRRSPAAVLTLDEVREQCRIDADLTDDDMLLQMIERAAVASAEARIGGPLLLAECRETLDAWPGLPWLYLDIAGGREVVAIEAVQQGQRRPLPLDAFHIERGERRLCIKPLKGWPAVDPLPGAIAIVYRAGFAEAGQDVPEDVRQWLRFRVATLYAYREEVSAGSVVALPDSLVDSLIAHYRPTESPL

SEQ ID NO: 5979 - protein, 106 aa, Chromobacterium substugae
MNASMLNNRIRLSQPIKSRQPSGAVREAWSEPKPVHAKVDYLAARTYTAVLAEQTGCSVRATIRRRPVAQGWRAWVDGLPLKVKTIEPHKDRGYLVLMLKTDDGNG

SEQ ID NO: 5980 - protein, 152 aa, Chromobacterium substugae
MHGLDLVMRHLDAVPRNLQRKILRRGLRKGAALVRDEARRRVRRRSGVLAKSITVASSRGSGQRGAVAYKVGLRSRAWYGRYLEYGHVKRGRGKKIAGGERRRAATREALKGAGQFVPPYPFMRPAADKLPAALGVVADEVCGALISGELSS

SEQ ID NO: 5981 - protein, 120 aa, Chromobacterium substugae
MELLAAPEVAALVGDRVYPVHLPDEPVLPAIAYQVLDEKRQQIARRPSGRVRSLVQLSIVAPDYDAAYSVAWVIRRRLERWRGQAGGVLVYDTLEEALQDVGDGTPHVVAMTWRIHWKEQ

SEQ ID NO: 5982 - protein, 135 aa, Chromobacterium substugae
MSKIEALMRAMEEALKSATPAADRVSRDVEKGYSFGEFPAIVLHQLRDAPLSGSPVGYEYRQLSVELEIQADGDEPHAACDGVLEAAHLALHEMLTGVQDLQQGVIDWDYDEENPALGVCRVQYLLTYRRREEEL

SEQ ID NO: 5983 - protein, 507 aa, Chromobacterium substugae
MIDSDSLGNKGEKRFGELCADAGLFCNDSSDRDRAGWDFIVNFPESEERKESLDNRIAPLSCYVQVKTIWSKGGEVRLKLNMAERLAKEPIPSFILIFKVDVDLQFSNAYLIHIYDARLAAILKRLRHEHAKCDGKSLNKKVIKFSPLEEETIPISGSGLREAIIRCVGGDIDRYVESKKQQRLSVGYDERPESIKVTFQGLSDAELLDVFLGIRKDVPVLNFESAETRFGIAIKNIPSDSGRITIEPNSLGKCKVLARPPNRMGGMAILFGDFYMTMKVGSCQKAIVRSNIFTIEITDLDASCHVKFEYSTYGKMCDLSEWANFLQLILLLNRDDVMVEIHPPKSKKPLEIKSSYFDLKPSGDKLDAVMHDIFIVRSLESIFSFIGLSSRPLIKLEDIIGSANSIAMVAALMDNVNPNLNLDCDYFGAVKDIDKEIIVASRFYVGEILMAYYAVVLGVSVDSVEGEVGYDVFEFKSVVILDNVEEAFEEFLKSIRCQENIDQVVLI

SEQ ID NO: 5984 - protein, 309 aa, Chromobacterium substugae
MALNSKRVAIIAKPESKEGVDAVPTGAANAILVASPKVTPLDSDRAERNVVRPYFGNAESVVTGVRMKAEFEVELAGAGVAGAVPAWGVLLRGCGFAETVAKDASASYAPISGGHESLTLYYNLDGVQHKLLGARGTVSLDLQNKAFPKMKFVFTGVHGGIVDAPAPALKLTPFQTPMPFDAANVASFSLYGYSPAVQSLSLDMANEVKHRSLPGGVESVLITGRKPSGSVQIESTRVAEKDWFALARTAERGALALVHGKTAGNIIQIDATVSIGSADYGDSDNISMTTLPLALLPTNGDDEIKITVR

SEQ ID NO: 5985 - protein, 125 aa, Chromobacterium substugae
MFKIANSGTVRVPAEILTRTESGAENKVSIQLTGRLLSQPGWDALFAKYAGEAGAGELSEVYRQNARLYAEVFTAWDGVADTDGQVLPLSQAALEAALLSVDGPQVNAALQQAVHELRFGAVRKN

SEQ ID NO: 5986 - protein, 114 aa, Chromobacterium substugae
MRWQFGERAATRSEDRQALLAAGVPLEQADAMLPARCDVEAFALLPDALPAWRVWQAMQTQWRVGPAGPYGLDYAALPVVERRVGLPAAQRAEVFDCLQEMEQEALRLMAKKGA

SEQ ID NO: 5987 - protein, 888 aa, Chromobacterium substugae
MAAQNVGSLVINLEARVAQLQGDMAATKRVVSDAMDTVERDAKRGAKALEDAAGSAGLLARAGAAIAGGFALSAVKDGVVSVAAALNQAQIASERLQKSLFYANGGDVRAIASDIEWLRRQASGLGLDFAQASASYAQFAGAVKGTPLAPYARQVFDSLSTAASAFGLSAETAQGAMLALVQMSAKGVVSAEEFRGQLAEHLPVATQAAARALGVTTGEFSKMLESGQLLAADFLPKFAAELKRMSADAAAFGGETQKASANFVNSWEAMKTEVAQSGIASFIAGQLAILTDAFDDVSESMRRARKEGSGFWGQTMAGGGAVMRFLNPVNALHYDAQSDNARMAQLKERIKEGQAGLYEYSFSQTLAQKQAGLAAMRSELAELEKRAKAATTDAAAGAKAAEAKAAARKDAEARAKKYADDDSRLNDREEFDKKVRKEEEAFKGAVVGLEKGSAAYLAAERAHQTAVSKLRDDFDKKQAAERKRAGAQGRREDAAIDAMQREIMGVEKLSAVERARYEIAEGKYAGWSAASQARLLALAAELDATRQVRAENKKFLDELNRDVEQYETHQRDVARRLRGGEYDNAAQRLQSEHRERSLDIQYNAGLSDQEKQQYGQQEDRRNERAVDALRSSERQGIGLQSEEQQLRDQYDRRHQLIMDATTLSETERADYIRRNQEQLNLDLMNMERNRASAMLSSSSQLFDGLAGLAATFKGKNSGIYKAMFAMSKAFAIADSVIKIQQAVATAAASAPWPANIGAMSSVVSATAGLVSTIASTNLSGMAHDGIDNVPREGTWLLDKGERVVDRRTNGDLKDFLTRVNAAQSAPATPAQPVKVVVNNLAPGTAARTEERQGAGGEREILVLVERVIDNKLARSMRPDGDIYNFVRG

SEQ ID NO: 5988 - protein, 114 aa, Chromobacterium substugae
MAAETFGWTPLFGGSSSIRARVREAKFGDGYVQRVPGGINTMPRSRKLSFAGDAAMCDAIEAFLMRHAGARWFWFAYPGAARCKVRCEEWDRSYLAAGDEVVSAAFEQVFDPGE

SEQ ID NO: 5989 - protein, 231 aa, Chromobacterium substugae
MMGEIHAEKQRLVPDALVQLFEIRPPAGETMQPLRFTTSGNGQAVTFQGLTYEPWAIEATGFESSNKGAPRPRLSVSNIGMLPDGRPMRGIFTALVMQHQGLVGWEVVRRLTHAKFCAGGELAAFPEMHPEEIWLINRREADNGDVLTFELRSRLDLAGKRAPGVLVTRYCPAHVVYRGPHCGYQGEAMFDANDRPVMDKRLDKCGKRLSSCRCRANLANYGGCPGMRRYN

SEQ ID NO: 5990 - protein, 238 aa, Chromobacterium substugae
MGNAMTATTEQIAAMLAYAAAAGDLEACGVVLDSGRVYPCRNLADEPARQFRIDPVDHAAAEQLGRVVGIWHSHPNAPAEPSPADRAMCERTRLPWHIVSHPGGDYRYIEPCGYQADYLGRPYCYGVFDCWELVRDWYARERGVSLPRPPGAERDGWWSRGLDLFTTAAEAAGFVWVDDEPQAGDVLLMQIQGALPNHTALWLGDGRILHHLRDRQSETHIYGGYWQRATVRRARYRQ

SEQ ID NO: 5991 - protein, 189 aa, Chromobacterium substugae
MSNSTLRMIRLGGVLGEQYGQAHELAVSSAAEVVPALNALYPGFNNALRALDEQGMAFRVTVADRTVCEQELTLVSSGDILIMPEVVGASGNQVLGGVLIVVGALTWAFGGTQLMAVGVGLMLSGAMMMLTPVPRLDQSQSEQQQGKTSYLFNGAANSSAQGMPAPWGWGRHRAGGIIISAGISVEDMR

SEQ ID NO: 5992 - protein, 1208 aa, Chromobacterium substugae
MDRDIRGAGGGQKEPRRPVEASDTLQSLATARVLMLVGLGEMGGLVDGDQSVFFGGVPLQDRNGARNFERVRVEHRVGTAAQAPMAGFDEIETEYAVGVEVKAGDGIVRSIDNLDATAVRVTVSVRGLLAVNDDGDTNPTAVTMAVDLREPGGVWHQARQIDIVGKTRSKYQRSVRVDLPPGGPWQVRVRRVTPDSTTQKLINATEWDSYTMLQSMRLSYPGYALLGVEFDARQFSSLPEITSEWRLSVLQVPSNYDPASGTYAGAWNGTFKPAFSSNPAWCLYTFATDARFNLNLPPDGAWKWDLYRIGQWCDQLVSDGMGGLRRRFEMHGYHGDGADAWKVLQDMASVFCGKVVPSAGGIRVVADIPGDPPAKHFTPANVIDGQFSYASTEQADRYTVASVSLVDPEDGWKRGIEYVEHAEGLARYGYQPAEVVAVACTSRAQAQQLGRYILETAQTETELVTFAAGLYGVDLQPGELFTVFDPVVAGRRVGGRLLEVKGKAVTLDAPVMLDEGVSYSLECPMPDGSLVQRGVVVTPGEAASLRLVAPFPAQPVDGATWALIGTNLQPTLWRCVAKREREPGIYEVSGLQHNPNKWAAVEQGIRIDAPPASSLPDPAQMPAVSAVSMREVSYLTGDGRRAVRLEVDWPGVNHPYLRGYVVGYRQDGGNWLELPEQAANHAELEGLQPGQWQVRVSSVSAIGLRSIPALASIDARGHVAPPPAPALSATGAPMAINLAWTYPPGVPELVRAELFYSADPHDGNPARLADLAYPANSFIHQGIGLGVHYYYWLRVTDSWGNVSAPAMADAATIRNPELLLQQLQNSIGGGQLAEELRQPLERLPDIAAQADEAGKLAVSAVETALQNVLASDQLGDVQTRQFAIARRDLKTTNEALKSEATAREVLAAKLGDTQAALIEERTARAEADRALASEVKTLSSQTAGDLATVRQELQTATGENGALSKRLDQLTAKHETTQAGLLQEQTARAEADKALASDVKSLTSKTDTGLAAVREELQAATGASGSLAQRLETLSTRIGDSEATIQQQSKSVDGLRAQWSLRITRTANGKTFASGMGLSNGEQGSELAVLADKFSVAQPDGENARQVFTVGSINGRPAVGVSGDLLLDGTLSANKIAAGEIRAEVGLYAAAIRGGYINMGGGQFVVDNNGNVSISSGRNGARTEITNRAIRVFDENGVLRVQIGDLAA

SEQ ID NO: 5993 - protein, 100 aa, Chromobacterium substugae
MSVHGLVVKDAGGRVTMHSDALSGSLVDVISLTGGVGERHYPELRGFALNTLQIYGATVGGPGKRMHAVSLDYAPGYPLLRWWPQTGDVAATTLYVLSAR

SEQ ID NO: 5994 - protein, 235 aa, Chromobacterium substugae
MVSNRNGGIVVSDRTYSMVYVGLAEFSGVTGAALPVYPGREDIAKCGTTMCYYVNNCPFEPLPFIRRNAGWAGIVGVQPAGLNRWEITVVVYPANPPQILVFCRTPNTGPAGRWGMVLRGPDGSLRYDSNRQNLVLADILNHAPGGIYPWESMWNCTTVTPLRVNNPNLAFCYSATGKATTDNNYWSYYFLLVARLSDAGFETKYSTIAKGAQVSAGYYDHVPQAVMVIDASLYI

SEQ ID NO: 5995 - protein, 786 aa, Chromobacterium substugae
MVKGAATHWRGQVNPGDILIGPDGRLYEVAEVDEGGEALTLRTPYLGDMAAGAPYAIVRNFTGSPLGQVAAELAKMQRRWLTTLAGFRDVLLSEEPQATLYDELGGAHAVMSWPAIDKAVKAGLASMEAARVMVVDNSGELIASRTAAGASAKASGDSAAASAASASAAKASEDASRKSADFAAAAQEQAGGHRQAASAAASAAAQSEKSAAASAGILSSAAAAVEEARKLVNGLDARFATPAQVDAALARVVDGAPGQLDTLRELSAALGNDKDFAANMTAQLAKKLEAGDLSRVGLGGNAQNISAGAMTDKRPNGFYHVQTETVTGGPAGVGNGMLLVNFLSDKWGVLTYRAWGGGVYEARLENGVWSSWARHWHSGNDAPLSLFRGELDGKADLNTLQQNGWWWQRANAAAASGANYPCGDAGALSVSNAGNMTFQQYQTFSTERPRLFLRSRYGEAWGKWREVWHSGNHGAGSGLDADTLDGLQGADLLTVSSDQTVAGAKTFAQPIRANAPGGSWDSWAGAARGPALQLNCPDAAQAYAVWRAGKPGGEQLAALDVRAGGDKPAAAVLHLAGEGVAVNAHAWTGNDYAAAGNIQAGGRLVSGEINANATGGTDIGVEVRNKPGSEGDDGMAAMGFHCQGKFGVKLGLRADGVFGLGGWSASSWRWYVNAATGDMTAAGNVTWFSDRRLKTDIEPITDALGKVLRLNGYTFTRTDTGARQVGLIAQEVQAVQPEAVIEAADENKTLTVAYGNLAGVFVEAMKEQQRHITRLEARIAQLEAAA

SEQ ID NO: 5996 - protein, 160 aa, Chromobacterium substugae
MTLPVNGTLSAREVNVEVSRPGAALGNAGEPVFRALAEVGDSGSYSAMAFYGKNVIKPLTAALSTYLDESTFVVGIGRPRVYVEVTCTPGGGVPPYAYAWEMLSEDRGHPFYSGEATNKILFSGDPKGYGSTWRCRVTDSQGKVAYSPVLTLVFKYRKLG

SEQ ID NO: 5997 - protein, 92 aa, Chromobacterium substugae
MQEHEKALAALVGVGAAIGLGKLLVSQEQITARLAVGRAILGGGTSTVAGVALTQFPEMPLPALVGIGAGIGILGAQYLEAWLKQRADKIGS

SEQ ID NO: 5998 - protein, 148 aa, Chromobacterium substugae
MELVQVAISQLGVEEQPRGSNDGPKVRQYLQAVGIGFPASWCMAFVYWCAERAAAESGAANPLLKTGGVLKQWNERPALRVSAPQPGDVFIMDYGKGLGHTGIVERVDGDKLLTIEGNTNASGGREGYAVCRRVRSAKLCKGFLRVGV

SEQ ID NO: 5999 - protein, 110 aa, Chromobacterium substugae
MDVTRREWALADAQRGATEARADLAGYRAEVERLQALSVLIENKLEALRQAQPKINERYNRVVEKSPLPADCRPGPERLRELNAAIEAANTALAGQPGQALPASGAGDGG

SEQ ID NO: 6000 - protein, 37 aa, Chromobacterium substugae
MKVSYLFFVSCFAEFLLSELLAFLIFLRVLLKIEWSH

SEQ ID NO: 6001 - protein, 713 aa, Chromobacterium substugae
MSVQNASCPAPEKESTTQKAARFQTKAELGNNVNKKTEPSCKTNIWSNFFFDGTNNNRDRDLVDAVNSGKPRYRCDHSNIVSLYETAIDDQKANHYTHYMQGVGTIFKDINENEPSDMGLSMAAGGQARLSYAYYQLCNDISLAFNGKRLFTAEDFKKELRVAKDRNPNPRFPDLSSLDAVQKKLALNIGNNKNTPKIEIVNIAVFGFSRGAALARVFCRWLELSCKRQGDTWLFAGCVPIRLYFLGIFDTVASVGMAHSTPGIGRAPGRSANGVVDGQNSWATPDMLKVTSFTKQCRHYVASHEVRYSFPLTSIRHEDGSMPLNAVEVVYPGSHSDVGGGYGPGDQGKAVGHRRKLLSQIALLNMYNDARAAGVPLRSLSALKRDPAAQDFEIDPLLIKRFNTYMAWANAGGRMVEDALYAHLKKYWHWRIATSPQFMQQDCIQQLSKGATQRSSRSDKQDLEDMRASEKDWQGDLSRARIVESEVNEAAELLRLQSEEGKQPVPKDVHDFFDQHLHDSHASFYMIGPTTAWQRQQRIADARHKSKSVIYNPAIGLTPKKLSPFEQKLAKCAPGDSDDPKKIDSSNYPVVTDSDYSDLVKGDGAGGTVASAMTNTRREIGGHAHQRATFVGRYERYAKTTSSIDFLARDTLKARQDQLAHDYNEQVRIRNMVFENQKAILKDQGLSTNQLEKTHQQDMMQLGIKFRDQLQSL

SEQ ID NO: 6002 - protein, 281 aa, Chromobacterium substugae
MFLQNRHAPELLPQLHQWMAINENGHYCWLMDGSQLDAKEKRWLQRRQPWQRALDDTPMDALEDFGPLIWTEPLHLQEWWPEWLAITSGRPLLSVVEFRHAVPDSAFWHWLSDFRTDDGQKLLLRFADTHTLANVLPLMSDEQLTMLASQVARWGWIGRTGEWEAATLRDTPTIPAPWEPLEFTQAQFDRMMDRARPDMLPPILAHYEVELPQDETPASLHLRLSQLAEAMSSYGIQDEPSQALFASLAFEQGDSFHQETEWQEFWNRTRKGQLLTAALSE

SEQ ID NO: 6003 - protein, 881 aa, Chromobacterium substugae
MDITALLASFASAFSQNNRHITLAIASDAAGPEQLLPQTLDGEEGVSRPYRFQLDCLSPDGQIELKSLLGHPARIGLMNAEGGEDVRCGVISQARLLGSDGGFARYGLTVEPPFALLRHRRTSRVFQDMTVPDIIKQIISEHQAANPAFARVQTLDIKVDAAQPSRSYCLQYRENDFDFIVRLMHEEGFAWRFEHVDGDSPQVRLVVFDDAFSLPAGSAPSVRFHRADATEEQDGLTDWQAARQIVAGGVALASYDYQPTRTSHSGDTSQVDQGQAGQALQSSLNHYDAPGLYYASDADQLSRYAQLRQQAHDLQAKTFTGFGAVRGLQAGAWFRLDDHPAHQGDSAEQREFVVTGQRIQARNNLPGDLSQQLQAIAPGLGLQAADSTTAPYQTEFQAQRRGIPLTPAYADTPHAKPTSLGTQTATVVGPAGEEVHTDEHGRVKVQFHWQRPDEHPTIGAGMDDKSSCWLRVAMPSAGAAWGHQFIPRIGQEVLVNFIEGDIDRPLITGMLYNGSHRTPTFSGAGSLPANKTLSGIQSKEHQGGGYNELLFDDTPGEVRAKLSSEPGKTQLNQGFLTYPRSDGMAQPRGEGFELRTDNHGAIRAGHGLLLSTEAQNGAGGKQLAREHAQSQLDAAQSLSQALAETAAGQLADAMETGPDEITPDNAKDGIKEKGHLAHLASALKAWEAGTNTNGGGEVPGQQPVIILSAPAGIASLTEQSQTLAAGQNLDLIAQRDSNHTTGRRWLHNVGMHISLFVAGVKDKVAFKLIAAKGKVQLQAQSDAMELTADQDLTITSAKQKIHANAKQEILLTSGGAYVWIKDGKIELHAPGNVSIKAGKHDWSGPDQMGPPLPQFPNNVCIPCLLKAMAARSPVATTTPGA

SEQ ID NO: 6004 - protein, 102 aa, Chromobacterium substugae
MDLSKLEFTALIALKADVEGEIKRREVEEKSKAKKQILELARSFGLSVEDVLSSKIAGTRKPVEAKYRHPDDSSLTWTGRGRKPAWVQAWIDSGKAMETLAI

SEQ ID NO: 6005 - protein, 126 aa, Chromobacterium substugae
MSTTRPDSPCIALCSTALGDNVCRGCARTFGEISQWCFMGADEREAVWSRLPQRQRLLQLAAACSALLELDSLDGVEWGRLPDGSHYRLEEGGGALLRRDAAGRDEQLCCEGLTLERAASWLLAQR

SEQ ID NO: 6006 - protein, 201 aa, Chromobacterium substugae
MQDSSQPQFWEQRYQEGVMPWEGAELPAPARDFFSGQVPMRVLLPGCGSASDMPPLHAMGHQVLAVDFSQSALDLARRQWPGLADKLMLADFFQLDLPAFDCVFERAFLCALPIAMRKGYADGVARLVAPGGALAGVFFLAQTDRGPPFGIAEAQLEALLGNWFSLEEKQLLPTGLPVFRGQEHWMVWRRRKLDLDQALTA

SEQ ID NO: 6007 - protein, 599 aa, Chromobacterium substugae
MEWFWRLYTFSEKNFWNTLSRKLCSFFFISGFQLLMVGYCYYALSDIRATLRTAGVAPQVLASVEGNIDSALSWTLGLWLVSFVFIAFMVWYLRYLIVRPLNMIIQIFNEIGAGAGDLSREIPTVTYDEIRDLSLSYNRFLLKMREIISNVRLMTVRIAMDSAVTRRNVTESLGSARQQDELARQVSQASEQSTRGVEQVTEQTEAISATTAENLKVAQESCEELRLVTGSIHDISRKVGHFNLTVEDLSQRSASIKTIVDLIKDVSEQTNLLALNAAIEAARAGESGRGFAVVADEVRKLAERVKKATDEISHNIDGMLGLVAETQQETAAITQDTNQARDVISRASEHFSKMMGDFEATSTSLSQIAATMHDFSESNHQVNEHVAEIHVLGRQVSGRLGQTESAAAELTAAAEQVQELVSKFVIGDGVFDQAVNQARGVRDEVQQLLQAELQRGVDLFDQRYQPIAGTAPVKYRTVYDGKLEKLLQPMLDKLVGLIPGGKFCVAVDGNGYAPTHNSWYSRPLSGDAARDLAESRDKRIFNDPAGLRAARNNQPFLLQTYSRDTGEVLSEVVLPLQLRGRHWGALRVGFDPNSLLAQG

SEQ ID NO: 6008 - protein, 188 aa, Chromobacterium substugae
MEAFLISTGVVALAEIGDKTQLLALLLASRFKKPIPIILGIFVSTLVNHFAAAAVGQWLMTKIGPDFMRWGLGISFVMMAVWMLIPDKLDEDGGLRERFGVFGTTVIAFFLAEMGDKTQIATVALAARFHELPMVVAGTTLGMMIANVPAVLLGEVAAKKLPQKLMHGIAAVLFVVLGVITLMSPLTL

SEQ ID NO: 6009 - protein, 153 aa, Chromobacterium substugae
MSVLKEFKEFAVKGNVIDLAVGVVIGGAFGSIVKSLVDDIIMPPIGLLIGNVDFSNLFFVLKDGAKQAGPYVSVAAAKQAGATTLNLGLFINALVSFTIVAFAIFMLVKAINRLKREEAAPAPAAPATKECRYCLSSIPDKATRCPCCTSQLD

SEQ ID NO: 6010 - protein, 285 aa, Chromobacterium substugae
MPSKPTLLAAGAIALWASLATLGALTRSLPPFFVVGVSLTVGSLLALPRIREWRVPIPTLLVGVYGLFGYHFLLFFAFRMAPALEANLLNYLWPLLIVMLTPLFRPGSRLGARHLIGGALGFAGAALIVSGGSLSLSQQYLPGYLLAMAAAIVWSTFSLALGRLPDFPGSAVGGFCLISGLLSLLCHALFEPAAQPSALQWATLLLLGLGPMGGAFFLWERALKHGDPRQIGSLSYVTPLLSTLLLAVSGQGQLNPLALLAILLILGGALLGTLSDNRKPADQAA

SEQ ID NO: 6011 - protein, 380 aa, Chromobacterium substugae
MLWNEIFRSPALAWFALLATAHCLALRSRMEITIQRMGSMDAFWNEWLGQKGLASDGELPLGERLSQVEALLRQSVLAPLANFAVIKAEGEDAAAFLQSQLSSDIRELVEGRAQYSTYSSAKGRMLASFMIWQHQGAYYLMVAADIAAAIVKRLTMFVLRSKVKISLADEWSLLGMSGPQAVETLRKYFPGVAGLESLQTLSADGAVLLALPEGGFMLALGENASLRQDIAAAELRPLAPEIWALRDINAGIAWVSQATQEQFVPQMANMELIGAVNFKKGCYPGQEIVARSQYLGKMKRRMFLVEFSQALAVGSKLYSPQLPDQSIGMLAASCQVAEDRYRGLAVVQSQTWSSGIFGDEAGTIALTALELPYALESVTE

SEQ ID NO: 6012 - protein, 101 aa, Chromobacterium substugae
MDLSKLEFTELVTLKADVENEIKRREVEEKSKAKKQIIELARAYGLSVEDVLSKTVAVRKPVEAKYRHPSNNELTWTGRGRKPAWVQAWIDSGKSLEQLAI

SEQ ID NO: 6013 - protein, 573 aa, Chromobacterium substugae
MLDFFSRGSKGKPDPLANAAAAKAYVDALRMEFGASAHDKVAELLGGLNSPSLELSADLLEAVLTLNLETQALHDTLCVQYLMNTRMPKVLESQLRGQILNYGKQFTDFYQYALPASADNPNGLKIRSHLPLVLARMLHYLTEYARWQYIRNFQPDEVFWMNANQLYRFAEQRGFDSQPVFLFGEKSAATTVQDLYLALQMLSVLCTGNLSVRQINFSYELLSLLSNRMTMTKAYFAEASFSVTLTDPKPAARARGAGGGEQTRYWNTADMVEILHGWAIVMEGGRIPPELKRLVEPGIDAGLLRVLTREWAAKPVVFERAERVAVSNRHVEVAHRLTILHKLIRKPDEESMQQHRGVDSDSYDDAANIRIYGFVTSRKRDKSLSPLPAGSLSMAGETAEAGTPQEFQKWALENISQTGLGVSLDVMGNEWVSLGSLIGFHEADGESWNLGIIRRVKRTSRERIYLGIETLSTRPLAASLRPTDARLIDPTLPPDQVWLAGHISLFMPYRRSGKLVNALILPLSLYMLGKQFYMSARGKHFQIALGKVLEKGSDWCMVEVELVKTLDKLPVVL

SEQ ID NO: 6014 - protein, 377 aa, Chromobacterium substugae
MKISSNFDAGSIEIVSADTAEDIQLRIRRDNAAEFAQWFYFRAQGAAYQHCNFRFLNAGECAYPQGWVDYQAMASYDRINWFRVPTRYEDGVMTIEHVPLSGSIYYAYFEPYSYEQHLNLIGQAQGSGLCQVSDLGSTVQGRDINLLTIGHEVESDLKIWITARQHPGETMAEWLVEGLLNRLLDPQDPTSRALLDRATFYVVPNMNPDGSVLGNLRTNAAGANLNREWSEPSLERSPEVLLVREKMLETGVDLFLDIHGDENLPYVFLAGTEGVPSWNEKLEALADNFRHHLLLASPDYQTEHGYPRNEAGKANMGIATNWVCEQFGCLAFTLEMPFKDNNNLPDDDFGWNGQRSLRLGEALLSPIYAVLNDLTGE

SEQ ID NO: 6015 - protein, 184 aa, Chromobacterium substugae
MSYNNEQLNKLSLAGFESTLRFAQIALDSAERLVKLQLDASKQSLEDNTKAAKQLTELKDPQEAVNHLNKLATQSIDKAVSHSRNLYEVVSGAQSELSKLVEESVGHFNKSLISSIESVAKNAPAGSDATLNAVKTSFAAAAAAVNTFSKAAQQVAEFTDSSVKAATSATADAVKNSAKRGATV

SEQ ID NO: 6016 - protein, 186 aa, Chromobacterium substugae
MSVEKRVIKKYPNRRLYDTATSSYITLGDVKQLVLDNVDIQVQDAKTQEDITRGVLLQIILEEENGGMPMFSYEVLTQFIRYYGQAMQGMMGPFLEKNLQLFSQLQQKMQEQTRAMYGDNAMLNTTLWSEFMNLQGPAIQNMMANYMEQSTGMFLEMQNRMQEQTKQLFGGFGFPGYPGVEPKDKP

SEQ ID NO: 6017 - protein, 440 aa, Chromobacterium substugae
MSQEGGQRLRQAQRRHLAGETAGAEADYRALLADAAIGVAARHWLGFLLLQQGRLEEARRELAQAVAMDGGHAEWHFNLGLACARLGRRDEAIAALRAAVAGDGGRYAYWTNLAALLDEAGDDAEAEHACRRAIALEPGSPDAHHLLTALLLRQGRFDEARRSNAEGVLAEPPGKMAPIAVGQALCELGRRDEAQALAESWLRQQPGHPVALHMLAAFGKGEPPPVCDGAYVGRAFDAAAADFEAALARLRYRGPQWLADCLAGQGIAPRSLSALDLGCGTGLAGAALRPYASRLDGVDLSAGMLAQARGKALYDALSQADLLDFLRDGGDCRYQLIACMDTLTYLGELAPLFGLLRRRQGPGGLLLFCTERLDDGDDADYRLHHSGRYRHHARYLERLLADGWRVLARERLPVRDEGGCPVAGEFICAQRVDSVGEPGA

SEQ ID NO: 6018 - protein, 47 aa, Chromobacterium substugae
MTEGLRWRWRLPAHGGGYINNQTLAAHQSQLITNSRRIYLYFLKLQP

SEQ ID NO: 6019 - protein, 363 aa, Chromobacterium substugae
MRAKTTLPLLLLLSLSPLAHALGKTPGTYTHYRFPAAASAGLDAVDFTITVKRDPGYSANVYWANQFDLVGTSGAYTGMQSNGGGARTFLFSAWDTTDAKPGSAGSYCTTFSGEGTGRSCRIHVDWKQGHSYRFRAAYEPGGWLGVTVTDQTDGSSFKLGSIKTAASKISPRNMVNWTEYFEWNNSRSTCLGQPYSLAAFAAPVGSAGGKTMAAAISGSSVSDACPAYSKVTVYSQSSEQENGIGNSARAPIANAGQCLDAKGGLGDGVAAIIYACNGGANQSWVHAADQSLQLQNNYCLEETGSGVEVRSCSGKSRWELAAGHVRSLRSGLCLSANRPGQPVSLLQCGGPGQQWSLPAAAAH

SEQ ID NO: 6020 - protein, 809 aa, Chromobacterium substugae
MVAAGCSSILVRDDDGAIHGIWTEADALRTALTPADADAPVSRAVGEPPATLPHDMPLPDAVAVFRSRQLRHALVLEHGRPLGMLTLTDIVRNQGVESFLIVKRVSDLPGPPAVVLAGSQAPAEALRVMREQALSALAVALPQGGFGILTQRDALRWLALGGFPATLAEGCRQPLIGVPRHASLLQARQLIQQHDIRHLAVFGDDGAPLRLLGFDDIVRGIEHEYQHELNAALRQRDEALQQSRHSLLLADKVFESTMEGIVITDRNGLIQSVNPAFSRITGYSREEALGQTPAMLKSGKQPPEFYQQLWRSLLRDGRWQGEVVNRRKGGLLYTEHLSITAIRDAAGECLHYVAVFSDITQRKQAEERLHFLANHDALTSLPNRTLFLEKLQGAVARAAADRRGLALLFIDLDRFKLVNDTLGHHAGDQLLIRIARQLQARLQPTETVARLSGDEFTVLLEGVDGVAQVAGRAQALLDAITELSGAAGQQVFVSASMGISMFPDDGREADTLLVHADTAMYRAKESGKNGFQFYTADMNARALERLKLEYSLHRALAQRELELWYQPKVALDSRRIIGAEALLRWRHPELGLVAPDRFIPIAEESALIVQMGAWVLDAACADIRRWRDAGLDAGRLAVNVSGRQLKHGDFVRQLEQVLAEYGLDSAALELEITESVAMEEGGGMVETLRRLQRLGVYLSIDDFGTGYSSLAYLKRLPVRGLKIDRSFIADLHCDSDDAAITRAIVSIARSLGLDIVAEGVERESQRRFLLEQGCNCAQGYLFSQPVPREAFEALLAAQARPRAPALLQK

SEQ ID NO: 6021 - protein, 427 aa, Chromobacterium substugae
MLDITLLRNDIDAVAARLAARGYALDTVAFNQLESDRKSLQSRMQELQAKRNASSKQIGAAKSKGEDVSAIMAEVATLGDELKAAEQAFETVQKQLDGWLMTIPNLPHESVPAGKDDSQNVEVRRVGVPRQYDFEVKDHVDVGAPLGLDFDTGAKLSGARFTVLKGDIARLHRAIAQFMLNTHTGSHGYVEHYTPYIVNDTALLGTGQLPKFADDMFKVTRGGDESAAPQYLISTSEVTLTNTVADTILKEDELPLKMTAHSPCFRSEAGSYGRDTRGMIRQHQFDKVEMVRVEKPEHSYAALEEMVGHAENILKALELPYRVVTLCSGDMGFGAAKTYDLEVWLPAQNTYREISSCSNMTDFQARRMKARYKDENGKNQLVHTLNGSGLAVGRTLVAVLENYQNADGSVTVPTVLRPFMGKDKIGG

SEQ ID NO: 6022 - protein, 439 aa, Chromobacterium substugae
MPDLFAAEPQKPLAEALRPARLDDVIGQQHLIGPGKPLSLAVAAGKPHSMILWGPPGVGKTTLARILAASFDAEFIPLSAVFAGVKDIREAVERAHAVLQRDGRHTILFVDEVHRFNKSQQDAFLPFVESGLVTFIGATTENPSFEVNSALLSRAQVYVLNSLSEDELKQLLARARHEHALDGLNFDDAAVSTLTGYADGDARRFLNLLEQTRTAAQARGAADIDAAFLEEVLTLNARRFDKGGDAFYDQISALHKSVRGSNPDAALYWLSRMLDGGADARYLARRIVRMAWEDIGLADPRAMQIANDAAATYERLGSPEGELALGQAVIYLAVAAKSNAGYNAYNEARAFVKQDKSRPVPVHLRNAPTRLMKELGYGHAYRYAHDEPHAYAAGETYLPEGMEDIRWYRPVPRGLESKIQDKLAFLRRLDADAQQDPDK

SEQ ID NO: 6023 - protein, 187 aa, Chromobacterium substugae
MKTAQELRAGNVFMVGSDPMVVQKAEFSKSGRNASVVKMKMKNLLTGAGSEAVYRADDKFDVVVLDRKDCTYSYFADPMYVFMDTEFNQYEVEADNLGDTLNFIVDGMEDICQVTFYDGKAISVELPTTVVREVEYTEPAVRGDTSGKVLKPARLVGTTFEVQVPAFVNTGEKIEIDTRTNEFKKRA

SEQ ID NO: 6024 - protein, 381 aa, Chromobacterium substugae
MTRQHWDIFCTVIDNYGDIGVAWRLARRLAHDRGLAVRLWVDDLASFARIAPGLDPALPQQTLAGIDIRQWPLAGFPPDVVPGDVVVEAFACRLPDSFEEAMAAKPAKPAWINLEYLSAEDWTLSHHKLPSPHPRLPLTKHFFFPGFDAASGGLICEDGLIAAREAWQADPAAQQAYWRRRGLPPPQAGELRVSLFAYENPAATALLRAWADGAQPVSCLVPAGKVQADVERVFGKALRPGEPANLGNLTVHILPLSGQDDYDRLLWGCDFNFVRGEDSLVRAQWAARPLAWHIYPQDDDAHLDKLRAFLDHYCQGLPAEAAQAARALNLAWNQGGDIAAAWRRAAPCLPAWRQHATNWQQALLQPGDLVVRLLHFIADIG

SEQ ID NO: 6025 - protein, 747 aa, Chromobacterium substugae
MRKKAWTWLLAALPLPAWAGVLLQNGLWQVELEPATLAIAAKPAGAMARQLSQGAAPHAVSALSQDGQTAQWQWDDGKYSWRASLQGRDLQLTLTAREAGKVELLRQPAAAMGHGLLLPLAEGSYIPAGDKLWQDFLPGFAGDGLNTSENLSLPLWGMDYGHHSLSWLLLNPFNNALAIRAEGKGLALSLSHEFNALNQQQPMTLLLHLGEANLLSGAQRYRQWLEDEGRYQTLADKIRAQPEAARLIGASHVYLWGNNLLDADDVADWPGFVQRLRGGGALARKLRGRFDAEARQLLQQVGSRPDRYQKKTLIEAFNQALTAEARAGWLGPQPDWEGMAEPYRRLRGQVERDFGPALAADSTRWGGGLSRKTVDALAAAGLKRLWLGADNWEGGLWQPQAVAAGIKAGYLMAAYDSYETALPPGQHVDWLTAQQGAAVYRDCGVTLASGKKKTGFQQAGYYTNPDCVRATLRRRAEALQTAAGFNSWFLDAYATGMVFDDYSAGHRGSQAQLAAGNEQSMRWLADRFKQPVGSEMGNAATSGGIAFAHGMQVPVLGWGDADLQKNRQSPYFLGRWFPADQPEIFFRQAPLKQPYRDLYYAPQYRLPLYQAVFHGSIITTNHWLYDNLKFSNAYADNLLAQWLYNVPPLFHLSAASLKARLPQLQCADRAFRPVHLQLALQALTGFVWLNAERTAQQTRFADGSRLSANFGATAVGEGDQALPPQSLRVELAGQPPRLLRVADCGGG

SEQ ID NO: 6026 - protein, 184 aa, Chromobacterium substugae
MGATQWSRQYQYDAADNRSGQLSYRYDPVGRLLEAATPKGVESFRFDPAGNLLDNAPAADGHQDDSLLGNLLSQYAGRHYRYDSRGNLVEKRVNGSLTRLEWDSHNRLSRLRFIPTPVGNTPSWLVSPKSMAVHPHARGEHALLVGVAEKHGGSSPRPWGTRPPGWCRRKAWRFIPTPVGNTEA

SEQ ID NO: 6027 - protein, 285 aa, Chromobacterium substugae
MLGNALQQHQSYDKAGRLSSQRLMGATQWNRQYQYDAAGQLTGIADSRSGALNYRYDPVGRLLEAATPKGVESFRFDPAGNLLDNAPAADGHQDNSLMGNLLSQYAGRHYRYDSRGNLVEKRVNGSLTKLEWDSHNRLSRLIAPGGQRTDYHYDPLGRRIAKISQGQATLYGWDGDVLAFETRDEAAVHYLFEPDSFVPLAQVHTDAIRGVKVPAWSQHAGTRGPQGGVLLPHRPPGHPAGADRRAWRAGAGNGLPGLGPGARSHRRRRLKSRHPQPVPLPGAVS

SEQ ID NO: 6028 - protein, 81 aa, Chromobacterium substugae
MVFLSLFENPEFSYTYHRYYAAIFLLYWAIYFLCYIVQPELHHHRCHWLKYLIIQLAFFYWLQWIDALLDLDLLQARKTNL

SEQ ID NO: 6029 - protein, 514 aa, Chromobacterium substugae
MDVLNYGSGHVHGLLFGQRDIFNQERDKLHRETQRVLGNALQQTLAYDKAGRLSSQRLMGVTQWSRQYQYDAAGQLVGIADNRSGQLSYRYDPVGRLLEAATPKGVESFRFDPAGNLLDNAAAADGHQDDSLLGNLLSQYAGRHYRYDSRGNLVEKRVNGSLTKLEWDSHNRLSRLIAPDGQRTDYHYDPLGRRIAKISQGQATLYGWDGDVLAFETRDQEAVHYLFEPDSFVPLAQVHTDAIRGVKVPAWSQHHPYDPDKDPLRQPAPEPEAPKAVYYYHTDHLGTPQALTDEQGLLALEMDYKAWGEAREIIADAASKAGIRNPFRFQGQYHDDESGLHYNRHRYYDPEIGRFISRDPIKHNGGINIYEYGTNPIEWIDPHGLSSASILKKIAQIKTGQSVTACSYQEANAILFGAFPDAQKSAGAADKSEEKTAKDKAAFKANRQNGTGRASYHMDYKTNPATGILYGHEGLPDGHPHKTIPHINIVTPEGKKTDIFIEKPSSCPSRSKKK

SEQ ID NO: 6030 - protein, 1541 aa, Chromobacterium substugae
MTTAALARPVAVIPATPQAAAQALQQTGQDFDKWLRSISDGHLSVESLKTIASAVPVVGNLISIGDVIVDIVDMSNKSRANQEVDVFDWLFLGVDLIGVIPAAGGLFKMGARPTLKLCATSLRRAGKDWAKGEIEAGLAAKLVTMLPASYRNSPAEWVKYVDGKIQNELKVCGAKGATIIAGMGELLTSLGTGKFGAYVQKNVKHAPVRYNLNKTNDQGFWGTVSAHLHSLNQAAADAGTEAAAGMTVAAAKQIDSILKGTVSARLMQRLGAAMAKWAGMLVDMLMKMYSSHLKPLLDKLLKAFLNHLPKKAAAVATKAVNTAKKKVEQTVKEVAAKLKQLAKPGPKCACASTQASIGYAFGDESLQHTDFSLPGVLPIVWTRQYRSNFGGNDQKGEFGARWSLAYAARFDIEGGQLKFHDDSGRTLDYPLLPEGESHKDGIEGFTLTRLSDTLLSQTFGHDLIQLYERHGDSFRLALIKDRAGNSIAMNFRDGRLSQLVSSAGYAVDLNHDAIGRVTRVTLQNLETGLPQRTLAEYRYSDIPQLGGDAGDLLAATDENGESWSYQYQHHLITRYTDRTGRGITLEWDGTHLDARAIREYADDGSLDVRLAWDENIDLTYVTDAYGRTTEYYFDDKGYNYRIVYPDHKEEWFEFDDDKKLLSHIRPDGTQDSYDYDANGNLIWHERADGSEVRFAYDEQDNLVEIIDPMGEKWLRAYDDMGQLIEETDPLGHKTKYAYNEQGLPVAITDAKGGAKKIAYRPDGLLESYTDCSGSATQWQYDERGRPLLIVDAMGNATRYQYAANGTLQAIVQPDGQATQLEHDAEARLLKITDPLGRGTHYEYDKAGRLQKRTDANGHSLGYQYDKLGRLTALRNENHRYYRFDYDDGGRLTAETGFDGSATRYVYDNAGRLAQQVEGDVTTDYRYDRAGRLIERSAPNSKESFGYDPAGRLFQAKNRYASLRWVYDPVGNVVEEHHGYHVAGVKETYRWQHEYDKLGNRIATIRPDGHRVDVLNYGSGHVHGLLFGQRDIFNLERDKLHRETQRVLGNALQQTLAYDKAGRLSSQRLMGATQWSRQYQYDAAGQLVGIADNRSGQLSYRYDPVGRLLEAATPKGVESFRFDPAGNLLDNAPASDGHQDNSLMGNLLSQYAGRHYRYDSRGNLVEKRVNGSLTKLEWDSHNRLSRLIAPDGQRTDYHYDPLGRRIAKISQGQATLYGWDGDVLAFETRDQEAVHYLFEPDSFVPLAQVHTDAIRGVKVPAWSQHHPYDPDKDPLRQAAPEPQTPKAVYYYHTDHLGTPQALTDEQGQLALEMDYQAWGQAREVIADAASKAGIRNPFRFRFQGQYHDDESGLHYNRHRYYDPEIGRFISRDPIGLMGGINTHNYAPNSIQWVDPLGLWAAGAKYKYKYGPNGEIRSATAKIRPEDLNTGTKTSTSSRAFARSLGCPHDDAGHAIANRLGGSGGDDGVFPQALGINRGQYRTHEAQIAEKVKAGDNVIVRVVPQYDKGSTRPHSVLYQTRINGKTTTRVFDNPLKCCCGEKK

SEQ ID NO: 6031 - protein, 603 aa, Chromobacterium substugae
MQTATVVGPAGEEVHTDAQGRIKVQFHWQRPDEHPTIGAGLDDKSSCWLRVAMPSAGAGWGHQFIPRIGQEVLVDFIEGDIDRPVITGVLYNGSHPTPDFSGAGTLPANKTLSGIKSKEHQGGGYNELLFDDTPGEVRAKLSSEAGKTQLNQGYLAHPRSNGKAQPRGDGFELRTDQHGAIRAAHGLLLSTEAQNGASGKQLAREHAQCQLDAALSLSQALAETAAGQLADSMETGPDEIGPDNAKAGKKSQGHLQHHADALKAWEAGSNTDKDGKTAQDQAGQQPLLVLSGPAGIAALTEQSQTVSAGQNLNLIAQRDANHTTGRRWIHNVGQHLSLFVAGVKDKVALKLIAAKGKVQVQAQSDAMELTADKELTITSAKGKVQIAASQEVLLTSGGGYIRIAGGNIEIHCPSEVSVKGASHSLSGPASLSTPTPAFAKPGTGNLQVIHEFANGVSMNQGKFVVTDALGVKHKGVLDEAGKAMVHGLPVGPAQVDFLGRPNKDKADIFPFVPQPEEAVKQLVGGEAVKKQAMSQLSSLVGKTLPPGVAAAAGQLSQAKNTLDQAKQVAGQAQAMLQQARDVKQLASSAATVPNAANLLKKIL

SEQ ID NO: 6032 - protein, 315 aa, Chromobacterium substugae
MRQGQEIYNSEQLKLTDRKNRTMIEELRALAVFAKTVETGSFRAAARALQLSPSVVSHHVSQLESRLGAALLYRSTRRLSLTADGETLFQHAQAMLRAAESGLDALAGRATEPTGRLSLTLPAFFARSPLTARLAGFARRHPKVELALDYSDEKRDLVRDGIDLAIRIGELPDSALKSRRLFDMPRLLVAAPALLSARPAPRHPQELADWPWLGIRMRPDRKTLLDAAGEAHSFSIQPAIRANSLDAVCQLAIAGCGLATPPAFLATDDIAAGRLSEVEPEWQVEALGVYAVWPANAARASLTLRLTQYLSEMQQ

SEQ ID NO: 6033 - protein, 135 aa, Chromobacterium substugae
MEERRCAIIVDPDLPAGIAANTAAVLAMTLGRRHPELVGDDLADAAGSVRLGIVTTPIPVLQGGAALLRALRAQALEAGLTVVELTDATRSTRSYQEYAAALRGTPEPDLRYQGLALCGPAKQVRRLTGSLGLLR

SEQ ID NO: 6034 - protein, 196 aa, Chromobacterium substugae
MVWSFIAATALITLLPGPSMLVIVACALGQGWRAGAAATGGVVLADAILMAIALSGVGALAQASPLALLGLKWLGAAYLTYLGASVLRAGNKGAAAEASGRSGGAFRRGLAATLPNPKIIAFLIIYFPQFIQPGRDTAGQLLLLGPLFLLTVGAVFLLCMAAALTVGRAMPRGRAGRLSRACGCCLIACGLYSALA

SEQ ID NO: 6035 - protein, 221 aa, Chromobacterium substugae
MKAKADFSLLFDLDGTLTHTDDLHFDAFRTLMAEHGRALDHDTFLHHIVGAANEAIMARLFPDQPAQHLALAARKEQLFRDSVTRLVPTPGARELFDWAERHGVGIAVVTNAPRANAELMLGGLGLAQRIDALVIGDELAHGKPHPLPYQTGLARLGGRAERACAFEDSPSGMRAACAAGIHSYGIAGALPPQKLLDAGAAAVIADFAAPELWRWLERALA

SEQ ID NO: 6036 - protein, 463 aa, Chromobacterium substugae
MSDIYKIGVGPSSSHTVGPMKAGHQFLGALKETGKFNQVNRVHVDCYGSLALTGKGHCTDQAIILGLAGNLPDTVDPDNSASLLADVEQTGQLTLGRTHQRVAFGMDFHTANLPLHENGMQIHAFVGDEKVLTKTYYSIGGGFIVDEEHFNQSSCSDTPVPYHFVTAQQLIDMCEETGLSIAALVMENEKAFHDVKDTQAHFRRVWEVMKGSIERGMRTEGNLPGPMRIPRRAPALHRMLTSSLTVAKDPMSVMDWVNMYAMAMSEENAAGGRVVTAPTNGACGIVPAVLAYYNHFIQPLDDDSCLRFFLSSGAIGCLFKLNASISGAEVGCQGEVGVACSMAAAGLTELMGGSPSQVCMAAEIAMEHNLGLTCDPVGGQVQIPCIERNAIAAVKAINAARMAMHRVSSPKVSLDKVIAAMYETGKDMDAKYRETSCGGLAIQIKVESKVVPSQAIRWVDDAA

SEQ ID NO: 6037 - protein, 432 aa, Chromobacterium substugae
MSQAIASTAPRSGSSGWTKHDTTWMLGLYGTAIGAGVLFLPINAGIGGLWPLMLMAILALPLTFFAHRGLTRFVLSGSKEGADITEVVEEHFGAGAGKIITLLYFFAIYPILLMYSVAITNTVLSFLNNQLHIEVGTGIATRAVFSLALILGLMSIVRLGGQMIVKAMSILVYPFVVVLMMLALYLIPQWSDTAIRHAGSLGDAVSSGAFYKTLWLAIPVMVFSFNHSPIISSFSVDQRKLHGDDAEQSSSRVLIRAHTMMVLTVMFFVFSCVFSLSPADLAAAKAQNISILSYLANHFQNPVMEWVAPIIAMVAISKSFLGHYLGAKEGFNGLVIKQLRQSGKTIESSKLDRYTAIFMIVTCWIIATINPSILGMIETLGGPVIAMLLFLMPMYAIQKVPAMKKYSGAASNIFVTLIGLIAISAIFYDLIA

SEQ ID NO: 6038 - protein, 260 aa, Chromobacterium substugae
MSHSSTLAYVADEAASKQQALRSEPGRYLLSAAMAGALIAVVLAVSLKLGQVFFAAGDSGYYIATAGFFGVALVSIIVCKVELFTSNVMYFTVGALSGRCRLCYLLRSWAMVYLGNLAGVLLFVAVLAGAGGMGALPADHLLFNVVQHKVHAPAMEIFWKGVLCNWIICLAVWVPMRLANEAARILVIMLLVFVFFFSGFEHSIANMAFFALAKMQGMAGLAWSDILHNMLPATLGNIVGGAIGVGLVVFRLERHTLRAV

SEQ ID NO: 6039 - protein, 38 aa, Chromobacterium substugae
MDASGMLRRGIETAPKAMADLTKIKRNFRIRMYDVFNI

SEQ ID NO: 6040 - protein, 775 aa, Chromobacterium substugae
MDAITQNATQANPWRDFAAGDWQSKVDVRNFIQLNYQPYEGDDSFLAGATDRTKKLWDALGELLKQERAKGVLDVSADRGSSITAHDAGYIDQANEVIVGLQTDAPLKRAIMPNGGLRMVENGLEAFGFKLDPMIKEVWEKYRKSHNQGVFDVYTPEIMACRKSGVITGLPDAYGRGRIIGDYRRVALYGTDFLRAERQQVFHELDNATFTDDVMRQREELSEQFRALDELKQMAAKYGYDISRPAANAREAVQWVYFAYLAAVKEQNGAAMSFGRVSTFLDVYIERDIAAGALTEAQAQEMIDDLVIKLRIVRFLRTPEYDQLFSGDPTWVTESIGGMGQDGRTLVTKNSFRFLNTLYNLGPAPEPNLTVLWSVKFPQGFKNFCAKVSIDTSAIQYENDDLMLPYWGDDYGIACCVSAMKIGKQMQFFGARANLAKAMLYAINGGRDEKSGALVAHGFEPITSDVLTYDELMPKFEKMMDWLAATYVKALNCIHYMHDKYAYERIEMALHDRDIVRTMACGIAGLSVAADSLSAVKFAKVHIIRNEDGLAVDYKIEGDYPAYGNNDDRVDDIAVWLTQSFMDKIKAQPYFYRDSKPTQSVLTITSNVVYGKKTGNTPDGRRAGEPFSPGANPMNGRDVKGFVAAGASVAKLPYDSALDGISWTASATPDALGHTAEERILNLANCLDGFCSAHPTEFSSANCTPFDCEGERHIAGGGFHVNVNVFKRETLLDAMEHPELYPQLTIRVSGYAVNFIKLTREQQMDVINRTFHGKM

SEQ ID NO: 6041 - protein, 259 aa, Chromobacterium substugae
MIPPIAADHTEACVKAETIGYLHSTESGAGVDGPGMRFVFFTSGCQFRCLYCHNPDTWKLHNGRQVTVEQALSEVASYARFLKFAGGVTISGGEPLMQHEFVGELFHAIKQRFGLHTALDTQGFLHERVPDEWFDDVDLVMLDIKHSDPEKYLALTGQPLQPTLDFAQRLQRLGKKMWIRYVLVPGLTDGDADIERLADFVAALGEVVERVEVLPFHQLGKDKWAQLGMEYQLNDTPIPTAGQVAHARALFASRGMKVT

SEQ ID NO: 6042 - protein, 247 aa, Chromobacterium substugae
MDIVLEICAGSPASALAAQEGGAQRVELCDNLLEGGTTPSYGALALARDRLAIGLHALIRPRGGDFLYSELEFEQMARDIELCRRLGVDGVALGLLTADGDVDVERTRQLAGLAGPLAVTFHRAFDMARDPARALEDVIAAGCRRLLSSGQAPAAPQGAALLRALREQAGARLAVMPGAGVRADNIAALRRQTGCLEFHASARAAAASGMRHRQPGLSMGAPGADEYARQETSAQLVRELARQAAQA

SEQ ID NO: 6043 - protein, 396 aa, Chromobacterium substugae
MPRQILIAEDSPGQLQLLAELCRKLPDTEVFEASDGRWAMQIAQRHPQLDLVVTDLNMPGMDGIELAQALSHRIHLPALMFLSGDVPELLAGCSRAAEALGFSQIDSCAKPIDPDRLLARVHRLLQGCRPPSRPDIAIALTEIMTGLAHNQFCAFYQPIFNQQNHRAGQMEALARWRHPLHGLLGPQHFIDRLEHDGTIMLLTRRMAQTSLDLLSLNSWTGGMRVSINLSRSLLHDREFFDWLQQEVELRRIAPGQVVLEITETLAFNNLGNTLASLLRMRMRGFELSLDDYGAGNTTLEHVRDLPLTELKLDRSLILDIHRDRRSQGILASTVEMGRRLGLRMVAEGIDNPQDFAYLRQHYPDLEMQGFYLSRPMSAAELPLHLSWSPDGDSASA

SEQ ID NO: 6044 - protein, 557 aa, Chromobacterium substugae
MLARSPVRWFHIAALGPCLLLAAAPALAAEAAVAAPDAYGAAVAAQILKDGGNAVDAAVATAFALAVTYPEAGNIGGGGFMTLYQGGKPYFLDYRETAPRAASRDMYLDDKGQVTANLSLVGARAAGVPGTVMGMWQAHQRFGKLQWRQLLAPAINYAENGFTVAPRQYQYRDEAAQLFAGKTNFNRYFGSLKAGETFRQPELAATLKRIARYGAADFYQGETARLLVAQMKRDKGLVDADDLNGYRARWREPIRIDWRGNVVYTAPPPSSGGIALAQLLAIKQARAADFAGVAHNSARYIHLLAEIEKRVFADRADYLGDPDFSKVPTAQLTDAAYLQRRAAEINPRAISPTPDVKPGLESRQTTHFSIVDKWGNAVANTYTLNFDFGSGVVVQGAGFLLNDEMDDFSAKPGVANAFGVVGKDANAIQPGKRMLSSMAPTIVTRDGKVTLAIGTPGGSRIFTSIFQVLNNLYDFDMPLKQAVAAQRVHHQLLPKDTIFYDDYAPLTGAAASELKTMGYTLKDQGWRMGDIQAVRMNGDEAETASDPRGRGVGVVVK

SEQ ID NO: 6045 - protein, 144 aa, Chromobacterium substugae
MRYRTVLSDVADEAARAAIVAPLIAYNQAQAGAGNNRPLVITVEDEAGQVAGGLWGHTGFGWLYVQLLAAPAEARGQGLGRRLMEEAEAEARARGCVGAWVDTFTFQAPAFYESLGYRRFAELADYPPGHSRVFFHKRFDAEPG

SEQ ID NO: 6046 - protein, 549 aa, Chromobacterium substugae
MTHLLAQFSIRAKIFGLILLGIAAALIIGVNGITGASGMFQLTIDMHDNMLKPVYLLGQAGKQAAYVNRADYRYIAESEKSQMDQVQVNRDKFEANMKGFLDQYRKTELTPPEVDGLKRFDAAWDAMNAPCKKVRELSYTDTGNGENNKKALSIMAKECRPLFTAADDILKELSDINIKLADKALDDAQAQYQRVRSMAIGVLVVGLVLVTGLGLAIQNGIVGSLKSAGEAMVRIGNGDLNGEIRPQGKDEIAGMMQSLADTQQRLRKTVGDIMRAATNVAATSEQLAASTEQVSASIGQQVNATSSAAASIEELTVSIDLCSSNAGQANEQASQAGQQAKAGNRDVQDSTVQVKKVNESVSRSADSLESLSDQAQQIGSIATVIKDVADQTNLLALNAAIEAARAGEQGRGFAVVADEVRKLAERTTTSAQEITVMIGKIQDGARVAVDGMRGSRQIVSDVVVAAENASATISTVESSAAEVVGAIGEIASAMREQRQASTELASRVEAIAQMSKENGIAVDVFSQATRELAMVAEQLQQTTMAFKLD

SEQ ID NO: 6047 - protein, 248 aa, Chromobacterium substugae
MPPVTALIADDERLMREQLTMALARVWPELQVVAEARDGAEAVELARRHRPDLAFLDITMPVQSGLAAAVELDGACPVVFVTAYDQYAIKAFEEGAVDYLLKPVEDDRLERTRQRWQQRQIALPPQWQDTLRLLGRQLEKPNYLRWIRASVGNSLRMISIGEVLFFQSDEKYTRVQTVGCEALIRMPIKELLPQLDPEEFWQIHRATLVRVDAIDQVRRDERGLLLELRGHDQPLEVSRSYAHLFQRM

SEQ ID NO: 6048 - protein, 300 aa, Chromobacterium substugae
MNERAQAAPADGDSALRGIEHYWWLFVDQVARLGWGRLFIASLLVQTLGGILNVPLLTLTLVLVSVLVKILASGKRQAEQIADRAIARSERAEQQAELEALQRQLAETRMGALQAQIEPHFLFNTLSSVCQLMETAPERALSMQKALIRYLRSSLPEWRESPGETSLGQQLELSRAFLDIMQLRMEERLQVRLEVPETLLQARFPVMMLQTLVENAIKHGLEPKAEGGFVEVRAKVLDGKLRLTVCDDGVGFPDEPGQGMGLANIRERLALRYGAEAELLLEVRPEGGTRATIALPFVLA

SEQ ID NO: 6049 - protein, 79 aa, Chromobacterium substugae
MAKPMLHAAGAALRCGWEHLAGYAARTGWGRLLLTALLVQILGGMLRVPALTLILILATLLAKLQAGKNEQSKQEAHHE

SEQ ID NO: 6050 - protein, 87 aa, Chromobacterium substugae
MNYQTIAALLDSLIQLCHHMPLYFTQGLDWLSQLEWGRFTLFALLASLAGGALIVPVVLAWQALDYCAAKPLARLHRLSQHKEAHHG

SEQ ID NO: 6051 - protein, 172 aa, Chromobacterium substugae
MTTTFPASRHGLLDTRFGPAAAWLNADGALLRLLFNPTPQQLAEHACRRDDGALREVARQLAEYQAGERQSFELALAPAGTPFQQQVWAALRRIPYGRTVSYGELALLLDLPGGARAVGRANATNPIALIVPCHRVLGADGSLTGYAGGLPLKAALLRFELERSAPPGLFAD

SEQ ID NO: 6052 - protein, 403 aa, Chromobacterium substugae
MNDTKSAALAAESPPADDPSRSRALLAASSAHAAHDGLTDLVYVLLPLWQAQFGISYAQVGLLRGAYSGMMAGFQLLASRAAARWGRKRLLAAGTALAGIAYLVAGQAGGLAVLLAALLLGGLGASVQHPLASAMVADSHEAGGGVKQALAQYNFAGDIGKTLIPALAGLLLTVASWRAVVSLAGLLGLAAAAALWRLIPARLDAARREAKAAAPAAGQGSAGAMRALLFTGVLDSAARMGFLTFLPFLLKSKGAGSAGIGLALALLFVGGAFGKLFCGYLGARIGMVRTVWLTETATALLIALAVALPLFGAMAILPLLGLALNGTSSVLYGAVPELAGAGSRRDQAFALFYTGTIGGGALSPVLFGRLGDAVGVPVASLWLAALLLLTLPLAWRAGKGLRA

SEQ ID NO: 6053 - protein, 116 aa, Chromobacterium substugae
MAADAVIALVALLHGYFLVLEMFLWDKPLGMKTFRLTPERARDTKVLAANQGLYNGFLAAGLAWGLWLGAGGFQIKLFFLACVLAAGAFGAATVNRRILLVQGLPAALGIALLWLA

SEQ ID NO: 6054 - protein, 61 aa, Chromobacterium substugae
MPLEEIASVSLRRGRRLFGLFSFGRWLVAESRGGKFYLEPTLEYKTEDLERLVARICQFIA

SEQ ID NO: 6055 - protein, 302 aa, Chromobacterium substugae
MKPALGQVSDFDIRLLRLFRAVAECGGFSAAEGVLGISRSAISLQMGDLEKRLGIRLCQRGRAGFALTDEGREVLRASHTLLAALEDFRGEVNLLHRQLRGELNIGIVNNLVTLPRMRVTGALKALSEQGPEVKISIGMMTPSDIETGLLDGQLHAGVVPLIQPLSGLDYLPLYDERSQLYCSREHPLFSRPDNDLSEVDLAAANAVAPGYRLPPQAQALQQRLRAAATASDREGIAFLILSGRYIGYLPDHFAAGWVAQGQMRPLLPDICHYDAPLALAVRKGRRANLVLERFLQELEHTS

SEQ ID NO: 6056 - protein, 39 aa, Chromobacterium substugae
MGKFGTGGERVHVRHLWREYGHSMPRTLRELNAIFLMFR

SEQ ID NO: 6057 - protein, 445 aa, Chromobacterium substugae
MNPLTTRSEFSHLDLRAHWMPFSANRNFQRDPRLIVAGEGNYLVDDQGRRIFDSLSGLWCCGAGHSRKEIAEAVYRQLSTLDYSPGFQFGHPLSFRLAERVAAMAPGALNHVFFTNSGSECADTAVKMARAYWRLKGQASKTKLIGRARGYHGVNIAGTSLGGMNGNRKLFGPLMDADHLPHTLLPANAFSRGLPAQGAELADDLLRLIELHDASNIAAVIVEPMAGSAGVIVPPQGYLQRLREICTQHGILLIFDEVITGFGRTGKLFGADYFGVTPDIMNVAKQLTNGAVPMGAVVATSEIYEAFMAQATPEYAVEFAHGYTYSAHPVACAAALAALDVLENENLVARAAELAPHFERGIHGLKGLPHVIDIRNCGLAGAVQIAPRGGDAIVRPYEAAMALWRKGFYVRYGGDALQFGPPFTTTPQELDSLFDAVGETLTKLA

SEQ ID NO: 6058 - protein, 506 aa, Chromobacterium substugae
MSPIKRDPEMTTLQHLIHGEACDGGSRRAPIFNPSTGQAIADVQLADAATVAQAVAAAQAAFPAWRDMPPAKRAQVLFRFKQLLEQHEAEIVPLISREHGKTLEDAAGELKRGIENVEYACAAPALLKGEYSRNAGPNVDAWSDFQPLGVVAGITPFNFPAMVPLWMYPLAIACGNTFILKPSERDPSSTLLIARLLHEAGLPRGVLNVVHGDKEAVDALLAAPEVKAVSFVGSTPIAEYIYAEGSRRGKRVQALGGAKNHAVVLPDADLDNTANALMGAAYGSCGERCMAISVAVCVGDQAADALIAKLTPQIQALKVGPGTSPGLDMGPLVTHAHLDKVSGYIADGVAAGAELVVDGRGIAVPGHEGGFFLGGCLFDRVTPQMRIYQEEIFGPVLCVVRVNSLEEAIALINAHEYGNGTCIFTRDGEAARLFADTVEVGMVGINVPLPVPVAYHSFGGWKRSLFGDLHAYGPDGVRFYTRRKAITQRWPQRASHEASQFAFPSL

SEQ ID NO: 6059 - protein, 190 aa, Chromobacterium substugae
MKLSASATIVSSPWSIRRLSAADIGADWLDDFQRRQEVTLVYRGAPGERRIVAEPFIDDWSADERRALCRELAAMADAGRVWSAMEGERLAGFAAIAPAPLGPDGEYRQLTELQVDARWRGRGLGRELMAACVAGGREMGAGRLYISSHSAIETVSFYERCGCVPARWLHVPQIEREPFDWQLEYDLARQ

SEQ ID NO: 6060 - protein, 147 aa, Chromobacterium substugae
MPNTIRLHRVLNAPPERVYRAFIDPLALAKWLPPDGFVCQVLEQDATVGGGYRMAFVNFSGGQQHEFGGRYLELIPGERVRYSDRFDDPNLAGEMTTTITLAPLSCGADLTIVQQGIPDAIPPENCYLGWQQSLRQLAALVEPDIPG

SEQ ID NO: 6061 - protein, 373 aa, Chromobacterium substugae
MKALGKKAAGARLERMRASPMWADDGFRNIYPIAPGLRDPAVKMPSLKDFLCGGERRTPNGPLPVADPRHAWRKPPESGLRATWLGHSTVLLEIDGLRVLTDPVWGPRASPTRLAGPKRFQPAPVRLKELPPLDLVLVSHDHYDHLDYPTIRELAKTPVPFVTSLGVGAHLEAFGVAPQRITELDWWESYRHPSADLTVTATPSQHFSGRGLKDRNATLWSSLAIRTPRHSVFFSGDTGLTGQFEEIRERIGAFDLVMLEVGAYHPAWGDIHLGPDNALKALELLGGGAFLPVHWGTFNLAMHAWDEPADTLLALSEQSNVQLLMPRQGQALEPAHADRTEPWWRAVDTVAAPAVPASDAAADQAKTIPWPLD

SEQ ID NO: 6062 - protein, 183 aa, Chromobacterium substugae
MDEVLLQLCRQEGLPDHAVLDMRVVQRQRYPRASLLYWAVVDFSLPSTEARLFVFDTLEGSVQRFLVAHGRGEDPAGHAHYAQHFSDAPGSLASCLGVCRAADTCFGPHGLALWLDGMGPDNANMRARRLTLHGAQYVAPDYIRQHGAPGCSDGSLAIDPQYSVGLINMLQGGSYINCIRSRI

SEQ ID NO: 6063 - protein, 327 aa, Chromobacterium substugae
MRAIVRQQYGGPEQLRIQDIPAPQAGADEVLVRVRAFGLNRAEQYFRQGLWGEVAAVSGIECAGEVAHDPGGVLPPGQTVIALMGGMGRSRNGSYAEFVSVPAANVVPVRTTLDWSALAALPESYATAWTCLHGNLALQNGDTLLIRGALSALGQAAMALAKLHGARVIATVSQASRLQAARQLGADIARVESAELGAELAEIAGCSMDKVLDLVGTSTLLDSLRLAKRDGRVCVAGFLGGHEPLAGFDPMAHLPSGRQLSFFASALVFGSRDYPLGDIPFQNIIEWAESGAIPARPARVFAFEQIQEAHSVLDAQSAGGKIVVTLD

SEQ ID NO: 6064 - protein, 302 aa, Chromobacterium substugae
MDFTLHELVCLDAVLREGSFQAAALKLHRSHPAVHAAIKNLEARLGLSLLDRASYRVRLTPQGEAFHRQAQALLAQAASLGTMCGQLRSGEETDLRVVVGDLTPNAEALDLLRRFFRNWPHTRLHLHFEAISGPWERLLAEDADLILHHVDKSDTRFEWTDVCRVELVPVAAPGFLDGPISRDVSPEQMARHVQVVIRDSAQAPGRDYFVVKEAPSWTVADQYTKKDLIVRGMGWGHMPLHLVAEELRSGALLSLEGRHFRRSALDIVAARLRGRPAGPVASALWSFLAAEGEGRPGGAQLR

SEQ ID NO: 6065 - protein, 311 aa, Chromobacterium substugae
MACPYFLFHPLSYSLFMNAKTCRLLALILQACCGLRAMAETEIVYPAPESPRDVRHADILELLNGALAHTDKRYGPALARPSLEPMNKNRQLLSLTQGQGLTLMWGSISRELQQKTLPVYIPLRKGLLGYRIALIRRDRQDEFNRTASLADLKKFSLGQGRGWADVDILRGAGFHVITNEYPQLFGMIEARRIDLFPRGINEVYAEYAAHRDQTPSLAVEAHLALHYANPYYFYVAKDNAALAQRLEQGLRLMMRDGSFDEIFWRYNGQAIRQADLAHRGIIEIPSDDTLTPRKVLKDSQLWFDPRGAAYR

SEQ ID NO: 6066 - protein, 332 aa, Chromobacterium substugae
MPQLRQLKAIAAAVAISAATLLSATSSLAAAPQIHAQAPGYYRMMLGRFEITALSDGTVKVPLDKLLHGESPEQIRQQLENGFQTPGHAETSINAFLINTGSKLLLVDSGAGDLFGPSAGKLPANIRAAGYRLEDIDAVLLTHVHLDHSGGLTVAGKAVFPNADVYLNQKEEDFWLNPANRAKVAPAQPSGFDQSKGFAQAQASLAPYLAAHRVKAFAAGAELFPGIRAIAAPGHTPGHTFYEAQSQGQRMQFWGDTVHAQVVQFSQPQVNIDFDVDSSGAVKLRRHAFADAAAHGYWVAAAHISFPGIGHVRRDAKAYAWIPANYSEDMGN

SEQ ID NO: 6067 - protein, 308 aa, Chromobacterium substugae
MTISERDFRAVDLNLLVTFLVLMRERSVSRAAERLFIGQPAVSGALARLRSLFDDELLVRGAGGMEPTARALRLEAELLPALQDVQAALFHSERFDPAGAERAFTLAMPDWVEVWLMPRVFAELRRQAPRVRVAVKATDPFQGAAMLERHEMELGVATLPDKPAWLRSVPLARMGFSCVHHGKRLPLAGPLTLRDYVAHPHVLVTYRGAFRSGIDQLLEARGLRRQVQYTTQQFSTLPSLLREVAALSSVPAALADHWAYCQDLHAHPLPLPSPEIELSMFWHAAKDKDPALEWLRGVVAEAARTPLV

SEQ ID NO: 6068 - protein, 92 aa, Chromobacterium substugae
MNAWMVIAVLPIGAASFYFLAYQPAAQKYWLRFPTLEKYRQDHPASHSHGVPHCHVCGGSDILSVGLLRPVEYRRIYQCAQCQTKLWRAMEP

SEQ ID NO: 6069 - protein, 951 aa, Chromobacterium substugae
MQQENIAAMAEQDISREVLLEKYAKNGEQSVSEVRRRVARALAGLEHDPARFEPLFFEALDHGFIPGGRINSAAGTELSATLINCFVQPVGDSVSETEHGKAGIYQALLQAAETMRRGGGVGYNFSRIRPRGAHVKGTNSRASGPVSYMRVFDRSCETVESAGARRGAQMGVLDVSHPDVEAFIHAKDQGDLRNFNISVGVSDAFMQAVEADADWQLTHAVEPASDAFPDSFRREDGLWVYRTVRARALWRQIMESTYDHAEPGVLFMTRINQDNNLSYCEVIESTNPCGEQPLPDYGCCDLGSVNLTRHVRAPFGDKAHFDFKSFEKVVRMSIRMLDNVLDLTVWPLPEQEREAQNKRRVGLGFTGLGDALIMLKIRYDSEEGRRFAARIAQSMRDAAYDASVDLAIEKGAFPLFDADAYLAAPHCASRLPDKIQARIRKHGIRNSHLLSIAPTGTISLAFADNASNGIEPPFSWFYTRKKRMADDTQQEYLVEDHAYRVWRMQGGDTARLPDYFVSALEMSALDHMRMVAAVAPFVDTAISKTVNVPADYPFADFESLYLEAWRNGLKGITTYRPNNVLGSVLSLEPAQAAAAAPEDLSGAANDPDRRVVLNTAPTPALSSLKWPNRPKLKEGNPSWTFMVEGDAGDFAVVVGHMENGRVQPFECWVNATEVQRGLSAIAKTLSMDMRCRDRAWLAAKLDALSRTNGDKRYQFTLGDKAIHATSAAAALGQVVRHRVEQLGALRLDAGEATPVMDALFARKEPKSGSDGTMSWSVDVVNPQTGDDFVLFIKELILPNGKRRPYSVWLAGAYPRELDGLCKMLSLDMRVIDPAWIGLKLRKLLNYAEPQGDFFARIPGLEKSQSWPSTVAYLARLIIHRYAMLGVLTEEGVPLEEMGVMAPEQSDLFALEAPAQLKPLAGKACPECGNHALIKKDGCEFCTACGHVGACG

SEQ ID NO: 6070 - protein, 1070 aa, Chromobacterium substugae
MAFWAFLGLAGPRLLQKAAADWAGKHGRQLSIQQVRITPWSMELALDGVALREGDGRPLFLARRLYLNADLYALLLGRWQASEFTLDSPQLWLERGADGMWNWEKLAADLSGPPKLEDGTAPEKLPRLKIAALNLRSGQIRLSDHNDGQHERFRLMPINLNLADLSTLAENGRYALHAELQGGGRFDWKGSMRLQPLQSSGEASMQDLPLATVWDYVHPYFATAKPQGALSVNARYQFEMNGSRPDLTVSPIRASLKDLKLAAPGGASELSLPELTVEGGALDLSRSLLTIAKVELNHGRVSAGRGADGMVDWLRALPAAPAAAKPVQAAKPSPWLVKVDSLRLNQWHAQWRDDVFVKPMALQADMPRMQARISLSPEHGLQLGDLGLSLAGVKLGSAGAPDWLTLDGAELAPSQIDLKQQQLKPGDLTLRGLQVALQRERNGQLQLQQLLAQRPPKAAKAKADGDAKTPAWKFSYPAIRLEDSRMNWRDLTLAKPLALSMDQLSGQLATRDGQQLALDIAGRMGGGKLAAKLDLNPDKLAARGSVKLDALPIAPLAPYALAGTPLKLSGGALSADLQLDAASASQWKLAGQLKLAKMALQEPGEALPLLGWNSLSLSRLQVQGMPLKASINDVRLDQPRARLILDPQRRLNWQKIFAGAPAAKPAQPAGKSAPLPQVDVHSIHVQNGAVEFADHGMTPDFATRMHHLRGSIQNLSTRAGGRGRITLDGAVDQYGEVKVRGALSPTSPTDSTDIHLDFHNLALNNLNPYSMNFAGWQVKDGRLSLELRYLLEHRQLKGENRIVIDSIQLGEELQGDKSPHLPLRLAVALLEDSNGRIDLDLPVAGSLDDPQFSYGQVVWKALVNIVTKVVTAPFRALGALLGGDGFDDIRFVAGEAHVSPPEREKLDKVAALMAKRPKMQLAISGGYAPDEDSKQLARARVDAAVLAAAGHAPMDDEPLASLDLKDAQIQSAIKTVYGQRIGRLKLLGHTLKPGGPSGAELAKLLRDEMLAAEKVSQADLVKLAELRGANARKVMLRHAPDLAERVTLDAPQKTSANRDGVELAVKITAK

SEQ ID NO: 6071 - protein, 53 aa, Chromobacterium substugae
MQQSYRPRRSFILFSTDAATPLLADRCLFLLQAGRRHTLANPARLLGSSGTHT

SEQ ID NO: 6072 - protein, 446 aa, Chromobacterium substugae
MDSANAINQWLDEHHITEVECLIPDMTGLARGKIVPRHKYNPAEGLRLPEAVLSMTVTGDYPDRDFTSVADPDMKLIPDASTLRPVPWNKEPTAQIIHDCYSFAGDAVDLAPRNVLKRILKLYEDKGWKAVIAPEMEFYLVEIQPDEDLPLRPPVGRTRRTEAGMQSFSIDAVNEYDDIFDVMYDWCEAQGLALDTLIHEMGTAQMEINLDHGDPLQLADQVFLFKRTVREVAIRNNMYATFMAKPMQGQPGSAMHMHQSVVDIASGRNIFSLQDGGPSPDFLHFIGGLQRYLPAAMPFFAPYVNSYRRLSRYTSAPINLSWGYDNRTCGLRVPHSGPEARRVENRLAGVDVNPYLAMAASLACGYLGMREGIQPSEPLTGSAYEQPHQLPRHLDDAIDMLLRCKPLAELFGEHFVETYAAIKEVEYREYFDVISPWERRFLLLHV

SEQ ID NO: 6073 - protein, 66 aa, Chromobacterium substugae
MAFMQGFETISTNFRKMSEQIITTIVRRDKTKTFCVVEKLNGTRFHNALLVFVKGNKIAKSMIIKE

SEQ ID NO: 6074 - protein, 365 aa, Chromobacterium substugae
MNRRRFLRHASLLSGSALLLGGALAAPPRPAQSGWRIPDEGEPHAATWMAFGARADIWGERLLGPVRQNLAGIARAISAFEPVAMLAPKDSLELARQLCGDGVRLIEQPLDDLWMRDTGPVFVKDAQGRAAGVGFHFNGWGGKQAHGRDARVAAAVCAQSGRPLLSSRLVLEGGGIEVDGQGTAIITESCVLNPNRNPGLGKAACEAELKRLLGVDKVIWLPGVAGRDITDGHTDFYARFAAPGVVVAGLDSDPSSYDYAVTRRHLAILRTARDARGRPLEVVELEGPSSVRPRFENREFAAGYVNFYICNGAVIAPQFGDSRADANCRAILRELFPGREVVQLDIDAVAAGGGGIHCTTQQQPA

SEQ ID NO: 6075 - protein, 296 aa, Chromobacterium substugae
MRTPSLKLLLGFEAAARHGNFSRAADELCLSQSAISHQVQQLEAQLGQPLFRRVGRGVELTVAGEVLQQSVRRALDNLQGGLGRIAGYMDPGLVVLVCPAGLAHGWLQPRLADLQRRLPQLSLLLSTDESARFIDEIDVDIVIADRPLQQAGVAERPWLRDEWVVAAAPELARRLEAAPIERHPELAGLLCLEDGFTDARAGGLFRGHLAGFRRAGVYDDARLLLDAALRGQGAACLPALLADEALADGRLRRLAGYPAAAGAQYWLARADGEPRAAIVAAVADWLLAKAGLAASV

SEQ ID NO: 6076 - protein, 461 aa, Chromobacterium substugae
MNKTGQLSQRFRHAIEQGHLRAGDRMPSLRKVCQDHKISITTAQRAYAELEKLGLIESLPRSGFRVLARSAVLPSNLPLQSDGSGIRIEHLTSALPMPWGCPYMNPALINTTPLNRALTRALRDYRYALSGNGSTGYEGLRRELTLRYLAQGVELDGDELLVTCGGMEALNLAIRAVTKLSGSAAMLVLTPAFPALFDQLEQLGIAAHTLATPPGQALDLERLEQLIVQHQPAGILAMANFQHPTGLTMSDHDKAALLALADRHRLPIIEDDTYRELYFGESAPLPLKAYDQKGSVLYCSSFSKSLAPGYRVGWIAAGRYRDSILGLKLCSSLSTPLPSQMALSRLLAGGHHEDMLSLLRSRLQANWLAMRQQLDSHMPAGSRQIAPQGGYFLWLELPEGTDCRRRLAQAMQQGIHFAPAPLFFQDNQPRLNAMRLNFSFYDPLQQHNGVAMLAEALAALD

SEQ ID NO: 6077 - protein, 449 aa, Chromobacterium substugae
MAAMSKLETKPIKIYPRLTSGRFNTLRVSMVALTQLVFFGLPWLQWNGRQAVHFNLAEHHFLIFGISLWPQDFIYLAALLVVCALGLFLWTTLAGRLWCGYSCPQTVYTQIMIWIERLVQGDHNARRKLDAAPMSAGKFAKKGLTQLLMGAFSLWTGLTFVGYFTPMRELATLNMGPWDLFWTLFYAGFTWLLAGVLREKVCLHMCPYARFQGAMFDDHTLVISYDARRGEPRGKQQARSEAKTKGCIDCGICVQVCPTGIDIRNGLQYECIGCAACIDACDQVMDKIQAPRGLISYTSAQAQQGQPAPAKSLHRPRIVVYSCLLAGIITLSTTALALKKPFKVDVLRDRASLVEQTDDGLLQNRYNLRLINTTEQTQRYSLAVEGLPGIRLDQPDQIIAVKPAQTETVAVRVQADPEHAGRGAHPIHFVIRSLGDDVTIKEKSSFIGE

SEQ ID NO: 6078 - protein, 42 aa, Chromobacterium substugae
MKFPLRSKPYAAQIYHARHPGRRAGKRPQPAKPLQEAVPRQA

SEQ ID NO: 6079 - protein, 179 aa, Chromobacterium substugae
MIYINDQPAPGQDGVEDADQQPAFFAVSPQKLFVMSLSTLGMYQVYWMYRHWQRVKQREGSDIWPFWRALFGYFFCYALFRRIHDDCERASVEGLAAGPLAAGWVVICLLWKLPEPYWLVSHAAILLLLPVQAAACRANEALAPGHARNDGYSGWNIAAIVLGGILWLLAIYGMFFIKN

SEQ ID NO: 6080 - protein, 72 aa, Chromobacterium substugae
MLYFMLPTAMFLALFPSCLAGWLFTRVIRKVIAGSGYERARAVAPRTGGLCSLLAVWGAADFCSASVEAAVT

SEQ ID NO: 6081 - protein, 221 aa, Chromobacterium substugae
MKKMILACSLLLAFGVAQAQPYGHFDMRQMLMPHAEGDASYRLNLEYLDRVLDDLAGHARNYPPAFDSQGDKRQALNDAKKLSDMLEIVAGGGQADTELLMRAGFLNSMAYNLDVPKSGGRAQAAFAAVLQREPDNANAHYLYGSFLAGMGHAKEALPHLDRAVELGQQEALYSLGMAYLALGDKAAALRELEAYQAGHPNDRSVGGLIEAVRSGAGSVQR

SEQ ID NO: 6082 - protein, 446 aa, Chromobacterium substugae
MFNQKLKSDLSHALSQLEGQKSVLDALDRSTAIIEFSPDGIILAANANFEQTMGYAAAEIIGKHHRMFCPPQLAASQEYLAFWQMLREGRFVKDQFRRIAKDGRTVWLEASYNPIRDHNNQVVKVVKFALDITHEVKIAHEASNTMKAVGRSMAVIEFTPDGVILAANANFLAATGYSADEIVDKHHRILCPADFVNSPAYEELWRTLKQGVFVTGRFERRHKSGRPVWLEASYNPIFDDDGAVCKVIKFATDISDQETARQEDLRLVQEAHRLSAASDSASNDGQQVIRDTIRAMNVIADSAGKSARLIEDLEQKTGRITTIVNTIHEIADQTNLLALNAAIEAARAGEQGRGFAVVADEVRKLAERTSASTKEVTEMIDDIKTGTGSATDSIHEMLVKAQLGEEHASVASTSIDEIRASTSQLADVVNHFSAVQANSTHPPRGS

SEQ ID NO: 6083 - protein, 209 aa, Chromobacterium substugae
MEIEIAKIFIALLVLVNPLGAIPIFISLTPNASQEERQKIAKTTAIAVAVVLCLFALVGQTLLRFLGISIGSFQVGGGILLMLIAIALMNAKPGPTKTTKQEREEAGHKTNIAVVPMAIPLMTGPGTISTVIIYATTAHSWVQVVYLLISGLLVAITCYGALVLASPLTRLLGQTGINIVNRVMGMLLAAVSVEIIVDGVYRLFPQLTR

SEQ ID NO: 6084 - protein, 377 aa, Chromobacterium substugae
MSATLDLARELIRRDSVTPRDEGCQALMIDRLEAIGFKVEKMRHGDVDNFWARRGGAGPLFCFAGHTDVVPTGPLEKWDSPPFEPTVRNGLLYGRGAADMKASLAAFVTACERFVAAHPDHEGSLALLITSDEEGVAVDGTVKVVDALEARGETIDYCIVGEPTSEQRLGDTIKNGRRGSLSGRLVVHGIQGHIAYPQLAKNPIHLMAPALAELAATRWDEGNDFFPPTSWQVSNIQAGTGATNVIPGHCELLFNFRFSPESPADSLKERVCQILDKHGLGYELHWQLSGQPFITPPGALTEALSAAIAEVAGSKAELSTTGGTSDGRFIKRIARELVEFGPINATIHKLNECVEVADVEPLSDIYRRTLELLLAKA

SEQ ID NO: 6085 - protein, 116 aa, Chromobacterium substugae
MITLYGIPNCSTVKKARQWLADNGIDYTFHDFKKQGIDAERLSAWAEQVPLAKLVNRQGTTWRALPDAAKTAADTRDGAIALMREQTSVIKRPVLEWDGKVGVGFSEADWAERFGK

SEQ ID NO: 6086 - protein, 376 aa, Chromobacterium substugae
MLMLPFFKLMAERKASDLFMTSFSPPMLKLDGDLQPVNDKPLTADMVKQLAYSLMSEEEIAVFEREREMNLGHPVPGLGSFRVNIFWQRGSVGMVVRYILPSIPSLEQLQLPPMLASLIQQKRGLILVVGSTGSGKSSTVAAMLQTRNQTMKGHILTVEDPIEFLYRHDKSIVNQREVGFDTLSYARALKNAMREAPDVLMIGEIRDAETLGHAITYAQSGHLCISTLHGNNSYHMLNRVINFFPPESRNTLLMDLSASLRAVVSQRLIATLDGGRVPAIELMINTPHISELIRTGEIDKIKEAIESSMSDGSQTFEQALFQLYKAGRVSLDEALKNADSPTNLYWLVNQSKEGAADKNKSGPDSAASFDSIKLDL

SEQ ID NO: 6087 - protein, 559 aa, Chromobacterium substugae
MDKVWLKNYQAGVAHEIDINQFQSVTEVFDRSVKKFSDRPALACMGKVLSYAELDALSGQFASFLQHKLGLAKGDRVAVMMPNLLQYPLAVFGTLRAGGIVVNVNPLYTPRELEHQLKDSGAETIVILENFAGVLEQVLPRTRVKNVVIASIGDMLGFAKGALVNFVVRKVKKMVPPWHIPGHIRFNDALSAGAAKPYVKPALTHDDIAFLQYTGGTTGVAKGAELLHKNIVANMLQANAWVKPLIREGQEVIVTALPLYHIFSLTANLMVFTNMGALNLLITNPRDIPGFIKEMKKYPVTCITGVNTLFNALLNHPEFSKLDFSTWRLTLGGGMAVQKAVADKWKAVTGVTLAEAYGLTETSPAACINPMDLKEYNGTIGLPISSTDIEIRDAEGKPVAQGEQGELCIRGPQVMRGYWQRPDETAKVLGADGFLATGDMAMVTPEGFVKLVDRKKDMILVSGFNVYPNEIEDVVASHPDVLEVACIGVPDDKSGEVVKVFVVKKNPALTDKDIIRHCRENLTGYKVPKLVEFRSELPKTNVGKILRRALRDQETAKPA

SEQ ID NO: 6088 - protein, 141 aa, Chromobacterium substugae
MDVRLLLESTLQGFGYELVDFEITPGGGFRVFIDKPGGITVEDCVLVSNHLTRLFMVENVDYERLEVSSPGLDRPLKKEADFVRFAGQLAKIKTRMPIEQQKKFTGRLAGVEDGSVKLEVDGRIVAIPFANIDKARIEPEF

SEQ ID NO: 6089 - protein, 492 aa, Chromobacterium substugae
MSREILLLVDALASEKNVSKDVVFSALEMALASATKKKFTDDEMDVRVEIDRHTGQHQTFRRWTVVEDDLLESESKEIGLTDARERDPRVEVGAVIEDAMEAVEFGRIGAQTAKQVILQRIRDAEREQLLNEFLQRREHLVIGTIKRIERGNAIVECGKLEAVLPRDQMIPKENLRVGDRVKSYLLRIDRQGRGPQLILSRTAPEFLTKLFELEVPEIDEGMLEIRAAVRDPGMRAKIAVKANDARIDPQGTCIGMRGSRVQAVTQELAGERVDIVLWAPEPAQFVINALSPAEVSRIMVDEDNHSMDVIVEEEQLALAIGRSGQNVKLAAELTGWYLNIMTVAEAEEKNQAEDAALRQLFVTALSVDEETAAKLVGEGFAALEEVAYVPLEEMLEIEGFNEELVGELRSRARDALLTQAIASEEQVENVSDDLKDVEGLDAELVRKLAAGGVSTRDDLADLAVDDLVDMTGMEAEAARAIIMKAREHWFNQ

SEQ ID NO: 6090 - protein, 926 aa, Chromobacterium substugae
MVLTNVKQFAGEMNLTPERLLEQLKAAGVSKRSPEDTLSAQDKSQLLDYLKRSHGAREDSNITLTRKSTSEVKKADGGTVTVETRKKRVVVRPEEAPKAAAPVEAKIEQPKVEPKVEAKPEPKPEPKPEPKVEAKPEPKPEPKVEPKPEPKPAPAARTVASILSPEEIAAREAEEKRQAAFRARQQELMREKIEREERRQAAKLAASQPAPVVEAPRAPEPQREQRDERGPRPAAGDNRGPRPAGDNRGPRPAGDNRGPRPATAGAPGAPAIPATVAGRPDAKKGGNKKGGDRWDDNKKGGRGGLKTKGGDAGNDWKSRGGKGKHKQSNNQHAFQAPTEPIVHEVLVPETITVAELAHRMAVKAVEVIKALMKMGMMVTINQVLDQETAMIVVEEMGHKPKAAQADDPEAYLEVTDGEAVEVVELPRSPVVTVMGHVDHGKTSLLDYIRRAKVAAGEAGGITQHIGAYHVETPRGMITFLDTPGHEAFTAMRARGAKATDIVVLVVAADDGVMPQTIEAIHHAKAAKVPMVVAVNKIDKVGANVERIRQELVSHEVVPEDWGGDTQFIEVSAKMGTNIDALLEAILLQAEVLELKAPVDAMAKGIIVEARLDKGRGPVATLLVQSGTLKKGDVVLAGTAFGRVRAMMDENGKPIESAGPAIPVEILGLSDVPQAGEDTMVLADEKKAREIALFRAGKFRDVRLAKQQASKLENMFAQMTEGEVQTLSLIIKADVQGSYEALAGSLQKLSTDEVRVSILHSGVGGISESDINLAIASKAIVIGFNTRSDAAARKLAENEGVDIRYYSIIYDAVDEVKAALSGMLAPEKKEQILGTVEIRQVISVSKVGNIAGCMVTDGMIKRTASVRLIRNHVVVHTGELESLKRFKDDVKEVRQGYECGLMLKNFNDIQEGDQLEAFEIVEVARSL

SEQ ID NO: 6091 - protein, 138 aa, Chromobacterium substugae
MAKAKKGFSRADRVSEQIQRELAELTRTGLKDPRAGWITITQVEVTRDYSHAKVYYTVMVESTRAATQEALESSAGYLRNELGRSIKMFSMPQLHFVYDESVERGMHLTSLINQVAREDAEKFGTAAPGEEAGEGDKE

SEQ ID NO: 6092 - protein, 307 aa, Chromobacterium substugae
MSKPRSTKRQIDGVLLIDKPYDISSNNALQKARWLLNAAKAGHTGVLDPLATGLLPVCLGEATKFSSYLLDADKGYRATVKFGAVTTTGDVEGEVVSERPVSFSREQLEAALASFRGEISQVPPMYSALKHQGKPLYEYARAGIEVPREARRVTIRKLELLAFDGVSAEIDVLCTKGTYIRTLACDIGEALGSGAHLTALRRTATGGFGLDEAHTLAALEALEMAGREALLLPADVLVQHFPETELADGEIGKFMNGQAVLFAEKCEKMQRFRVYQKSTRRFMGLGEARDDGRLHPIRLLANQAATS

SEQ ID NO: 6093 - protein, 89 aa, Chromobacterium substugae
MAMTAEQKAEIVKSFQRAEGDTGSSEVQVALLTARINDLTPHFKANTKDHHSRRGLLKMVSRRRRLLDYLKTTDADAYRALIARLGLRK

SEQ ID NO: 6094 - protein, 714 aa, Chromobacterium substugae
MFNKITKSFQYGRHTVTLETGEVARQASGSVIVSVDDTVVLVTVVGGKSVKPGQDFFPLTVDYLERTYAAGKIPGGFFKREGKQSEKEVLTSRLIDRPIRPLFPEGFYHDVQIVATVMSLNPEVDSDIPAMIGASAALAISGLPFAGPIGAARVGYADGEYILNPTKTELQSSQMDLVVAGTQRAVLMVESEAKELSEAVMLGAVVFGHEQMQAAIKAINELADEVNPVMFDWAAPVANEELIAQVRGIAGAKLADAFRLRQKQARTVVINEAWAEVKAALINETTDTLVANEIKGIFKGLEAEIVRGQILAGEARIDGRDTRTVRPIRISNNVLPRTHGSALFTRGETQAMVVTTLGTKQDEQIIDALAGEYTERFMLHYNFPPYSTGEAGRMGPPKRREIGHGRLAKRALVAVLPPEDEFGYSMRVVSEITESNGSSSMASVCGGCLSLLSAGVPLKAHVAGIAMGLILEGNRFAVLTDILGDEDHLGDMDFKVAGSASGITALQMDIKIQGITKEIMQVALDQAKEGRLHILGLMKEAVDGPQELSAHAPRLYVMKINPEKIREVIGKGGETIRSITKDTGCEINIEEDGTITIASISNEGAEAAKKRIEEITVEVEVGKVYEGTVVKILDNNVGAIVSILPGKDGLVHISQIANERIKNVADYLKEGQVVKVKAIEMDDRGRIRLSIKALLEEEAKTAQATADSFGLKTQ

SEQ ID NO: 6095 - protein, 60 aa, Chromobacterium substugae
MDVAEPEKYLRELGLFKQMLARISWKTRGSPIYISASMGFDELTTVFEQYYAAYGAPSRR

SEQ ID NO: 6096 - protein, 108 aa, Chromobacterium substugae
MRIIVFVPGVVFAWCFYGFVLFVIGIGYMNPRLPQYYGAISLFTQFLPLLVSIGSWLVWILTLRLRWLKRCVAALALLAAGTVFLQQIQHYLPPGPDREQAQLQQMEP

SEQ ID NO: 6097 - protein, 372 aa, Chromobacterium substugae
MENIMTTLARPEHGLLAPEHGHASPPSSQADYRSMASPAELLRSLPASARASASVHAGRDAVKKVLNGSDPRWLVVVGPCSIHDPRAGLDYAARLAELAAELDDTLLIVMRAYFEKPRTSVGWKGLINDPYMDDSYCVDEGMHIARRFLLAAAELGLPLAGEALDPLSPLYLADLYSWTAIGARTTESQIHRELASALDSAVGFKNSTDGTLDAALNAIVSASAPHAYLGMGKDGRVAVVNSRGNPHCHLVLRGGGGRPNYDSVSIALAEQAMKKHDIPPAIMVDCAHANSWKQHTLQPRVLADAVSQIRHGNRSIRAFMLESFIEPGNQPIPANLAELRYGCSVTDPCVDWNTTADILRDARAKLRPLLKH

SEQ ID NO: 6098 - protein, 254 aa, Chromobacterium substugae
MVGLDFTGQCVWVTGAAQGIGQEVARRFVEAGARVVALDLQFEQAAAHCGVMRELPLDIRDADAVAALCRRLAEEDALPDVLVNAAGVLRLGAFDALSVDDWQQCLAVNVSGPFYLLRALMPHFKARRAGAIVNVASNAAHVPRIAMAAYGASKAAMASLSHNAALELAPYGVRCNVVSPGSTDTPMLRGMWQDEHGAASTIAGKPEAFRLGIPLGKLATPADIAGAVLYLASDLAGHVTMQDIVVDGGATLAA

SEQ ID NO: 6099 - protein, 292 aa, Chromobacterium substugae
MSIPKLNAYPLPQAADFPANKTDWRVEPKRAALLIHDMQRYFLAFYGEDSALVNELVSKVDALRRWADSHGVPVIYTAQPTEQKPEDRALLNDMWGPGLTTADPAVQVVTPRLAPREQDTVLVKWRYSAFQRSDLQERMQAWGRDQLVICGVYAHIGCMMTACDAFMRDIQAFMVGDAVADFSEEEHKMALRYVATRCGAVISQSDLAVAGGDAALTREWLKAQVLTVLEDGDDSLAGGDNLLDYGLDSIRVMELVAQWQKLGLEIGFEDLAQDLTLDGWWAAIEAKLPQEA

SEQ ID NO: 6100 - protein, 535 aa, Chromobacterium substugae
MSVAFTRWPDDLAARYRAAGYWNDQPMTEMLARQCRERPDAPAVLCGEREISYAELDRRAGNLAAWLLARGVARHDTALVQLPNVAEFYIALFALFKIGAAPVNALFSHQKLELSAYARQIQPKLLIADRRHPLFGDDAMADELAAISPALSVRLFANDELEAVLERDCGGLPEQAGPSAADEVAFFQLSGGSTGTPKLIPRTHNDYFYSVRRSAEICELGPHTRFLCALPAPHNFPLSSPGALGVFHAGGAVVLAPNPEALACFALVQRHQVDIAALVPPAVALWLQAAPGRESQLKSLKLLQVGGASFAEATARQVPEVLGCKLQQVFGMAEGLVNYTRLDDGDDIVYGCQGRPMSDADEVKVVDEAGHPVPIGAPGMLATRGPYTFRGYYLAPEHNARVFDNEGFYYSGDVVVADERGYLRVVGRVKDQINRGGEKIAAEEIEHLLLQHPQVAQAALVAMPDAMLGEKSCAYVVAHEDGLKSVALRRFLREQGVADYKLPDRFELVNTLPLTHVGKIDKQALRGMLAAAAGA

SEQ ID NO: 6101 - protein, 392 aa, Chromobacterium substugae
MHTQSAATGNAEDGEFYFLSSHRSLKAGGIHSRIDTPARGALDAGSAFSREVAEAFARARADGIASPVLMGAIPFDIDQPSELFIPARHAFFDRQERLQAATQRAGDGGKVVGSRSIPDEQGFKAAVSQAIERFGRGEIRKAVLSRVLEVDFDRPVSAERVFDAVCAQNPNGYQFQLPLAGGGRLVGVSPELLLQKEGARVRTFPLAGSAKRQSDPAADAAASAKLLDSSKDHYEHSLVIDDIQNVLGPYCAELSIPSAPSLLGTRAMWHLGSPIDGVLADASLPILQLACRLHPTPAICGFPTQASRQLIREIEPFERGVFSGIVGWCDEHGNGEWAVTIRCATVADTRVRLFAGAGIVAASTPESEWAETQAKLGTMLGAFGLSGQEAAA

SEQ ID NO: 6102 - protein, 1300 aa, Chromobacterium substugae
MTETPTRLPVSHAQYGIWMGQRLAPDNPGYWTAEATELDGPLDIDAFRAAAAAALAHCPALRMRFEFDGEQLWQCPQAAPAQALPWHDLSGAADPEAAADAWMREALSRPCDPAADPLHRSALLQLGPHRFLWYVQTHHIALDGFAYGLLAKAVSARYNAAQRGQDAPPLPDWRLEPVLAEDQAYQASEQRERDRAFWTARQQAFPPAATLAPPQPLADSVRKAGRALTASQIDAWQRAAKACGVNWAAWLMAATAAWLARRSGRRAITLGLPVMNRMGSAALAVPCMAMNIAPFSLRLDPAASLGELARQAAAGLRDIRPHQRYRYEWLRGDLGRLDGRQRLFGPVLNLMPFDRHAPFDGLKTRIRPISSGPVEDLSINISLLNTEWRLSLEAHPDAYPAERLDALWHELPQWLDQLAHAEPGTPLASLLPDLPPLSILQGPALERPAVPVMERLAAQAVAQPDAVALEGEGQALSYRQLLDRARALAGRLKAQGLEDGDRVAILLPRSVDAIVAILGTLWAGGCYVPLDPLGPSARLAMVLDDARPRLALTHRRWAALCGDAPALCLDEAPGEDAPRLDACAAGVDSPAYLLYTSGSTGKPNGVLVGHRALAHFVSSAGQFYRVHAGERILQFAPLHFDASIEEIFLALCHGGTLALRDDAMLESMPAFADAVARLKIDVLDLPTAFWHELAYALTPELAGRLSRVRLAIIGGEAALTERARRWRELLPDATLLNSYGPTEASIIATGAALSGPDAVWDGGDDIPIGLPRPGVAAAIVDAGLQPVAQGEEGELCLLGDALAIGYLGRDELTARRFVALDALPGAPRAYRTGDRAVWQGGQLRFLGRLDHELKISGLRIDPAEVENALLACPGVREAAVIGLPQAGGGYTLAAFLAADAEPDAGALRRQLAERLPAAAIPDRWQWLEQLPRNVNGKIDRKQLAALSDAPARDASPAAEATPLERQIMEVWSQVLGRMPEGPHANFFALGGKSLQAIQAANRLAQLLQREVAVSALFSYNTVAALAQALSAPAAHRPPSASQGGEFAPLLTIQPGKLPALFCLHPAEGLSWCYLGLARHLPDTAIYGLQATGIQGEAPASFDAMVADYVARMRAVQPCGPYRLLGWSLGGALAQAMAAALAAAGETVELLALMDSYPAACWETRPQPQLHDALVTVLSVNGEVDADADGLPLDNEAIYQRLLRPGSPLAPLGRAALEKLGQASLHGMRLFRDSRTPAYAGDVLLFRAGRHPGDAPTPADWQPYLQGRLDCVELDCDHFGMSDPEPMRRIGEELARRLQSI

SEQ ID NO: 6103 - protein, 256 aa, Chromobacterium substugae
MSEQLSIENLSVSYGKRRVIDKLSVPCMRAGEVTALLGPNGSGKSTLLRALAGLQGGDGLVRLRGRPLSRQRGEVAYLPQTLPPSVHLTVFESLMVAGQATAAGLFRRHDDQQVFALLQSLGIDHLALHFLDQLSGGQRQLVGIAQALIREPAVLLLDEPLSALDLNYQFHVMDLLRRETRRRGMVTVIVLHDLNAALRHADRALMLKAGQLLANGDPDQVIDAATLQAVYGVNGRVERCSQGVPHVLVDGLAAIR

SEQ ID NO: 6104 - protein, 355 aa, Chromobacterium substugae
MNDSTLPPLTAAAVSGDYRRALLRRLLLVAGLLALLALSLSLDVTTGASGMPLAEFWRTLLEPSAADPATAVIVWDIRLPYALIAVGAGLALGLAGAEMQTVLHNPLADPFTLGLQPAAAFGAALALLLGISLPGIPASWMLPVNAFVFALGSALLLNLVARWTRMAASGVVLFGIALFFSFNALVSLLQFVSTADALQDLVFWLMGSLSRADWPKIGLIFAAFALILPWSLANAWRLTALRLGEDRAASFGIDVRRLRLTALLRASLLTALAVAFVGTIGFIGLIAPHIARRLVGEDHRFYLPVSALTGAAILSMASVVTKNLIPGVIVPVGIVTALVGIPFFIVIVLRNGGRT

SEQ ID NO: 6105 - protein, 369 aa, Chromobacterium substugae
MKTVFSRLLAATLIAATALSAQAATITDIAGRKVEVPAKVNRILLGEGRLFYSLALLEGKQPLARVAGWQGDFRQLDPQTYAQYKKRFPEIDRIPLIGKTSENSVSAEKVLTLKPDIAIFSISGHGPGLNNPIVQQLQAAKVPVVFVDFRNAPLEHTVPSLRIMGKALQREAEAERFIRFYQSRIDAIRKTVAAIPAQQKPNVFLDLRAAAFPNVTSAGKGSLGELVDAAGGVNIGDKLIPGAVGEVNMEHVLASKPDWYIGTGTADAADKIGIQFGADISPAQARESLARAAARKPVGALAAVRDGRTFGAWHHFYNTPYHIVLLEAFAKTLQPARFAKLDPDASWQQLHRDFLAIPPQGTYWVKGGK

SEQ ID NO: 6106 - protein, 93 aa, Chromobacterium substugae
MLSSRASLTTANADKVLYKLCKHYALKVPVDFDTERAHVQFPIGTCDIQRAGDTLDMVCAADAADKLAKIEFIMDEHLGLMAKQPELKLDWQK

SEQ ID NO: 6107 - protein, 709 aa, Chromobacterium substugae
MKKNRLPPRAVARHGFRLALLSAAAGSLHIPAAFAAESEAVLPSVVVTASGYEQKIKEAPASISVITREDLEKKPFTNLTDAIRDLEGVNINGSGPGDKDISIRGMPGEYTLLLVDGRRQNTRESRSRGTGGFQQYQIPPMEAIERIEVVRGPMSSLYGSDAMGGVVNIITRKAPKEWHGSMTLGGTITQHSDEGNTGQSSFWVGGPLVKDLLSLQIYGALNNQAEDNIYYSNSGDGGKVATHASDINAKLTFTPNKDNEITFEAGHNELRKTTTPGKSVASLIKVKGGFGPNTKDDYFDTRDHWSLSHNGKYGIIRSNVALYQEIEKPSHSANNIDDGKGLKLTNTTLDGQLSFLFDRHTLKLGTQVGQQVGDNMRAQEAIAGFTGPANPNKITVNTWALFAEDTYDITDSLKLTGGGRLDHHSVFGSHFTPRLYLVEQLNSQWTLKGGAGKGFKAPTIRQSTGGYCMRTGAGNEAGVLCGNSNLKPEESTSYEASLHFDNNKDLSANATLFYNDFKNKVVSYGTDKFSNQYDPGISPARIYVYDNVDSVNIRGLELSGSWAFAPRWTVSGNYTYTKSKRHGGKETSFGGQSLDGMPLDKTPEHAGNAKLAWNPMEKLDLYTRLNFEGKQYYTGFRNGANVARTRGGSSTWDLGGTYRINKTFDVNFAVFNVGDRKVAIDDRGRYNGLDGNWMVDEGRRYWLTLSGKF

SEQ ID NO: 6108 - protein, 38 aa, Chromobacterium substugae
MKTAAIQDTGGGCPPRAANLDALALHQAGVSIPLAYHL

SEQ ID NO: 6109 - protein, 878 aa, Chromobacterium substugae
MSVKRLLGAAALAAATTAAWAAPDAAALGQSLSMRVAVDSNRGAAAGAPCSDLGADWASCLKGRLILENQGGQAVPAGGGWSLYLHSIRRILKLDTPQFAIRHITGDLYQVTPTAAFQGLAAGQRLELPLIDEYWILQESDVLPRPYVVVDGQAPALLAHDGSDEASYLLPLRGDNWKNPAGELRPLATPQQRYLTFTQRGQQLSAAQVANRVIPAALRQQLGGGQLEVKGLSLSLSGLSPAQSQALSQRAAQLGLRPAGGRVAGGVVGTRLPADIAVSGGYRLQIGRQGVKVEGYDAAGVFYGVQTLLGLLPQNGGKAQWMTVEDAPRYAHRGMMADLARNFKQPATVRRLIDQMAAYKLNKLHLHLSDDEGWRLQIPGLPELTEVGARRCHDLSETQCLVPQLGSGPANQSGGGYLTRAAYIDLVRYAQARFIEVIPEFDMPAHARAAVVSMEARYRKLAAQGRPQAAAEYRLLDPQDQSNTLSVQFYDRRTYFNPCVPGSARFVAKLVSEVAQMHREAGQPLQIWHFGGDEAKNILLGAGFQDASGGDPSKGKVNMAQQDKPWGRSPACLAQIAQGQLSSVDQLPLKFAQTASRIVAEQGIPTMAAWQDGVAGASGASDFATRNTMVTEWDTLYWGAAQAVNGYAAKGFQTVLAMPDYLYFDFPYELNPREHGYYWASRDTDSYKVFSFAPDNLPQNAEVMPDRQGQPFAVTSAAAPARYAGIQGQAWTEVMRTDAEFETMVYPRLLALAERAWHKAAWERPYTVGETYQLGVTHLVDKAALNADWQQFAAVLGWREAPKLEHAGVGYRVSMPAVRTGSQGQTATTEWPGARLQYSYDGHGWQTYQPGQQVQANYWRGVSQDGRRAGRAESLSGQ

SEQ ID NO: 6110 - protein, 148 aa, Chromobacterium substugae
MSERDSRLHGSWRLLSFELELQESKARTQPWGADPNGRLIFGADGRMMVLVTAKAREPGGTDAQQAALYRTVMAYTGRYRVDADSFIVQVDSCWNEAWNGTEQQRFYQLDGDALVVFTAWMPNPLAADNAMGRGVLGLVRESSGLCSQ

SEQ ID NO: 6111 - protein, 250 aa, Chromobacterium substugae
MVTALLCTAFIGSAAADSFVVGVEEIDYYPLHSYANGKFSGYGRDLLDAFAKQSGHSFTYMPLPVSRLFHTFLNDNSIDFKYPDNPHWQADMKKGKSVLYSDPVVNVSEGLLVKPEKIDQLSEDSLQAIVTMRGFTPWPFDQTMRQKINNGSIRVYQEDSFGKVIALGMTGHYDAVYASPIVINYYLDVVIHKPGALVFDKKLPFESNDFSLSSIRQGEVIKQFNEFLAKNQPLVMELKKKYRLTDKAVQ

SEQ ID NO: 6112 - protein, 371 aa, Chromobacterium substugae
MSELKIEKLGKRFGEHRVLDDITLTVEQGSLLALLGPSGSGKTTLLRLLCGFERCDEGSIHIGGRLVSSPQLYLPPEKRQIGYVPQEGALFPHLSVSDNIVFGLPRAERRERRRVAELLDMVGLPADFAARAPQQLSGGQQQRVALARALAPKPALVLLDEPFSALDAALRAETRQAVADALSASGTTALMVTHDQAEALTMGRQVAVLWQGKLLQVAAPQTLYQRPASPELADFVGDAVLLPGRAQGGEAHCALGRLPLLDGMPQGEVNVLLRPEQIRLLPASPDHARQAKVLDVSFSGHDASVRLMLDDGSLLAARVPGHRCPQPGQTMALQVEGAVACFAAPGSASSGGGNIATTRLQHSPALFRQEK

SEQ ID NO: 6113 - protein, 538 aa, Chromobacterium substugae
MNIAMRLAGGSSRRPAGLIVSAALVALLALLPLGFTLWQAASVGSGDAAELLLRPIVARLAGNTALIVLASTFSCAVAGTASAWLVERTRLPGHRLWALLCVAPLAIPPFITSFAWVSISPDLQGFWGAWLVLTTAYTPLVYLPVSAVLRNMDPALEETARSLGLSAWSCFRRVTLPQLKPALLGGMLLVALSSLSEFGAFMLLHFHTFTTEIYAEYRASFDSAGASLLASVLMAAGVLILLAELRVRGESRYQRLDRGARRAAGRLELGWKRWPALLWLVLQGSVTLLAPIATILYWTLQPGADAVTPAEVSPQLLLSATATSLGLGLAAAALTTVLALPLGYLLARHPGRLAHLLERVVYLAQGVPGIVIALALVNLAIQWLKPLYQSALMLALAYAIMFLPLALVSVRSALMQAENKLEELARSLGLNWWQALWRVVLPLAAPGLGAAASLVFVSVITELTATLLLAPIGTETLATQVWADTAALAFAAAAPYAAILIALSLLATWLLMSCLGRGAVLGGQPQPWNQQEDPPCRN

SEQ ID NO: 6114 - protein, 333 aa, Chromobacterium substugae
MKRKLISALLAGSLLAASQLSTAASLVLYNAQHPQTIKLLTADFEKMSGISVKVRSGEGPELSAQLLAEGKASPADVYFASNSPELMLLEGKQMLAKLPAATFSAIPARYSSPQGEWVGVMARENVLVFNNKLAAGAQMPASLLDLAKPQWKGKLAIAPSDGDFLPLVSAVRALKGEPATLAWLKGLRDNAQTFDDNEGVVAAVNRGGVAVGIINNYYWTRLQVELGSKGMHSQLYHFGNADVGALINVSGAGILKTARNADAAQKFLAYLVSPRAQQLIAKSNITFEYPLLPSVAPAPQLKPFNQLNPPPLDMQKLGDDSQSAKLLRQAGLL

SEQ ID NO: 6115 - protein, 426 aa, Chromobacterium substugae
MTDRDKPKQPSRRGFLKGGGALALAGWLGGGKALAAAAGHTKAAAQPGREPFDGVHQGGILTPQQQNSYFAAFDLQTAKREEVIALLKAWTEAARRLSQGLPARALSGQSDKAPLDSGEAVGLATARLTLTFGFGPGLFSKNGVDRYGLAKHRPEALVDLPKFNGDQLVPEKSGGDLSIQACADDPQVAFHAVRQLAAIADGIASVRWVQTGFASGAPGGGTPRNLMGFKDGTNNPSTKDPALMNQFIWVGDEGGWMKNGSYLVVRRIRIALEHWDKTELGFQQEVVGRYKDSGAPLGQKHEFEPMNLAAADKDGNPLIPDTAHSRVASPQENDGARILRRAYSYNDGANFYAERWPPWRQGVEYDAGLFFIAYQRDPRTGFIRINKKLAAMDMMNQYITHVGSAVFACPPGARPGGYIGEALFQL

SEQ ID NO: 6116 - protein, 372 aa, Chromobacterium substugae
MKRNFSRRGLAAAATLLALAGAAHADGAFLAGIKRHTILANTVPDNGDQNPYAIAVSPVSAGKLKQGDVLVDNFNNAANLQGLGSTIVNYHPDSKSLTLFAQIPRTLPQCPGGVGLSTAMTVLKSGWVIVGSTPSNDGTTDTKGAGCLMVLDSSGKLVDTWAGADINNPWGNMAVIDNGDKATLFVSNAGFGVGSAKGTPPVVNLATVLRLELDIPAGQPPRIVSRTVVASGFGEQADKGVFLIGPTGLAYGKDDKLYVSDALGNRISEIWDATTRTTSAGIGRTLTHDGLLLRPLALATTPQGHLLVTNGSNGKVVEIDPANGEQLGARWIDANKAQTPPGNGDLFGIAMTPEGDGFYFVADDNNNLVLAK

SEQ ID NO: 6117 - protein, 502 aa, Chromobacterium substugae
MKRPFLPNAAAKPLRISSLALAVLLGCGLQAAHAEETDAAANPADLPEADQAIKAKPDNQWTGWWNRSTLLGDMGGLRSALGRQGVTLGLTEASEYLRNVSGGVKYGGDYQGLATLTLGLDTQRAGWWNGGSFNVSALDIHGKAFTADHVGSIQSASGIEADRATRLWEAWFQQQLNGERLDVKIGQQSLDQEFMVTQYGGAFIGTMFGWPAVPSADLPAGGPAYPLSGLGVRLRGKLGDNITLLGGAFAGDPTRDVSQNPNDPQQLNKHGTTFSRHGGTLFIGEMQYGRNLPSNGAVEAPRGATGIAGLPGTYKLGFWYLNQKTADTRMDVNGQPIALTGANPQLHSGNYSIYAVADQTVWRPAEDSTQTLNVFTRLMGAPGDRNLVSFSANAGVTLTAPFAGRDNDTVGLAVGYVKVGNHAAGNDADTGIANGNLAYPVRSDETQVEATYIYQLTPWWQWQADLQYVRNVGAGAVSPNDPTQTQRIPNNWVVGLKTTITF

SEQ ID NO: 6118 - protein, 404 aa, Chromobacterium substugae
MSNTVSRADFDQVMVPNYGPAGFIPVKGLGSRVWDQDGREFVDLAGGIAVNSLGHCHPELVAALTEQANKLWHVSNVFTNEPALKLASLLVEKTFAERVFFCNSGGEANEAAFKLARKYAHDHFGADKNQILSCVNSFHGRTLFTVSVGGQPKYTEGFGPVPGGIAHFEFNNIESLKAAISDKTCAVVIEPIQGESGVLPADPAFLKAARELCDQHNALLIFDEVQSGMGRTGALYAYQQYGVTPDILSSAKGIGGGFPIGAMLTTEKVAKSFVIGTHGSTYGGNPLACAVAHKVVSIVSSPEVLAGVEARHQRLVAGLEAINAKHKVFKLVRGKGLLIGCVLTDEYNGRAREFLKAAEKQQLMILVAGLSVLRLAPSLVISDADIDEGLKRLEAAVAEMAAAK

SEQ ID NO: 6119 - protein, 339 aa, Chromobacterium substugae
MFTVRPIRTSDLPAIERLAQASGIGVTSLPSNREKLFERIQQSIRAFEHEAIGDAGSEYYMFVLEHGGAVVGTASICASAGFDEPFYSYRSETAVHASRALKVNNRIHVLNICHDLTGTVQLCGFYVEGGLDQLAAELMSRARLLFIAGERERFGRRIIAEMQGIHDEAGQSPFWNAIGRRFFNLDFLQVEQAFVSHSKTFIAELMPSYPIYVPLLPDEAQQAIGQIHPDFERVCRLLCNEGFEADNYLDIFDGGAVLTAELDRLKTVEQSRSHPVEIQASLPAQASLQLVSNQRLSAFAATAARVAVVDGVAFINPDAARALGVASGDRVRVAGLQAE

SEQ ID NO: 6120 - protein, 345 aa, Chromobacterium substugae
MMFIRPVEHKDLDGLMNLARSAGIGLTTLPVNEERLSRRIARSVLSFSGELDKADHCYVFVLEDSDTGAVAGICAIEAAVGLKEPWYNYRVGTIVHASEELGVYSRHETLFLSNDHTGYSELCTLFLHPDYRVKRNGGLLSKCRFLFLAQFPQLFGKMVVAEMRGVSDEAGNSPFWEALGRHFFSIDFAKADYLTGVGQKAFVAELMPKHPVYVDFLPPEAQAVIGQTHEGTRPAVALLESEGFRYEGYVDIFDAGPTIQAYVSDIRAVKESQRLPAKVCDPLPQGEREWYLVCNDALAGFRSVLVEAVRPQGEFCLTPELARALDVQDGGHVRCVTLTPKEAVQ

SEQ ID NO: 6121 - protein, 486 aa, Chromobacterium substugae
MSSLFIDGKWLAGDGVAMAKTNPADNAPLWSGRAASGAQVDAAVQAARAAFPAWARAGLDARAKVVRRFGELLTERKAELARVIAQETGKPLWEATTEVATMVGKIDISLKALAERTGERAAAMGDAQAVLRHKPHGVVAVFGPYNFPGHLPNGHIVPALLAGNAVIFKPSELTPWTAEITVKLWAEAGLPAGVIGLAQGAKDTGVALAGHEGLDGLFFTGSSATGALLHKQFSGRPDKILALEMGGNNPLIVGPVADVDGAVHHVIQSAFVSAGQRCTCARRLLVPQGEWGDAFVARLVEVAGKLRVGKFDAEPAPFLGAVISNAAADALLKAQDALLAAGGKPLLAMRRLEAGAAMLTPGIIDTTAVVRPDEEFFGPLLQVIRYGDFDQAIAIANDTRFGLAGGVLSDSRELYDRYWLESRAGVVNWNKPLTGASSAAPFGGIGASGNHRPSAYYAADYCAYPVASLECDTLALPAQLSPGIVL

SEQ ID NO: 6122 - protein, 448 aa, Chromobacterium substugae
MNAYEVNFDGLVGPTHNYSGLSFGNVASTSNVSAASNPKLAAKQGLQKMKALHDLGFKQGVLAPQERPDVASLRKLGFGGSDAEVIARAAKEAPAILAAATSASSMWTANAATVSPSADTADGRVHFTPANLNNKFHRSIEHPTTGRVLRAMFADEARFAVHAALPAQMHFGDEGAANHTRFCAGYGQPGVEFFVFGAAAFDMRYPKPAKFPARQTLEASQAVARLHGLDEAGVVYAQQDPDTIDAGVFHNDVISVGNGEVLFHHQQAFLNQADVLEELARKLAARGGRFVPIEVPRAEVTVEEAVKSYLFNSQLLSKPDGKMLIVVPEECRNIERVWRYLQKLAASGGPIDEIRVFDLKQSMQNGGGPACLRLRVALNEAELAAVNPKVLMSDALFAELNGWVDRHYRDRLAPADLADPQLLSECRGALDELTRILGLGSVYPFQLA

SEQ ID NO: 6123 - protein, 309 aa, Chromobacterium substugae
MDIFLQQILNGLVLGSIYALIALGYTMVYGIMGLINFAHGEVVMFGAMVTITVITTLMGMGVNLPGPALVLIGLLVAIPACMLLGFAIERIAYRPLRGKQRLAPLITAIGVSIVLQQVAILIWGRNYIPFPQILDHDVVTIFGASITKLQIVIVVLCLAIMAGLLLMVEKTKLGRAMRATSQNPAVAGLMGVNVNTIISTTFVIGSGLGAIAGVMVATNYEQAHYYMGFMIGLKAFTAAVLGGIGNLGGAVAGGILLGIIESLGAGYIGTLTGGFLGSNYQDIIAFMVLIAVLIFRPSGLLGEKMADRA

SEQ ID NO: 6124 - protein, 363 aa, Chromobacterium substugae
MNLNTLDTNKKMGLFALSAIALLVLPFVVGGALGNSWVRIIDFALLYVMLALGLNIVVGFAGLLDLGFIAFYAIGAYSYALLSSPHFDIHWLFFLTIPLGAALASLGGVLLGTPVLRLKGDYLAIVTLGFGEIVRIFMNNLNAPINITNGPQGVNLIDPIHVGSVSLGQTIELFGLSFHSVYLYYYLFLALTVAVVIMVWRLQHSRIGRAWVALREDDIAAAAMGINIRNIKLLAFGLGALSGGVAGGLFASFQGFVSPESFSLLESIMILAMIVLGGMGHIPGVILGAVVLTIAPEILRDVIGPLQMKTFGRMLIDPENARMLLFGLAMVVMMLVRPEGMWPSKRRKAEFQHAKEEAAAQKG

SEQ ID NO: 6125 - protein, 256 aa, Chromobacterium substugae
MAEVLLKIEGIHKRFGGLHALSDVGLTINKGEIYGLIGPNGAGKTTLFNVLTGLYVPDEGKFEFDGHNLFQQKPHVVVAAGIARTFQNIRLFAEMTALENVMVGRHIRSKAGALGAVLRDPGTMAEERAIEAKAWELLEYVGIADVAEERARNLSYGHQRRLEIARALATEPKLLALDEPAAGMNPRETEELKQLMSKIRDGGVTVLLIEHDVKLMMGLCDRIAVLDYGKKIAEGVPEEVRRNPKVIEAYLGAAHA

SEQ ID NO: 6126 - protein, 236 aa, Chromobacterium substugae
MSILEVKNLQVAYGGIQAVKGIDFHIDQGELVTLIGANGAGKTTTLKTLVGMVKKSGGSIVYDGKDVASIPSYDFVRHGLAMVPEGRGVFAKLTVEENLQMGAYYRNDKEAIQSEIEHVYELFPRLKERRLQLAGTLSGGEQQMVAMGRAMLSKPKLLLLDEPSMGLAPIIVEKIFEIIQMVAKQGVTMLLVEQNAKLALEVSQRGYVMESGRITMSGDAKELLNDERVRNAYLGE

SEQ ID NO: 6127 - protein, 246 aa, Chromobacterium substugae
MASWKYALMLVVSLSLRAGAACAGETLTLAASEYPPYMSSQMANGGVAVAIVREALRRAGYSAKAVYMPWARAVNEARDGHLDGIVGLWTTPERLQRFLFSQAFLDNHIGFFKRSGDPIRYRALADLKPYTIGIVRGYANSEAFDAARLQTDETLSDASNLSKLAAHHIDLALIDRGVANYLLGGSLVALAPKLEWLPPPVVVYPMHLGISKRLPQAEKRIQDFNRGLETMRQDGTLDKMLKEAKI

SEQ ID NO: 6128 - protein, 256 aa, Chromobacterium substugae
MSRYFPLSAALFVLLLSQSAAAQLPALHILTEDDPPLTFSQNGQPAGLVVEVVREIQRRVGSHDPITVMPWARGYLLAQTQANTALFNTNRIAEREHLFKWVGPVTATLGSFFVRRDSKLKLVSLDDARKLDQILVVRDWYLQLTLSAQGFSNLSAIATPNQMVSMLMRGRADVIASENTTLPTQLAQLGYQPADVRKAYTFIRTWGYIAFSPQTSDAVVAAWQRALDDMKRDGSFAAIYRRWLPGEPLPAAAAEK

SEQ ID NO: 6129 - protein, 266 aa, Chromobacterium substugae
MDGGAAASSCKGETMYSVTVLAHRLLGALLLPPILNLLPIIAGGMLIRRCPHAGRLLLASGVALTYFLSIPQTAIWLAHGLERYPVIDAAQLADVDAIVVLGGGKRPAEEFGGNAPGGDTLTRLRYGAYLARASGKPILVTGGAPSGGEAEGAVMARALREDYGLKPRWVELRSNTTLENAQLSAPMLQAAGVKRIALVSQGWHLARAVPFFRRQGLQVLPAPTGLIRYDGAAAFLYIPSGNAMAECRTLLSERLGLLFYRIRPTG

SEQ ID NO: 6130 - protein, 382 aa, Chromobacterium substugae
MKTTTRPALWLLTALITFPQLVETIYSPALTDIAFAFGVSQAQASQTLSVYFLAFAAGVALWGWLSDRIGRRPAMLLGLACYGAGSALALAANDFNMLLLARMISALGAAAGSVVVQTMLRDSYDSTRLARVFSLLGATLALSPVLGLLSGGWLAGRFGHHGVFAALLLLAVALLALTALQLPETRPIGTARPDMARLAGQMLRDAELWRDAMLVALFNTMLFSYYSLAPFLFQRLGWSPEQFGGSGAALAAASLAGSLLNRRLLGRGLQSEQLVRAACRLALLSGLAAWLLQASAWILLPAAGAVIAFSIAIPNVLSRALRHYRDQAGAAGALFGLSYYLLLSLGLALAGLAQQLGMTLTLAALLALACQRRQAQPVGRMR

SEQ ID NO: 6131 - protein, 258 aa, Chromobacterium substugae
MAWIPADQAFDADGFDAPMIGIAADMGVHDSGRHCHRRHQLLFAAAGCITIELADTLCLLPPSRAAWIPAGTAHRVRMRGVVAYRSLYFAVDLPFPAPPLQVVEVNPLLREVIERMAWWPWDLPAERQRSLLAVFGEELQAARGENWRLPFPADARLASWLDGVRGGAQPPRLNQLADAVGASERTISRIFIRDTGMSYQAWRQQWRLLRAMEMLADGMGTSETAQRLAFASDSAFIAFFRQHTGATPARRAQSSVSR

SEQ ID NO: 6132 - protein, 217 aa, Chromobacterium substugae
MKMLLLSLLLALAAPARAAAPDLQAVVHYETVSLGADGVEKTIRYREKLVRQNGHVWRERLNAGAPHRHDDDGHQHLDFAAAPRHVWLDAQGRPQLEFIHAGKKERIQTAPREWSDVGFNGSWAQASQLVDISQLRGFSLRQEEKDVARYSKTSAQGSKTLRWSQRWQLPLEVEVRSADGRQRETIRVSPQALAAGTVPPWRQYARWPVRDYLDTLD

SEQ ID NO: 6133 - protein, 452 aa, Chromobacterium substugae
MQTVMKTLLAAAALAALSSAPARAAGEAKNVIFFLGDGMGPATVTAARIYQYGEGGKLNMEKLDRTARIKTFSNDAQTTDSAPSMSAYMTGVKMNNEVISMSSDTRAIEPNSDGTGNCGANNGAPAATLLELAKAKGKAIGAVTTTRVTHATPAATYAHVCHRDAESDIIAQAVPGGAGYNARLGGGLDVLMGGGGKFLLPKASGGKRADGRNLLQEFAATGYPVLQTGSDLAAFDAKSASRVVGIFGKDHLEYELDRVKNKVDQPSLAQMTAAAIDVLSKNSNGYVLMVEGGRIDHALHGTNAKRALTDAIAFDDAIKTALAKANLSNTLIVVTADHDHTMTINGYSKRGNPIHDISRSYVDGQPAKDADGAVYTTLVFGNGPNRKPTRVSVDSAAATADDYQQETGIRLSSETHGGGDVMLMSGGAGSKGFKGVMDNTRVFGLVKTALGL

SEQ ID NO: 6134 - protein, 474 aa, Chromobacterium substugae
MAISLAACNSGGGSAANRPQDNAESRPPAASAKNVIFFLGDGMGIATTTAARIYSVGEDGQLTMDTLPESGFVKTFSNDAQVTDSAPSMSAYMTGVKMNNEVISMSTDTVAKSPKADLTSNCGAGNGKAVSTLLELAKAGNRATGVVTTTRVTHATPAATYSHVCHRDAEADIAAQLVPGGALYNAALKDGVDVVFGGGRQFFLPKAAGGKRADGRDLVAELKTRGYGYAADKAGFDAIDPVRTRRAVGLFTASHMSYDLDRDAAKEPSLAEMTSKAIAMLAGRSDKQGMFLMVEGGRIDHALHETTAKKALQDTVAFDQAIQAAINAMQQKDPGLKNTLIVVTADHDHTLVLNGYAKRTGKTAPGNPGVLGLAKDYVSGKNLVDADGMPYSIIGFGNGENRVAGDRSAATALTDDAASANDYHQEAAIRMPAGGETHGGTDVYIAAIGQGADSVHGFLENIEVFGLVKKAAGL

SEQ ID NO: 6135 - protein, 364 aa, Chromobacterium substugae
MVDIGKELSMDVYSKNGFLLLKRGHYVLTPELKQKLVNMGFAEGKSEARPVDKPILNDSRKHSLFEDIAFLQQRVRSMLYYALATPGFEARAMEIALTLIRLAETHPDALIASIFLVPFAEYSVAHSLHTAALLAILSRSIALPPRHRETLICAALTMNISQIELQNELFGQPGSLSAEQRQAISDHPLMSSAILREAGVDDQLWHTLVQTHHESWHGNGYPHGLSREQILPPAHMLRLADITCAKLLPRRYRSALLPATALGQIFQRKDSEFDQSFTTLLIRELGIYPPGSFVRIASEEICVVISAGAKPSAPIVAAIRRADGPPYGEPLLRDTNKPGLKVLAPCPAGDAKVRVSFLAHLWKC

SEQ ID NO: 6136 - protein, 1311 aa, Chromobacterium substugae
MTPAASLADLKSALSCCLIRDRHILRRKLADAADRLKKNQSADKLLADIANQVERSRGRADARRAHLPKPEFDDALPVNQKLADIKSAIDKNQVVIICGETGSGKTTQIPKICLELGRGVFGLIGHTQPRRLAARSVATRIAQELGSQLGEHVGFKIRFTDKLSEKSVIKLMTDGIMLAETQTDRHLEAYDTIIIDEAHERSLNIDFLLGYLKQLLPRRPDLKVIITSATIDADRFARHFDGAPVIEVSGRTFPVEVRYRPLKQRDEDEREMEMEDAIVDAVDELSRQGPGDMLVFLPGEREIRETAEKLRKSGIRGYEILPLFARLSNEDQQKIFKPSGGRRIVLATNVAETSLTVPGIKYVIDTGLARLNRYSPRAKVEQLQVEKISQAAARQRSGRCGRVAAGICVRLYAEDDFNARSPFTDPEIVRSNLAAVILRMAALRLGKVDAFPFLEAPSSRLIADGYQVLTELGAVDDKGELTPVGKELSRIPVDPKVGRLLLAGRDFHCMREVLIIAAALSIQDPRERPFEARDAAEKAQARFNDEKSDFLSFLHLWDFFSDALKHKKSNRLLVNTCHDHFLSYLRLREWRELHAQLAEIASELGLIKRDEAHADAEQPDAQMTLKKRQQLDAVAYENLHKALVTGLIGNIGMKNQEGDDYQGARGVAFHVFPGSGLKKAKPKWLVAAELVETTRLYARCVAKIEPEWVEKLAPHLVKYHYFEPHWEKSRGEVVASERVTLYGLTLIPRRAVSYGRIAPEEARELFIRGALVNMDYVSNAPFFQRNQQLIREVEQLEHKARRQDVLVDEEALYAFYSERIPAEVVDAASFEAWRKEAEKAEPKLLHLTRDELMRHAAQHVTENQFPEWLELDDGKLKLRYRFEPKHPLDGVTIDVPLAILNRLTPAAFEWLVPGMIRDKLQQLIKGLPKQIRRCCVPVPDFVTRFLLSNPDLQQPIAPQLARFILRETGGVKVDIDEFNAQELPEHMLFNFRVIDDGKQEIGLGRDLAALQKQFGQAAQLTFRDTSADFERDDVKTWDFGELPESIQFARGRQQLTGYPALTLEDDKVAIRLFDTQLAAERHHRQGVVRLLQLQLKEQMKQLSKGLPGITQIGLQLRAVANVDELMADAIACICDRAFIGEDALPRNEKAFNDQKNRARTRLPAVIQAVSQYLQQIAAEYTPLGNKMQKHKLGYDLKPQLDSLVYKGFLAATPWSQLPQLPRYMKAMSLRMDKQPANPQRDGQRAAEIRDLWQKWQQRVAEQSEQGEAAPALLEFRWMIEELRVGLFAQELKTPYPVSVKRLLKAWADLPR

SEQ ID NO: 6137 - protein, 403 aa, Chromobacterium substugae
MNKLPVTVLSGFLGAGKTTLLNHILANREGKRVAVIVNDMSEVNIDARLVREGGAQLSRAEEKLVEMSNGCICCTLREDLLLEIRRLAAEGRFDYLLIESTGISEPLPVAETFTFRDDDGRSLADLARLDTMVTVVDACNFLRDYASRDSLTDRQASLGEEDERTVVDLLIEQVEFCDVIVLNKTDLISAEALVELEGILRSLNPRADIVRSEFGCVPLDKVLDTGRFDFDAAAEAPGWLAELRGEHVPETEAYGISSFVYRARRPFHPQRLWQWMRQEWPGVVRSKGYFWLASRPQFAALWSQAGSVARHSCAGLWWAALDRAEWPQDEDSLALIRARWQEPFGDRQQELVLIGMDMDKQALKAGFDACLLNDAELAGGMETWQTLEDPFPRWEIREEEAEA

SEQ ID NO: 6138 - protein, 212 aa, Chromobacterium substugae
MTADATAETIHLSDNLASLAAIFDADAELCLYRRPPNAAIAGYLRRAEQNGLLGLGWRRIVTPGESADLPLADLPGRDALQADIDWLCELYATLTGCPQVGARLEVLSRPMCPRFHVDRVGLRLLCCYQGPGTEWLPSPAANRSRLGSAAQGLPDAESGLILDAAAIGSAPPFAVLLLKGAEWPESKGGVIHRSPAPHPGEARVLLALDAVW

SEQ ID NO: 6139 - protein, 272 aa, Chromobacterium substugae
MLAHAAVNVVAGENFYGDVAQQIGGSHVRVTSILSNPDQDPHLFEASASTAKALSDARLVVYNGIDYDPWMDKLLSAAKAPQRKTVVAGELLKRKTGDNPHLWYDPATMPAVAKAIASGLESADPAHKADYDHNLQHFLASLQPLNAKVQALRGKYAGKPVTATEPVFGYMAEALGLKMRNEKFQLAVMNNTEPAASDIAAFENDLKTHAVNVLFYNSQASDQSAKRVQKVARAAKVPVVGVTETAPAGKHYQEWMLSQLNALDKALGGSGK

SEQ ID NO: 6140 - protein, 264 aa, Chromobacterium substugae
MSAVSLAGVSVGYGQRQVLADVSLEIGQGLFIGVLGPNGAGKTTLMRTMLGLQAVDRGSVRVLGQPARRGNPAVGYIPQLRSHAAHLRLCGWDFVASACRGHRWGLPLLDAAARREVGWALDTVGAGSLARRPLSELSGGERQRLLLAQALLGRPRLLLLDEPLISLDPHHQRGVVELVSRIQRDFGITVLFSAHELNPLLPAIDQVLYLGRGQAALGTVDEVITRPVLSRLYGSPIDVVRMRDRIFVMSGEVEVEREAHCHDV

SEQ ID NO: 6141 - protein, 266 aa, Chromobacterium substugae
MFEYDFMINAFIAGGLVALVAGVTGYFLVLRGQTFAGHALSHVGFAGATGAALLGLPPLWGMTLVTLCGGVAMGALGERLQGSDIAIGAILSLALGLGMLFLHFFTAYATQATALLFGNVLGVDTATLWTLAGLGLLCLAALAFISRPLVFCSLQPELAEAKGVSLRRLSMLFLAIVALATAGCIQIVGVLLVFTLMVGPAATAQKLTARLGVGVGLAALLALGEAWGGIALAYYTDWPSSFWITTLSGAAYLAAGGARGLRVMRG

SEQ ID NO: 6142 - protein, 220 aa, Chromobacterium substugae
MKAKFAMTACGALAMLYLAAAHADDTFGYAKLGTGVELGVGRALDNGLALRLGIADTFRYKHDKALDGTPYQLKSKPNPALAASLDWRPLSDSGFRLSGGLTLSGKPREDLNFAANGAGNYTLGGNRYAASAVGPLTGKMEYQPLGSYLGIGWDFAVPGASAWRITSDLGAQLQFGGKATLSPAAGVSAQDLAAAQQKLDHDLGGTRFRLSAGVGLSYAF

SEQ ID NO: 6143 - protein, 480 aa, Chromobacterium substugae
MLEGLRWAAWPLAHGWARPGFSMKSAGCMTYGLCYAGAYCAAWAALFILTREKAFSMRPYLHAIGSGSAWFRRALLLACALMLASGGVDLWPLPEAALREQAAAWLWPAWLAHGLRGWLSLRDAALLVFAALMLLFMIALRRGLSSEAPPRRWWPWLAGQMIIAAVLEPWTEPGLGYLVAAELAFLLPWRGAAAGALLQAALIDAALLPYLARVGNGHPACNIAGALPPPFWTVAALDWLQGLVFQAFAFCVGYGWAEALRGRHRQAQANAELQATQLLLTEAVREAERARIAEGVARLAADQLAALQLQLRLAEAKLGAEADTQIAAAREGASRLAEELRGVARGDALASLDLREALNTLCRGIPMPLVRLDMEDALTLSEPTLAHAIFRTVQEALSNALRHSGAAGAVVRLERSGAGVAVTVSDNGKGLAAPEAKRAGHGLIGMRERVEARGGTLDILSPASGGCCLRIWLPLSGEAS

SEQ ID NO: 6144 - protein, 337 aa, Chromobacterium substugae
MAHMRERLPLLTGPAIGLPGAMAAYGLGFAAFGWALWRASAVGARAPGATAKAGLVVLQIALALLTNDKLLLLTAAELALLFPPRAAWLGLGGQVLALLLACAWQLQRLPAKELMCNVSGSNVHAPPLEQRSWLLWQDAVVGGGFQLLTFGIGCLGAAERRRRAQLEATRASLLAARQLLAGAAGNRERVRVARELHDGIGHHLSALNLQLELLLRRGAGEADAPLRAAQQAARQMLAEVRTLVGMERRQQQAPLAEALRLLCAGVRPQAELVLEPMPALADDAAWRAFSAARQALERAGGRSCRLWLRGQGEGGAELRLSMSGEGEWTTVWQEAAR

SEQ ID NO: 6145 - protein, 223 aa, Chromobacterium substugae
MDDRVAGGGAMIRVGLIDDQILVRSGIRGLLELTGDIRVALEAADGAEALALLQGERPDVLLLDVRMPVMSGIALLQALQTRGGMPPTLLLTTFDDDEALLAGMRLGARGFLLKDISLERLAQAIRNVAAGATLFRPGLTERVLDGVRGGGASFPSLDLPERLTGREVEVLALMAGGFNNREIAEALGPSEGTIKNHVSSILSKLGVRDRVRAVLRALELGYI

SEQ ID NO: 6146 - protein, 502 aa, Chromobacterium substugae
MSIQAITEWFIPDAVRQIPEQAIRARTVVGVGLLAGLMAPLFAVEYLELGHYPMAEGIALGGLGLLCGPLLLKLCGAVRFTAEFITSCMYAMVCWMVYVNGGILSTSLMWFAAIPFTAVFIGTRRSGMFWLAMSLAAVGVVMWLSATPGGIPTSPLPREALPKLQAKSLAGLSLVVLVLALAFDKAKSKSFEKLESARQDAERASLALSQMMEQISRSIRDASSASRQIADSTGSMARTMADQHQRSENMVVVAQQMAVVTSQNAEQSSTATQLAQTAGSAALAGGEAMDQAVAQLGRAGEVIGHAAGRLEELGQRSAEVSGIVQLIRDIADQTNLLALNAAIEAARAGELGRGFAVVADEVRKLAERTQNATQDIESKIRVIVDGTNQAMVAMRDGNRQMQAGRDNAQDAQQKLSGIIRETGELAGLLSQVSQAETCQNQGFAQFAGDIVAVGESTRSLSGETHNIAEAIRRLDAQMETLHQAVSQPAHAPASTRREPSRA

SEQ ID NO: 6147 - protein, 691 aa, Chromobacterium substugae
MQTFFLAPTGFNAGLTSVSLGAIRSLEQAGLRVGFVKPIAQDTKDGEVERSTHFAQAICRLNPPQPISMERVEHLLSQGQVDQLMEEVVSLYQQAAQNVDVVIVEGLVPDQKQVFSTFLNTKIARNLQAQTILVSSVKDLGAAEIAEQLEMNIQAFGGQSIAGYILNHVLPGADRAELAREVQQSGNLKKTGLALLGVIPYQPELLAPRTQDVARYLNASVVHAGQQASRRVRNMVVAARTAPNIVNLLKPGALIITPGEREDVVMATSMAAMNGVPLAGLLLTCDSEPDPRIQQLCQQAFTGGLPVLATSLNSMETASALNAMSHQVPSDDLERMGKVIDHVAEFLDVSTLKQSVGEPREIRLPPPAFRFQLMEKARKANKRIVLPEGNEPRTIQAAAICQEKGIARCVLLGKRAEILQVAEAQGVTLPASVEILDPNEIRGQYVAPMVELRKGKGLNEPMALAQLEDTVVLGTMMLAMNEVDGLVSGAVHTTANTIRPALQLIKTAPGSSIVSSVFFMLMPEQVYVYGDCAVNPDPTAEQLADIAIQSADSAVAFGINPRVAMISYSTGSSGSGSDVEKVREATRIAQEKRPDLLIDGPMQYDAASVESVGRQKAPDSQVAGRATVFVFPDLNTGNTTYKAVQRSANVVSVGPMLQGLRKPVNDLSRGALVDDIVYTIALTALQAEQQG

SEQ ID NO: 6148 - protein, 401 aa, Chromobacterium substugae
MFKPMNSSILVINCGSSSLKFALIDSASHEAVMTGLAEKLGLADACITFKHNGDKQTALLSAPDHAAAMHAIIEKLQQVSLLDSVKAIGHRVVHGGEHFKQSALLDENAINEIERCIKLAPLHNPAHILGIRTAIQEFPSLPQVAVFDTSFHQTMPEKAYLYAVPMKLYRENSLRRYGMHGTSYRFVAEEAAKMLGKPADETSLVIAHLGNGASISAIRNGKCADTSMGLTPLEGLVMGTRSGDIDPSVFGYLATERGMDVQAVTNMLNKESGLLGLSELSNDCRELEDAAAKGHEGAKRALEVFAYRLAKYVASMSVGAGRLDAVVFTGGIGENSSFLRAEVINQLGFLGLKLDAAANEACIRGNAGRITAADSVPALVINTNEELMIAMDTAELAGLAK

SEQ ID NO: 6149 - protein, 62 aa, Chromobacterium substugae
MEQLRGSQIRHYSHTSVEEDIRPAESRSGRVCGTIKNNQSKQGRTLHYEGGIMPSPLPRGKR

SEQ ID NO: 6150 - protein, 369 aa, Chromobacterium substugae
MSDLASAQLLQASAAQLPIHTYFDPGFYAREQELLFADAPQYYGHELMAPNAGDYHTLEWLGHGKMLKNVDGEIKLISNVCRHRQAIIYKGRGNGNHIVCNLHGWTYDAAGTLVGAPHFPETPCLNLGQTELTRWNGLLFDARRNVAADLAKLGVAKHMAFDGYAFHSTQSAEYDFNWKTFIEVYSEDYHVDPFHPGLGNFVDCGDLKWEWGDSYHVQTVGVKNRLARAGSKVYGKWHEEVRRRYAEQQPEFGAIWLTYYPNIMVEWYPHVLVVSVVIPRGPEKCTVITEFYYPEDVVWFEPEFIEAEQAAYFETAKEDDEICIRMHEGRKALWMAGVSEVGPYQSPTEEGMQHFHEYYRRQMGLALAG

SEQ ID NO: 6151 - protein, 169 aa, Chromobacterium substugae
MVVFGALLLGSTMAQAASYADPVSKVRFTLPPGWKVRPSITDGVRVLRVVPPKADQRERAAIEVQIGVRKPRRGDTLPRLAAAFRNEDGDREAANFVRVNPKAGRLVTEYRDGRFVSNRLWIVRHNLHVIQLVDRNRLLEARCTANASEFKTYRRQMEAICLSVALARK

SEQ ID NO: 6152 - protein, 270 aa, Chromobacterium substugae
MVVAAALFALMGLFVKLGAQQFSSTELVFWRTLIGVVALGGAALWRRERFATPLLRYHLQRGVIGYSSLLMSFYAIAHLPLATASTLTYTSPMFLALLSVVLLRERLPAQAMAGLALGFAGVALLLRPTLSGDAWFAGLMGLASGFLAGWSYLHVRELGRQGEAEWRVVFYFALISTVGGVLLMCLERWHPVTLDNVGLLLGLGVSATLAQLAMTRAYKVGRKLAAANLSYLTVVFSSLIGALVWGDALSPASLLAMGLIVVSGMLASRR

SEQ ID NO: 6153 - protein, 118 aa, Chromobacterium substugae
MISIREQDYGLDVALFNEFTLADFQLLEQALLKRLEERDKPDMLLDLSELKDFTLDMALEEVKFMRAHEEKLGRVAIVVGDVWIRLATHIAGLLSHTHVQYFDLTEEAQAWLARPVAA

SEQ ID NO: 6154 - protein, 564 aa, Chromobacterium substugae
MKLRSLAAAHGGFLLSTICQAAAPPALIQQTDQLLRLQQQQLEQQRQSLQQRPDVFLPSSAGAKPAPAIPGAAPAAACFAIGQTQLDGAPASWQRWLQPLLDAGLGKCMGLDALNRLVAALTNEMVARGFVTSRVYLPEQNLRGGTLRLAVVAGRIHAIRLKEGGSDLALRSAFSSGPGDILNVRDLEQGLEQLGRLPGQQATMEMVPAEAPGESDVVVARQGGRPLSGALTLDDSGQRATGRLQSAASLNIGGAAGLNDVLALSWTQDAEHLRHPLSQSTAASWLLPLGDWTAMASYSGFAYRQTVQGVNQDFISSGHSRNTQLSLSRLLRRDQSGKTELKLSLTRKASRSFIEDAEVAQQRRDLTIAGLELSHRQYWGEAVLDGSIGYQRGIGAWGAQSDAQAAQGGPNPRHQLYQGRLALQLPLHACGQTLRWSSELRGQYSPDLLMSSEQFAIGGRGTVRGFNASSLVGQSGYYLRNELSWPLPPAGALALEPYLGLDAGQISRPVGETGPERSLSGWAAGLRLSLGGHLSAELTHERALHQPQGWDRPAITHFSITAQW

SEQ ID NO: 6155 - protein, 370 aa, Chromobacterium substugae
MKKAILAAAIAAAVPALAQADVTLYGSLRAGVSSTKNSTNNYTSTFGVDDFGSRIGFKGKEDLGNGLKTIWQVETGLSLDGTSGFSSTDSGKLANRESYVGVEGGFGKVRLGYLTDVLGDTESTDNLYGPFRDNMGTGFPLYEATDVFGAYGDSRFKNGIRYDSPELYGFSGTAQYGAGESQAAGQMKQGDKVGLRLAYQNSGFFGAWAYAGALNTKGGSNSATNRLEGGYNANNLYLAANYQWVTLYGNAHAQKSDNSGPVLAGIGNFPTIATGTNKLENTTWAINAAYAFGNFKPSVVYSKRGDAKVDGVRYSLGATQWAAALDYTVSKRTLLQAGYGQVKENRDAQTINGHAQSTSSTVWAMMKHNF

SEQ ID NO: 6156 - protein, 374 aa, Chromobacterium substugae
MSKKDFYDVLGVNRDASDDDIKKAYRKLAMKYHPDRNPDSKEAEDKFKEVKEAYEILSDSQKRSAYDQFGHAGVDPQAGAGGGQGFGGFGDFADIFSDIFGGGQRGGGGGRSNVYRGADLRYNMEITLEEAARGCEKQIRIPSHESCSTCNGSGAKPGTQPKTCSTCGGHGQVRMSQGFFSIQQTCPTCHGSGKQISDPCTSCHGAGQKKTTKTLNVKIPAGVDEGDRIRLGGEGEPGQNGGPAGDLYVVTHIKQHAVFQRDGMDLHCEMPISFSTAALGGEVEIPTLDGMAKVKIAAETQSGRVYRLRGKGVKAVRGSEFGDLHCHVIVETPVKLTERQKELLREFEAISQGDVATHNPRSKSFMDKLRDFFE

SEQ ID NO: 6157 - protein, 640 aa, Chromobacterium substugae
MGKIIGIDLGTTNSCVAVVEGGNPKVIENAEGNRTTPSIIAYVEDGEILVGAPAKRQAVTNPKNTIYAAKRLIGRRFEDKEVQKDIDLMPFEILKAKNGDAWVKVRDQDLAPPQISAEVLRKMKKAAEDYLGEEVTEAVITVPAYFNDSQRQATKDAGRIAGLEVKRIINEPTAAALAFGLAKQEGDRKIAVYDLGGGTFDVSIIEIADVDGEHQFEVLSTNGDTFLGGEDFDQRLIDYIVTEFKKEQGVDLKQDVMALQRLKEAAEKAKIELSSATQTEVNLPYITMDATGPKHLAMKITRAKFESLVDDLITRSIEPCRVALKDAGVSLSDITDVILVGGQTRMPKVQDAVKEFFGKEPRKDVNPDEAVAVGAAIQGSVLSGDRKDVLLLDVTPLSLGIETLGGVMTKLIQKNTTIPTKASQTFSTADDNQTAVTIHVLQGEREKAAANKSLGQFNLGDIPPAPRGIPQIEVEFNIDANGILHVSAKDKASGKQANITIQASSGLSEAEIERMVKDAEANAEEDKKLHELVTARNHAEGLIHSIKKSLSEHGEKIGVDEKAKIEDAVKAAEEVVKGDDKEAIEAKAEELAKASQKLGEIMYAQAAQAEGGAEGAQAAGDKKDDGNVVDAEFEEVKDKK

SEQ ID NO: 6158 - protein, 181 aa, Chromobacterium substugae
MQENQNPAAEAVENEATETASDAHTELEQTPEQHIAGLEAEIAELNDTLLRARAELDNQRRRAQEEVAAAHKYAIGKFAAELVTVKDYLEMALLDQSGQIDTLKMGVDLTLKQLVSAFDKAQIKDIAPKAGDKLDPHQHQAMSAEESDAEPNTVVRVMQKGYLLADRVLRPAMVVVSKAKA

SEQ ID NO: 6159 - protein, 44 aa, Chromobacterium substugae
MFASRHVRTLLDAFLCSPGGPGVLNSVSAYPVFRIFLSNRAVWA

SEQ ID NO: 6160 - protein, 432 aa, Chromobacterium substugae
MTTREQRIAAIQKDWDENPRWKGIKRGYTAADVERLRGSLQVEHSLARHGAEKLWKLVNTEPYINCLGALTGGQAMQQVKAGVKAIYLSGWQVAADNNEYSAMYPDQSLYPVDSVPKVVERINNTFTRADEIQHAKGLDKGDKGYVDYFAPIVADAEAGFGGVLNAYELMKSMIRAGAAGVHFEDQLASVKKCGHMGGKVLVPTQEAVQKLIAARLAADVYGVPTLVIARTDAEAADLLTSDVDPNDEPFLTGERTAEGFYKTKKGLEQAISRAVAYADYADLVWCETGTPDLEFARKFAEAVHAKHPGKMLAYNCSPSFNWKKNLDDATIAKFQRELGAMGYKYQFITLAGIHSMWFNMYDLAQDYVARGMSAYVEKVQEPEFAARDRGYSFVSHQQEVGTGYFDDVTTVIQGGTSSVTALTGSTEEEQFH

SEQ ID NO: 6161 - protein, 127 aa, Chromobacterium substugae
MKKILAGSLIIASSLCFTGCTSMRVIADNQQALSSLASPQQSQLKPGDKISLKTTDGKEYTLVLSAIDQQGLEGKLTDSEQLTRLAWQNISAVQKNEIDGVKTAGLILLLSGATFAIGKAFLSMFPG

SEQ ID NO: 6162 - protein, 159 aa, Chromobacterium substugae
MIPTTPDLCDSFADAVRVLEPIFQSYGGHARFHGQIVTLKLFEDNSLVRQTLGENGQGKVLVVDGGGSRRCALLGDQLGELAVRNGWAGLVIDGCVRDSAALGQLPLGVKALAAHPRKSVKLGGGQRDLPVRIAGCELAPGQWLYADEDGVIVAERQLA

SEQ ID NO: 6163 - protein, 135 aa, Chromobacterium substugae
MTIGLTGGCLCGAVRYRLRGTPFHITHCHCRSCRRASGAAFVTWFTMRVHELEWRGEKPVQYHSSAAVSRGFCPHCGSTLTYFHESDPEEIDITAASLDNPEVLVPEHHTWWEQRLEWGTANAQGALPVHQRGGG

SEQ ID NO: 6164 - protein, 263 aa, Chromobacterium substugae
MRALWLFPAWLCLSAPCQAQALDRSPLRICDDADEWPPYTYYVRKNQQQTRELTGYSVDVITRILDKQRIPFRIDLLPWKRCLSAIDNDEQYLMALSASKNPEREKQFLFSLPYYQTHYYVFYSRAKYPDGVNVAGQADLGRYRLGGVKGYAYSALTAVDKNAMLRAADYPTLARMLQADRFDLFAEDYEVLAGLDRLSVTHIVDNPAIGRMPLPGMPGNAFHMIFSRKNPRGAQLQQLVDRELRQMQASGELEQLLRRYVPR

SEQ ID NO: 6165 - protein, 235 aa, Chromobacterium substugae
MSWIAAIAAVSILAGCAAKPSQAQLDDARQHAQFANDAAAWRQLEDWARNDDADAQRALAEALASDGGMAGWRKARPWYQAAAERGDALSAFRLARIYAKGLGVAADAGQSDRWLALAARRRQADAACMLGLRAKDGGDAAAARRWFELAAERGSAEAMFQLGIAYQEGLGVAVDLPRARGWYEQAARLEMPAALQTLAMAYEGGDLGLKKDPAKASELFNLAAHAIHDFESALF

SEQ ID NO: 6166 - protein, 687 aa, Chromobacterium substugae
MPTLKPIECRLGDSDPVRQERHVMSKHNIAAAGWAVLLLAGCSSGSAPSGRPAEGTTVSVALLETTDIHQNVLSYDYYKLAANPSFGLERAATLIQQARSQYPNNLLLDDGDLIQGTALGDYQAAVNPVKCADTLAVHKVMNYLKYDAGTIGNHEFNFGLPFLSQVTNTDFRLANIARPSACGAPAYPQVLANVANLADKKPIFQPYALLKRTFAGTAPDGSSVQVPVNIGVIGFTPPTIMDWDKKNLNGQVYTNGVVETANTYVPQMRQAGADLVVALSHGGLDPSSYSPAMENGSWHLTKTGIDALMIGHSHDIFPNPGAAGSQFNAMQGVDNNKGFVNGVPTVMAGNWGNRLGVIRLTLKYSGGKWVVQTGQSAVETRSIKNADGSYVAADPRVAQLVAGEHQATINYVKTPIGSTDFRMNTYFALLGDVSAIQIVNMAQQDYVKKYVQANLPQYASLPVLSVSAPFKAGRNGASDYTDVAQGPIAINNAADLYLYPNTVQAVKVSGADVKNWLERAAQMFNSVDPTSSAPQELINSAFQVFNFDVMYGVQYQIDVSQPVGSRIVNLTYDGQPIDPSQQFIVATNNYRASGGGNFPGIDGTKTIIQAPDANRDVLIAYIKANGDLGRAQYGSSRPWSFVKINAKVNFKSIANQLAAASLAGINGVSQGADNGDGTWTYLVDLSK

SEQ ID NO: 6167 - protein, 38 aa, Chromobacterium substugae
MHPNFLFLADFSCFALPIVRQSGAWIILAMFFNRFSSH

SEQ ID NO: 6168 - protein, 126 aa, Chromobacterium substugae
MQRNMLKSKLHRVTTTHAELHYIGSCAIDENLLEAADILEYEEVQIWNVTNGERFATYAIKAERGSGVISVNGSAARRAAPGDLLIIASFAQYEDAELKNHSPKLVFVDGDNRLTEVKGATPTQPA

SEQ ID NO: 6169 - protein, 297 aa, Chromobacterium substugae
MEIIRTVADMRAWRKQAGKLAFVPTMGNLHEGHLALVQAARGQADKVVVSIFVNRLQFGQGEDFDAYPRTFEADCDKLRAAGVDALFFPTEGELYPRVKQDFNVEPPRIQDELCGAFRPGHFRGVATVVTKLFNIVQPDLACFGKKDFQQLHVIKAMVEDLNSPIEILPVDTGRAADGLALSSRNGYLSAEERAEAPRLYRNLTAIRDGLLAGSQDYAALEQSARDDLSAAGWVVDYVEVRQADTLEIAHAGEKRLVVLAAARLGRTRLIDNIEVFRAGTTRKLSCNAICSSPSSTA

SEQ ID NO: 6170 - protein, 262 aa, Chromobacterium substugae
MKITVNTLHKLAAEGQKITMLTCYDASFASLLDEAGVEILLVGDSLGPVMQGVDSTLPVSEADMLYHIRCVARGSKNALILGDMTFGAYQESPQQAFAHAARLLQAGAHMVKLEGGAYMAETTRFLVERGIPVCSHIGLTPQFVNAFGGYRVQGRGDDAQRIVNDAKALSDAGASLIVMECVPAALAKEITAAISAPTIGIGAGVDTSGQVLVLHDMLGVYPGKKAKFVKNFMEEADSIQGAVEAYVKAVKEQTFPTAEHTY

SEQ ID NO: 6171 - protein, 211 aa, Chromobacterium substugae
MSQLRYVVVEGPIGSGKSSLAARLAQYWGVQLKAEDPAANPFLPRFYRNMPAHALSTQLSFLMQRADMAREMLQGDLMAAPLVSDFLFEKDALFARLNLDEHELALYQRLARQALPEYPVPDLVIYLQASEDTLLQRVAARAVEYEVNFPEGYLKRVQAGYSEFFHQYESSPLLIVNTDHLNLVDGDEDFDLLIRCIAEMRGQRSYFNKSV

SEQ ID NO: 6172 - protein, 169 aa, Chromobacterium substugae
MTLAYVALGSNLEQPAQQVGAALAALGHLAGATLLRHSSLYRTAPVGYADQPDFINAVALLDTDLPPLALLDRLFEIEQRFGRERSFRNAPRVLDLDLLHYDGVIMSEPRLTLPHPRMRERAFVMVPLAEIAPAGMLPGVGDVAALAAALDASGVERLDESRGTRQQQE

SEQ ID NO: 6173 - protein, 455 aa, Chromobacterium substugae
MIRKLIRKVLDLPAGMSKRRNKPRVFPLPQHGVRRDQLSQAALRVTSRLQEAGYAAYVVGGAVRDLMLGVSPKDFDVATNATPEQVHHLFRRSRIIGRRFRIVHVMMGPETIEVTTFRGGNVDDTNETGRIMADNSFGSQEEDAHRRDFTVNALFYDPSDETVIDYHNGVKDLHAKKLVMIGQPARRYQEDPVRMLRAVRLAAKLGFEIDEDTKKPIRAHAHLLKKEPAARLFDEMLKLLMSGQAYACLKKLRDEGLARGVFPLLDAVMDDKGNDDAFLRLSLESTDARLRADKPISVGFLLATLLWRQVNQGWQQRLAAGEKSLPALLSAISDVESEQDNDFAIPRRFSVTMREIWTLQARFDSRSGGRPYRFLEQPRFRAAYDFLALRSEAGEVPAQLVSWWERFQRADADECERLIAEAKEQGGDAEPAKKRRRRRSNSRRRDESGGGESAE

SEQ ID NO: 6174 - protein, 341 aa, Chromobacterium substugae
MAAPSDGLHGIPVLFPLNPARIRISFKKILIKMVRTDDLQVFIRAADNGSLSAAARQLDLSPAVASAALKRLEQAVGAQLLARSTRSLRLTLAGERYLEHARAALDALRAGSVALAQDRQALSGSLSLSMPSDLGRNLLRPWLDDFLLRHPGLGLQLQISDRVADLYRQPVDVALRYGVPEDSALVALPLAPDNRRVLCASPDYLARHGAPAAPQELRGRECLRFILGAAVHERWSFAQGGERQTVTVAGRWQSDDGEIVRRWALAGRGIAYKSRLDVLADLRAGRLLPLLDGYDTEQTPLFLVTPHRLMLSPAVVALRAHLRQCLDGYLLGPDAAGDSLD

SEQ ID NO: 6175 - protein, 337 aa, Chromobacterium substugae
MKAVAYYQNLPISHPEALQDVQLPEPVVGEHDLLVEVKAISVNPVDVKVRANMAPEAGEARVLGWDAAGVVKAVGSQVSLFRPGDRVWYAGALQRPGANSELHAVDERIVGRMPDSLDFETAAALPLTAITAWELLFDRLQVLANQQPSGKKLLVVGAAGGVGSILVQLARRLTGLTVIGTASRPETQAWVAELGAHHVIDHRQPLSRELKRIGIDQVDYVASLNQTDQHFGEIVEALAPQGKLALIDDPAALDISQLKRKSLSLHWEFMYTRSMFTTDDQIEQHKLLTELARLVDAGIVKSTVAERFGAINADNLKRAHALLESHTAKGKIVLSGF

SEQ ID NO: 6176 - protein, 98 aa, Chromobacterium substugae
MIVEIVRLRVKPGLSQAFETAWAEASARYLRRQPGYQAHKLGRQLETERDYLLAVQWDSLDAHRAFMDHADFQPFAQSFWHFFDGEPDLIHFQPNPAL

SEQ ID NO: 6177 - protein, 76 aa, Chromobacterium substugae
MSPAAAPQMTALLARVRAAGTLDIATETLAQARAAAEGLRRWQAPPGWIRCATTAWITPRRCARPASIPAASCCPA

SEQ ID NO: 6178 - protein, 45 aa, Chromobacterium substugae
MSGLTHAGLHLSGVVAQARRLTDLGGEALRRALAAAPPPNATETT

SEQ ID NO: 6179 - protein, 267 aa, Chromobacterium substugae
MNRPHLTLITIDLSFHHASAAVVAALLEEHGVAVSEWRVPHERAFELLRNGEGDLLCSAWLPGSHGAYLAPLEDEVEKLAVLYTPYALWGVPDYVPQEQVPSLADLKKPEVAARMQKTIQGINPGAGISRFSLEIIERYRLDEAGYHFRHGSLDDCATAFERAVANQDWAVVPLWQPQFLHWRHSIRELADPEKLLRGKDEATLLIRKSALARLPPAAVEALRALTLGNPSVVCLDHQISRQGMDPLQAARHWLQTARAAASAIKAT

SEQ ID NO: 6180 - protein, 516 aa, Chromobacterium substugae
MYSKSSPSGGGQPGGIARRLPPHHLKHGAAALAVAIALAGCAVGPDFKPPVLPSAANGPYTEAPLPASTVSARGEHVGPAGASQRLANGQDLPEQWWTLFRSDSLDQLIRAALEHNPTLDAAQASLALARENYNAAAGTAYYPAVNAQLGGGRQRAILTGTSPSEFNVYNATVNVSYTLDLFGGERRQLESLMAATDYQRFQTEAAYQTLIANVVTTAVQEASLRGQLEATRELLKAQEEQLRIVDKQVALGAQPRAAALTQGTLVAQTRALLPPLDKALAQTRHQLAVFVGRFPGEGGLPEFHLDSLRLPAELPVSLPSDLAKQRPDIRASEALLHQASANVGVATANQYPQITLSGNYGTQHTVLPGMDLGNTLWGLSAGLTQPLFNGGALSAKRRGAEAAYRQAEAQYRSTVLKAFQNVADSLRAVDADALALKAQADAETQARESLQVHTRQYQLGGISYLSLLDAQRSYQQARIGLIQAQAARYNDTAALFLALGGGWWRHPAADGQGAGG

SEQ ID NO: 6181 - protein, 368 aa, Chromobacterium substugae
MTKRMLIMLGCVVLLVAALGVGFFLHIQKLIASSPKPGPQTVSTTIAKTQEWQPQLGSVGTLTAVHGVDISSEVAGQVREIAFKSGQDVRAGEVLVQLNADADVAQLRSLQAAAELSATTLKRDRAQLAVQGVSQAQVDADEADLKSKKALVAQQAALVAKKTIRAPFAGRLGITTVNPGQFLNPGDKIVTLQTIDPVYVDFNLPQRQIGQVRIGQSVSLKSDAFGNELFHGKINAISPKIDPATRNVQVEATIANPKRKLLPGMFANTTIDVGSKQKHLTLPQTAITYNPYGSTVFIVKAGKNGPEAQQAFVTTGDTRGDQVAILSGLKEGQEVVTSGQLKLKTGTPIAVNNSVQPADSPNPTPQEH

SEQ ID NO: 6182 - protein, 1021 aa, Chromobacterium substugae
MNFTDIFIRRPVLATTVSLLIVVLGLRSLFGLPVNQYPRTQNAVVTISTAYYGADAKTVAGFITQPLESAIAQAQGIDYLSSTSTSGVSTITATLRLNYDANRALTEINTQVNSVKNQLPAQAQQPVLTVQTGQTTDAMYMGFYSDTLPTNNVTDYLVRVVKPKLDSVPGVQTAEILGARQFALRAWLDSAKMAAHGVTAADVSAALANNNTLTALGASKGQMVTIPLTAATDLHSVDEFKQLAVKRNGDAIVRLEDVATVTLGSENYDFNVAFSGVRSVFIGIKVAPEANILDVAERVRTVFPSIQQQLPTGLTGQIVYDSTDFINTSIHEVVKTLLEALVIVTVVIFLFLGSFRAVVVPVIAMPLSLIGTFFIMLMLGYSINLLTLLALVLAIGLVVDDAIIVVENVDRHMREGKTPLEAAIIAARELGGPILAMTVVLVAVYVPIGFQGGLTGALFTEFAFTLAASVTVSGVVALTLSPMMCSRFFKSDMDNSPFVHAIDRTFERVRHRYQRILRSLLQTWPVLIVMGVILIALLGLMFKMSKSELAPEEDQGIVLSQVVGAPTATADQMQAYADQVFQVGKSMPEYKQMFQITGVPTTNAGIGGVLFKEWDQRKRSAHEIQLDLQARWNKIAGARVAAFQFPALPGASGLPVQFVITTTEPFENLNQVAQQVMDKARASGKFYFVDADLKIDKPQATVVVDRDKITALGLTQQDVGNSLSAALGGGYVNYFSIDGRSYKVIPQVLQTDRLNPSQLLDYYIKTPNSGVIPVGTVAKLKYDVVPESITRFQQLNSVTISGVAGVSQGEVLQFMRDTVQQVAPSGYTVDYSGQSRQFMQESGGFLVTMMFAVIIVFLALAALFESFRDPVVILVSVPLALFGAMIFIFLGFSSLNIYTEVGLVTLMGLISKHGILIVEVANELRKTGLSKQDAIEQAAAIRLRPILMTTAAMVFGVIPLVIASGAGAAGRYAMGLVIFTGLSIGTLFTLFVVPAMYMFLASKRETAVETAGDAALENQPR

SEQ ID NO: 6183 - protein, 259 aa, Chromobacterium substugae
MSITIQAAGASVNYTCSGVGRPLVLLHGTSVDAQGNFGQVAERFADHCQVVMPNYGGCGGSTLPDGELTLDILVEQVAAVIRHAADEPVDLLGDSLGAVVAAAVAARHPDRVRRLILVAGWADSGDARHQMVFEGWRRLLAADAELCNRYAFALAVSPAALTRFGGDSIDALLRQPMPPDTARRVELGLRIDIRQAARTIAAPTLVVACRQDYLVPPYQTRGLHQLIPGSRCVEIDSGHAAFLERPDELVALVREFCLA

SEQ ID NO: 6184 - protein, 247 aa, Chromobacterium substugae
MLRQNRIPGRGSHDAGPRCCIARPAAQPEICRRRGKQSEKMKQTMEARRVSGLILAGGQGMRMGGQDKGWLELVGAPLVELTLARLRPQLANGELLISANRNLERYAALARALPDAPEFAGCGPLAGLEAGLAACAAPWLVAVPCDLPFLPADLASRLLAPLLRGEASLSAASCAGRQHPACMALSVELLEDLRAYLRADGRKVREWQARVGALQIDFDDAPEAFRNLNTPDDLAAAEAYASQWRQS

SEQ ID NO: 6185 - protein, 398 aa, Chromobacterium substugae
MLAFEDAQRYLADYAPPLTGTETVRLDEAAGRVLARTLTAALDMPPADNSAMDGYALRCADAAPGVALPVQQRCYAGQAPEALLPGQAIRLFTGSLLPDGADAVAMQEDAEEADGMVTISRPPLPGQHIRRRGEDVAAGAILLEAGCVLGPGHIALLASQGMAEVPVFPRLKVGILTSGDELVAPGEARAPQQIYNSNGAMLAALAAGMGARVAARRHARDVEDELRQAFVELARECDLVLSVGGVSVGERDLVKPVLAGLGAELDLWKVRMKPGKPVALARLGATPVVCLPGNPVSAYVVFALLVTPLMRRMQGRGECFPPVGQLPLASGAQRKDCGREDFLRVRLESDARLHPHGRQAAGIISALPGSSGLARLPADRQLADGDRVAYYDWRHWLA

SEQ ID NO: 6186 - protein, 172 aa, Chromobacterium substugae
MHDEQAVSLRCAVLTISDRRTLDNDGAGDLLAEKLSQDGHVCARRGIVADNIYQIRRVLSEWIAEDEVQVILTSGGTGFSPRNSAPEAVLPLLDKEIDGFGELYRHFSLAQVGSSALQSRALAGFANRTLIFCLPGAERACELAWDKILREQLDSRHQPCNFASAFRVKEES

SEQ ID NO: 6187 - protein, 265 aa, Chromobacterium substugae
MGEGDGFIQCAVTRHQEDGGQRADADRVAEETPVALVFNGISHAVMMATPCDLEALAVGFALTEGIVARRGEIFDVEAEFFASGAEVRLEIAQPAFLGLKERRRSLEGRSGCGVCGIESLALLDLAPTPIAAARRIIARADIIARAARELPEHQRLMRATGGVHAAAWCGPDGAVLRAFEDVGRHNAMDKLIGHLALQGAALDEGFVFMSSRASYELARKAARMGIPLLATISAPTSLAVDIARQAGMSLASFCRKNGFVEYTAG

SEQ ID NO: 6188 - protein, 92 aa, Chromobacterium substugae
MTQPSSDQLDPAIAALLAQLWRAAQSGGPAWSLPRLCKQSGLRMSTLRRSLTLLAELELAAIELYADGRGRAWLSDDGLALCRQLFEPGDEG

SEQ ID NO: 6189 - protein, 767 aa, Chromobacterium substugae
MDHSKTKGRIEPYAPPAGGLGSLKSTTVALVKEKVPGSRYKTLFHQNQPDGFDCPGCAWPDREHTSTFEFCENGVKAVAAEATGKRIGADFFARHTVTALLEQSDYELEQHGRLTEPLAYDAASDRYLPISWDDAFALTARHLRALPDPNQASFYTSGRTSNETAYLFQLFVRMFGTNNFPDCSNLCHESTSRALPATVGVGKATVILDDFEHADTILVFGQNPATNHPRMLNELRECAKRGAAIVSINPLKERGLERFASPQHPLDMVGGGVAISSMFIRPTLGGDFALIKGVAKRVLELDDEAVAAGGERVLDAGFLAEHCSGFDAFAADLRAESWPALAADSGVPWSDIDALARLYARGKAVIATWGMGLTQHKNSVAAIQMLSNLMMMRGNIGKRGAGLCPVRGHSNVQGDRTVGIEDKPTPAFLDRLRDVYGFEPPRHHGLDAVDTIAAMRDGRVKVFVGLGGNFAMATPDTPLTFAALRNCALTVQISTKLNRSHLIHGKDALILPTLGRTEIDLQKSGPQGVTVEDSMCMVHLSYGINPPASRELRSETAIVAGIAQATLGGGKVDWLSFVDDYAKIRDEIAKVLDAFRDFNARVAKPGGFHLTPASRERRWLTPAGKAQFIVHALERDTPIQRARARHGDQLMVLMTARSHDQYNTTIYAMDDRYRGVYGQRRVLFIHRDDLARLGFSAGERVDLFTVWDDDVERRADGFLLVEYDIPRGCLGAYFPETNPLIPLDSVADVSNTPTSKSVPVLLRRAAG

SEQ ID NO: 6190 - protein, 1734 aa, Chromobacterium substugae
MLALLAGLGLSALVSWQLARQNDADVQLAVRSATQRMARQVAYRVLRYQFGLKAMRGVAMAAGERGLSRERFRDYSEGRDIAAEFPGAQGFGYILRVPLRQSAAFERRMRREGMSDFRIWQLQPHQGERDVVAYIQPELGNLRAVGLDIASEPNRRATAEQALRSGQMTMTAPIKLVQRSLAQDPAFVVLLAVYRGGVVPATGAARMEQGYGWVSVPLHMKTVMGGLEQEQGGVRVELNDVTDPARPIAVYASAAPAGQALASYSEYQLVLGRRWQLTLRAYPGFAARLQQPRPAAAGLAGAFLSLLGALLAFIWQRSHQRRMQLAATQARLATIVENSADAIIGKTLAGVITDWNRSAERMLGFSAAEAIGRPLAGLVVPQERQSQVEDILARVGRGEPVEHFATRWRRKDGSLVDVSVSISPVRDAAGEVAGASTSVRDISRQKQVEAQLHSLNSHLEELVAERGAELGKARHTLRTVVDAVPSLIGYWDRGQINRVANRAYLDWFGVAADSLPGLSLRELLGAELYRANQPYIEAALRGEPQTFERRIPGPDGRVRDALTHYLPDIVDGEVQGFYAVVHDVSELVESRDRQARARQEVDLLLSTINRQLLYSVTGADGRLLEVNDLFCRSHGYAREALLGRDLQWLDGGGQTPAFWSALSDALRRGEAWRGEMCNRASDGGLRWLDTVIAPQLGADGSLGRCVALSIDTTERRRADAELGRVNRLLSDVLGAASEISIIATDVDGVITLFNRGAERMLGYRAEELVGVSTPGRFHPAEEIAARGRELSERYGQPIEGFRIFVHESEILGADHSQWTYLRKDGSQLKISLVVTTMRDDEGRINGYLGIAVDITAQLQQQQELTVARDQLQMAADVAQLGVWSWVPADGMLNWNHRMFEIHGLAPQPEPARQELEYRSWLERLHPDDARRMEAGMMAAAAEGGAYDAAFRVVRPNGEVRQLQAGARIERDGDGRALRFTGICEDVTERQAYEATLLEAKRQAEQASIAKGQFLANMSHEIRTPMNAVLGLLQLLQRTGLDGRQRDYVEKTQAAARSLLGLLNDILDFSKIDAGKLQLDPHPFDLESLMRDLAVVLSGNHGDRNVEVLFRMDPTLPSMLYGDRLRLQQILINLAGNALKFTVAGQVVVSLSATRRGERDVVLRFEILDSGIGISAEQLNRIFEGFSQAEASTSRRFGGTGLGLVISKGLIELMGGRLQVESRPGEGSRFWFELAFGLSGGAALAASWPGDGLRVLVVDDNALAGEILLDTLSLVGWHADYANGGEEAIALARAAIAGGWRYDVVLMDWRMPGLDGVETARRMRQQAAPNHSPVIVMVTAFGREVLAGIAQQPQAPFCDVLTKPVTPQQLVDAIRRAVAGADNDLCEAMPPAAPRRLAGLRLLLVEDNALNRQVAMELLRDEGAEVALAEGGLQGVALASAADPLYDVVIMDVQMPDIDGLEATRRLRADPRCQALPILAMTANASRADRDECLAAGMDDHVGKPIDIDELVAKLQALAGWQARNTQMTGGEGEDGGSDDGPAIEALPSRLRRFGNKLKVYRAALATFRPECERLLADMERQVDKGAWPGLLVSLHALKGVAATMGATALNRQAQELSRLVKAGNPGRLAATALADRLRELERLADSSAGQLAASLPAEARSAPASGALALERDRLRDVLALLEDHNLAVIDLIEELLALELGDSEARVRQAAACVQRLQFGDAIAIVRGLVAAG

SEQ ID NO: 6191 - protein, 826 aa, Chromobacterium substugae
MFNDLRHERARILIVDDMASNIHVIREAVRDLGEVRFATSGREALEMAQRAVPDVILLDIEMPGMDGYAVCREIKATPRLSDIPVIFVTSHDEDGHELQALNIGGVDFLHKPLNVPVARARVQTQLALRLRTRQLAAAQRDLAEVLRRLPAFVAYWNADLCNEFANDESGAWFGIAAADMRGLPARAVLGEANFLAMELRLRAALNGDAATFDLSLAKPDGGTLHGQVALAHRPQEGGRPGCLMLIADVTERKRAELALRDEKERIRITLNSIGDAVIATDAAGRVTFLNPIAEEMTGWLAKEALGQPIESVMPLQASDAGRGVDNPVRLVLAERRAVGMTLDRALLRRDGRLLEVEDSAAPILDHAGELTGAIIVFHNVGEARALAVKMMHLAQHDALTNLPNRMLLQDRTQQALRQAESSGERLGLFILDLDHFKVINDSVGHSVGDRLLQLVAKRLQAIVRPGDTISRQGGDEFIILMPDPVSIEQLGAVAARLQKAVSEPCLLDEERFDLSVSIGVSLYPDDSRDQEELYRHADAAMYQAKEDGRNRYRFFSAEIEEALLSRQALERHIRMGAESGGFRAYYQAKVDVTEGRIVGVEALMRWRDESGEIISPGHFIPLAEETGLILPLGRFILRQACLDGKRWHDAGLPLRIAVNVSAAQIADGCFSDTVRAVLAETGIAPQLLELEITEGVLAANIAQTMSVLAELKRLGVAIAVDDFGTGYSNLAYLRQFPIDVLKIDQSFVRDMIGDKSNLAIISAIVSMAQGLDLQLVAEGVESAEQERALLALGCRVMQGFLYGRPVPVEEMDRQLGNGARLAGSQA

SEQ ID NO: 6192 - protein, 508 aa, Chromobacterium substugae
MNAAVGAPHRGMITVAIMLATIMQALDTTIANVALPHMQGSLQSSQDQISWVLTSYIVAAAIATLLTGWLCARFGRRRVLLASVAGFTVASALCGLADSLWQIVAARLLQGVFGAALVPLSQAVLLDINSKEKVGQAMAIWGAGIMVGPILGPLLGGWLTDNASWRWVFYINLPVGVLAFYGIARYLPESRAGNDKLDRFGLATLCVAIGALQLFLDRGEQLDWFSSAEICLEAIVCAAAFVYFIIHTWSAPEGQSFLSRGLLRDRNFVTGSLFIFVVGMILYATMALLPSLLQSLLDYPVVFTGEVMAPRGVGTMLAMMLVGRLVHKADPRLIMAGGFLLTALSLYQMAGIAPNMGSGIIVLSGFIQGAGLGFTFVPLSMVTFATLEPQLRNEGTPIYSLLRNVGSSVGISLVQTMLTEDAARAHAVLGEHVALGSPLLRELPAALSPFTDAGRALLNLEVTRQAEMVAYIDDFTVMMWLSLAVLPLLLLIRRPAPSAPAAGADSAH

SEQ ID NO: 6193 - protein, 150 aa, Chromobacterium substugae
MKIRIAERFGFLVSDTGRLYGRVFDQRARQQLGLSLAQCRLLGALAAHEGEKPLSQAELADKLDLTPMGVATLCDRMQAAGWLRRVPSATDRRVNEIELLEPAFAALKSAMALGDELQQQAQQGLSPEEDAQLRALLGKVHGNLASLLSR

SEQ ID NO: 6194 - protein, 462 aa, Chromobacterium substugae
MQTEVKEKPRYAIVASVQLPEVSDVEFEASLTELSELAKTLGFQVVQTFVQKRNSFDRTAYMGVGKLEEISMFVKRGIRADELEDEPQQMDASAVEIDALLVDHEISPSQMRNLELAVGCEVMDRTMVILEIFHRNARSRAARAQVEIARLGYMAPRLREAAKLAGPQGRQRSGMGGRGSGESHTELDRRKVRDRIAELQREITAMELERKTQRARRLERQGQGLGGVSLVGYTNAGKSTLMRALTGSEVLVANKLFATLDTTVRVLYPESVPRVLVSDTVGFIKNLPHGLVASFKSTLEEALDASLLLHAIDASDPGFERQLEVTDVVLKEIGADEVPRIRVFNKIDHVGDAAAQAAWTAELRQRYPGCVVMSALRPDDVAGLHAAIVSFFQQDLVEEELLLPWSAQQLRGEIYSHCQVLEEHAEDEGSRFRVRGEPEKLRRLREQLNPGSQGREKEYWEL

SEQ ID NO: 6195 - protein, 420 aa, Chromobacterium substugae
MSFASLGLQPDLVQSALEQGYIQPTAIQNAAIPAILQGGDVLATAQTGSGKTAAFCLPLLQQWLASPRAVLRQPRSLILLPTRELAAQVGEILRDLAQALPRKLKVAVVYGGVSINPQMMALRGGADIVVATPGRLLDLHQHNALRLSSVKTLVLDEADRLLDQGFAEELNRVLALLPAGRQNLMLSATFPPAVCSLAQTLLNQPLRIDIEQNAATAPDIRQRAIEVDADKRTLLLRHLLATHDWDRVLVFVASRQAADRVAGKLARNGVAAAALHGDCSQSQRGQALADLKSGRLRVLVATDVAARGIDIARLPLVVNYDLPRSPADYIHRIGRTGRAGASGEAISFVSADCAAHFKLIEKRQQLRLPRERIDGFEPSEAAAPAASLTDPDGNGGIKGKRKSKKDKLREAAAQQTAADR

SEQ ID NO: 6196 - protein, 288 aa, Chromobacterium substugae
MMKRLHCVLGIAMAALLSACGSLQSIPAAKVPAAVAANGVALSQARPTKDEVDSRSYEIPEHSAFVRQTSGGSVAVGVLLGPLGVLANSMNIDRLTQDMGESGKSSALYQLDARAEAIAAIGDELGKLNAGSIRDKAALKPYLMYFVADEKVGIQVQLHLRAESTVEEDGKSKPWVGEYVVLLRDALPFSALTSQDPAALQALRGDIKAGYRELLDEMAKDFSAGALPRRDIAWVIAPVLGLGMPGDIEYNAQGHMVLRSQWGKYNLVIFQDKKSYAFSNGPVPREQG

SEQ ID NO: 6197 - protein, 392 aa, Chromobacterium substugae
MIVRFYLKMASVQKGKALQLQLYDGVAAIKRPAWPQGEGAGVFVGQAWLTALEETGCVGGATGWQPMPLALERDGQAVALAPAYLKRHNRGEYVFDWSWAEAYARSGLDYYPKLVVASPFTPVTGGRLLGGADEQAHLIAGLRQLVDDNGLSSAHVLFPTADEASRLRQAGWLLRDGVQFHWRNRGYADFDDFLATLSRDKRKKIRQERRKVAEAGVEVRALAGAEISDADWRLFYRCYRQTYLEHGSAPYLNLDFFRLIGERLAGHCVMFVASRGGRPIAASLCMRQNDVLYGRYWGALDDVPCLHFELCYYQGLEYAIAQGVEAFEGGAQGEHKLARGFEPVATCSAHYIADGRFRAAIAAWLERERQGMGDYVDELFSHSAYKTLAPDE

SEQ ID NO: 6198 - protein, 530 aa, Chromobacterium substugae
MRIALAQFNPVVGDIAGNAEKILSLAHAAIAQGADVLVTPELALTGYSPEDLLLRESFYREVAKGLDAIEQLDGITVIVGHPARIGNERFNAATVLRDGNRLGQYHKMQLPNNEVFDECRYFTPGAAPLVFEQNGVKVGVLICEDIWHLEPAAETADAGAELIVALNASPFHRDKIETRQQMARFRVEETGLPLAYVQMVGGQDELVFDGASFAVNKDGEVVAQAAAYDEELLLVDYADGDFQPGKQAALPDALESVYRTLVVGVRDYIVKNGFPGALLGLSGGIDSALTLAVAVDALGADKVHAVMMPSRYTADISVADSRDMIARLGVKYDEIEIWPMYESFMAALAPSFDGLAMDTTEENLQARIRGTLLMALSNKSGKLVLTTGNKSEMTTGYCTLYGDMAGGFAVLKDVAKTLVFELCRWRNNVSDVIPERIITRPPSAELRPDQKDQDSLPPYEILDAIMARYVEGNQSAADIIAAGFAEADVNRVVRLLKINEYKRRQAPVGPRVTQRGFGKDWRYPITNRFS

SEQ ID NO: 6199 - protein, 371 aa, Chromobacterium substugae
MTRIKLAAAAALSSLALLTGCATPLAGKPADEATRKVIAQNWQNASYNFDGQLGFTQLRFIDSEGKLSQPDIADTVDQVGRSIKMNISGAIDAPTGRLELTPELRFERRNLLASVKVPLQFHAQDMSLLVDPSAIDLALPSLRKNPGKFIRAKLPADIAAKIPLKEMYQAMPQILDQAYAQVDKKAFSFEPLDAYADEVGAKYKLRLTLSKEQEQKMTLQILDGLAKAAHQQAAQPDDKFNAESMLTLVRDLVKLSPAGEMNGQTVSDIYVSRGGELEAIRQTIHMTSAEFSADAYFNLRYSHHGKPQFVYQPAESDIIDYDKLELPDWLKSKAGADEAPAADAALPAPAYPQPAAPAAKAKKRKAKPRAQ

SEQ ID NO: 6200 - protein, 205 aa, Chromobacterium substugae
MKPLKLALTAAALACLAVPAHASAIAQLKAFVAGSKTLSADFTQLVTNKGKREEASGRLEIARPGKFRWEYSKPYSQLIVGDGKTLWIYDQDLAQVTRKAQGAALGSSPAALLAGSNAIERDYRLNEAGKQGDVEWLTASPKKQDNTFSSVRMGFKGNMLVEMQLTDSFGNDTRVSFVKPQQNVVLPANRFAFVPPKGVDVVSGD

SEQ ID NO: 6201 - protein, 266 aa, Chromobacterium substugae
MPDAVQQHDVFHYNQAAWDRQARADCEWSRPVDAAAIAEARRGRVLARLTPSPLPAGWLDDARGLDVLCLAGGGGQQAPLLAAAGARVTVLDASVEQLARDREVAERESLAFRLEQGDMRDLSRFADASFDCVFHPISNLYVPDVAPVWRECHRVLRPGGRLLASFYNPAVFVADRDPALMEQGLIRPRFAIPYADPEHLSEAELEAKRTRGEALVFGHSLDELIGGQTAAGFLIAGFHEDWQPRPRFLIDRYLPTFIATWALKPA

SEQ ID NO: 6202 - protein, 198 aa, Chromobacterium substugae
MKNPPALEHLIAALKVLPGVGPKTAQRMAFHLLQRDKKGADKLARALDRALTQLTHCQRCNTFSEAELCSICADEGRRQDQLCIVEMPADLMMLEQAKCFEGLYFVLMGRISPLDNIGPKDLNLDKLLTRALDGQVSEIVIATNFTAEGEVTSHMLSELFKERGLAVTRIARGMPVGGELEYVDLGTLAQAVYERRGV

SEQ ID NO: 6203 - protein, 147 aa, Chromobacterium substugae
MFGHFTMRSRLPRPPETVWRDVVSRGGIADEFFPWLGMRLPAGELPARLEAPLRVGSCWLLLFGCLPVECDDLTLMRLEPGAFDERSRMLGQRVWWHRRRVAATADGCELVDRVAFLPRWPATLPLCRLLFRLVFAWRHRRLRRRYR

SEQ ID NO: 6204 - protein, 98 aa, Chromobacterium substugae
MKQAQQMQENMKKAQDELATVEVEGQSGAGMVKVVMTCAHGVKRVAIDDSVLDDKEMLEDLIAAAFNDAARKVESTTQERMSGFTNGLNLPAGMKLPF

SEQ ID NO: 6205 - protein, 642 aa, Chromobacterium substugae
MSYQVLARKWRPKRFADLVGQEHVVRALSNALKEARLHHAYLLTGTRGVGKTTIARILAKSLNCETGSTADPCGECSACRQIDSGRFVDLLEIDAASNTGIDNIREVLENAQYAPTMGRYKVYIIDEVHMLSKSAFNAMLKTLEEPPAHVKFILATTDPQKVPVTVLSRCLQFSLRNMTPQQVSTHLAHMLDVEGIAYETAALALLGRAAAGSMRDAQSLLDQAIAYGLGEVKEDGVRAMLGAVDRRYLYTLLQALSAGDGAALMAEADNLAERGVSFDAALAELAVLLQQLALAQTVPAALADDEPEREALFALADAIAPQDVQLYYQIAIHGRKDLALAPDEHAGFNMTLLRMLAFHPVNAPAEAAAPARAAVAPQARPAAASAAVASVSVPAERGMSPAARALQAAGLAAPTPAKSAPRAASEESVPAAEPEPEPAPRPQPAPAAAPAPEALVAAPAPAPQPQLVATASEADDDGRDEDEIDDTPWQADDGDAMPDYAQAPPPDDEPVDYQFDGDWQALVVDLGGKLGAARMLAHNAVLKGWNQQRLELAVPESFRHMSGRDYQDKLKAALSERFGRAVELTVTVEELGMETPAMVDARQRQEQLAIARECMKNDPVVQQLVREMGAALLIETIQPVQE

SEQ ID NO: 6206 - protein, 347 aa, Chromobacterium substugae
MKSMLKLAIAAALAGAAFSAPQAQADAAFLGRPDVQRYIDEQVASGQFNRPELEAVFANVELKPNIIRILDKPSTSRPWYQFRASTVSDKVIADGAAFWQDNADALARAERQYGVPPEVIVAILGVETHYGRNTGSFRLVDSLSTIGFDYPRRAAYFRGELTQFLLLAKEEGKDPLTLRGSYAGAMGLPQFMPSSYRKWAVDFDGSGHRDIWNNPHDAIGSVAHYFSRFGWKRGDDVVAPASVVPGPQVDKLLADKFNLHYTVGDLRKMGVAPQTPLADNVPAVLFALESSPGVTEYWLGLNNFYAITRYNRSTLYAKAVQEIADQVRQRYYAALARKLPEPASAAQ

SEQ ID NO: 6207 - protein, 339 aa, Chromobacterium substugae
MNERAQRLLKVLIERYIADGQPVASKALSLLPGMELSSASIRNVLAELEGMGLIASPHTSAGRVPTARGYRLFVDRLLTIRPLDELARHELEASLQPDSPQRIVQAASSLLSELTSFAGVVMTPQRSDVAFRQIEFLRLSERRILMILVTLDGDVQNHLLLTERDYTPSELVEAGNFINQHYSGQALDAVTSRVEGELRQLQGDIAELMSAAVRLGQKTLASSGEDVVVSGGSRLLQVNDLSDDLSRLRELFGVFERKTELLKLLSQSREAQGVNIFIGEESGLVTLDECSVVTAPYRVNGQVVGTLGVVGPTRMAYERVIPIVDITARLVGSALSFRE

SEQ ID NO: 6208 - protein, 350 aa, Chromobacterium substugae
MASEDKSKALAAALSQIEKQFGKGSIMRMSDNQINENLQVVSTGSLSLDLALGVGGLPRGRVVEIYGPESSGKTTLCLQAVAEMQKLGGTCAYIDAENALDPQYAQKLGVKVDDLLISQPDTGEQALEICDMLVRSSGVDLIVIDSVAALVPKAEIEGEMGDSHVGLQARLMSQALRKLTGNIKRTNTLVIFINQIRMKIGVMFGNPETTTGGNALKFYASVRLDIRRTGGIKKGEEVIGNDTRVKVVKNKVSPPFRQADFEILYGEGISRQGEIIELGVKHGFIDKSGAWYAYNGQKIGQGKDNTREWLKSNPAIAEEIERKIREAVGVKIEINENQGDEEFADDALDA

SEQ ID NO: 6209 - protein, 152 aa, Chromobacterium substugae
MAATGKSLKARAVELLARREYSRRELVRRLAPFADSEDELNAALDELAAANWQSDDRFARQFANSKGGKFGSRRLQQEMRQRGVDDDTIREALSGQDDLASAREQWRKKFGRPPADAAEKARQYRFLAQRGFPGDVIRQVLAGGADDDGYED

SEQ ID NO: 6210 - protein, 152 aa, Chromobacterium substugae
MRARAIATEIDITAAHETVWQVLCDWPRYPEWNPFIVGLHGRHRLGARLVATLRYPGGARATLRPVVIELSAPQALAWRSAALMPGLLDREHRWRLEALAGGATRLHHDGALSGVLLPLCGAGIQESARRGFLLMNEALKQRCETLASAATA

SEQ ID NO: 6211 - protein, 877 aa, Chromobacterium substugae
MKTSEIRKKFLDFFAAKGHQVVPSSSLIPGNDPTLMFTVAGMVQFKDTFLGFEKRDYTRATTSQKCLRAGGKHNDLENVGYTARHHTFFEMLGNFSFGDYFKRDAITFAWEFLTGEQWLNLPKDKLMVTVYASDDEAYDIWHKTVGVPADKIVRIGDNKGAPYASDNFWTMGDTGPCGPCTEIFYDHGPSVAGGPPGSPDEDGDRFMEIWNNVFMQFNRDEAGTLHPLPKPSVDTGMGLERLSTVLQHVKSNYETDALACLVRAAARETGVAYSQDVPSLKVIADHIRACSFMIADGILPSNEGRGYVLRRIARRAIRHGYKLGQKGLFFHKIVADLVAEMGEAYPELREKQAHIEDALRAEEIKFAETLEIGMGLVDSALEGGKKALDGDTIFKLYDTFGFPVDLTADICRERGIHADLEGFERAMEAQRERGRAGSNFKMTGKIAYSGAGTAFHGYDKSSVEAKILALYKGTEAVDSLSAGDEGIVVLDGTAFYAEGGGQVGDVGKISATAGLDALFDVADTQKIQSAAFGHKGRLLSGALKVGDAVTATIDLHARLASARNHSATHLLHAALRHVLGSHVAQKGSLVNPERTRFDFAHGEAVTAEQIAELERVVNRVICHNVEVKAELMSMEDAQKSGAMMLFGEKYGDEVRVLTMGDFSAELCGGTHVKRTGDIGLFKIVAESGVAAGVRRIEAVTGEGAVAHVQAQDALLKDAAGALKAQTSDEVVAKIAALQDGAKALEKELAKLKGQLAASAGDSLADSAAVVSGVKVLAAELEGADNTALRETLDKLKDKLGSAAIVLAAKGDGKVALVAGVTADLTGKLKAGELVNFVAQQVGGKGGGRPDMAQAGGTQPENLAAALKGVEAWVAGKL

SEQ ID NO: 6212 - protein, 163 aa, Chromobacterium substugae
MSAIELRQASWDDLPAVCQLIQQAFAPLLTQLPSPPTALDETVASLTGHLSSGSQIFVAVRQSRIVACLLVLPPENGCAEIKRVCTHPDLQGQGLGAALLDYAEQELQRQGVQQLKLSTRRRLPSNLQFYQRLGYEVSAQQPYPQGIDDERVTLSKPLAELVC

SEQ ID NO: 6213 - protein, 101 aa, Chromobacterium substugae
MRLLRAAFLACCLQALPACADLPQPDIYALTEILPPLSYGEGGEHKGFSNELLAMMLRDSGLRAVIQVKPWSRALREAQQAPNTMLYLAVRTPEREEMLNG

SEQ ID NO: 6214 - protein, 118 aa, Chromobacterium substugae
MVAVARDTPGQKMMEKLGFVDNVNLVLTNDEAQSARLLYARRVQYSVGVGLFQRYAAKQQNQQPDRLDSVQVLDDSTQFYFAMQRDSNPDYIARLQAALDRIKQDGRYAALLRRYTHP

SEQ ID NO: 6215 - protein, 255 aa, Chromobacterium substugae
MDLGYTVAGLAVGFIVGLTGVGGGSLMTPILLWFGISPATAVGTDLLYAALTKAGGVAAHHRQRHIDWRITLHLALGSVPAAMLTLGLLSWLHVPSQVMDALFRFVLGIALLLTAAAILCKPWLVRLGQRHFGSLGVGERLWPTALVGAVLGVLVTLSSIGAGALGTLALFLLYPALPTSRLIGTEIAHAVPLTLVAGLGHAGMGHLDWVLLLKLLSGSLPGIWLGSRLTGRLADHWLRPTLAVMLALAGGKLVL

SEQ ID NO: 6216 - protein, 38 aa, Chromobacterium substugae
MAKPQLSDEERSRQQKVRQRAHDRDDARFLADRCDDLF

SEQ ID NO: 6217 - protein, 602 aa, Chromobacterium substugae
MTTPAMLQLGLFLAVLLALAWPLGAYMTRIMQGENVGPVLWFAPLERGFYRLAGIQKDEEMGWRGYTVALILFNVLGALAVYALQRLQGSLPFNPQAMAAVSPDSSFNTAVSFVTNTNWQGYGGETTMSYLTQMLGLTVQNFLSAATGAAVVIALIRGFVRHSSAKIGNFWVDITRLTLYILLPLSLVFALVFTQQGAIQNLAAYKDVHTLEVTKYQQPKVDAKGNPVTGKDGKPVMEDKTAQTQTLPMGPVASQEAIKMLGTNGGGFFNANSAHPFENPTPLANFLQDIAIFLIPAALCFLFGRMVGDRRQGWAIIAAMTILFATAVVVETSAEQAGVPQYKALHIDQQASHLQSGGNMEGKEARFGIIDTSLFIAVTTSASCGAVNSMHDSLTPIGGLVPMFLMQLGEVVFGGVGSGLYGMLIFAILAVFIAGLMVGRTPEYLGKKIETYEMKMTAITILVTPTLVLALTAIAVSVAAGKAGIANPGAHGFSEILYAFTSAANNNGSAFAGLSANTPFYNIATGVAMFFGRFFMIVPILAIAGSLAAKKRLAVTAGTLPTHGPLFVVLLIGTVLLVGALNYVPALALGPVVEQLQMLAVH

SEQ ID NO: 6218 - protein, 706 aa, Chromobacterium substugae
MNDKNHLKSVVAEPIATGNKNAGKSMFDPALVKPAIVDSFKKLSPRTQWRNPVMFVVYVGSILTTALWIQSLGGHGEASSGFILGVALWLWFTVLFANFAEALAEGRSKAQAASLRSAKKNVVAKKLAGGNHGAAKTIVDGTSLRKGDFVLVEAGDVIPVDGEVIEGVASVDESAITGESAPVIRESGGDFSSVTGGTRVLSDWIVVKITVNPGETFLDRMIAMVEGAKRQKTPNEIALTILLVALTIVFLIVTVTLLPFSLFSVDAVKAGTPISITTLVALLVCLIPTTIGGLLSAIGVAGMSRMMGANVIATSGRAVEAAGDVDVLLLDKTGTITLGNRQASAFIPAPGVSEKDLADAAQLASLADETPEGRSIVVLAKQKFNLRERQLASHEASFIAFSAQTRMSGIDYDGRQIRKGAIDAIRRHIAELGGQFPDALAKSADEVARRGSTPLLVAEGNRALGVIELKDIVKGGIKERFAELRQMGIKTVMITGDNPLTAAAIAAEAGVDDFLAEATPEAKLKLIRSHQAEGKLVAMTGDGTNDAPALAQADVAVAMNTGTQAAKEAGNMVDLDSNPTKLIEIVEIGKQMLMTRGSLTTFSIANDVAKYFAIIPAAFASTYPQLNALNVMGLNSPASAIMSAVIFNAVIIVFLIPLALKGVKYHAKSAAELLRGNLLVYGLGGLLVPFAGIKLIDMALGALGLV

SEQ ID NO: 6219 - protein, 192 aa, Chromobacterium substugae
MKVIRPLLVIFGGLSLLTGLAYPLATTGIAQALFPAQANGSLIEKDGKVVGSRLIGQNFTGDKYFWGRPSATSPMPYNAGNSGGSNLGPTNKAQLDAVKGNVDAIRKAHPTQTGPVPVDLVTASASGLDPEISVASAYYQVDRVAAARKLPATEVRKLVEGRIIGETFGLLGEPRINVLELNLALDELSKKA

SEQ ID NO: 6220 - protein, 895 aa, Chromobacterium substugae
MTDLRPDPDALLDELKREELDAQRGRLKIFFGACAGVGKTYAMLAAAKTKQQEGVGVLVGVVETHGRKETEAQLAGLEVLPPSQIEYKGRALSEFDIDTALSRRPQLILIDEFAHSNVPGSRHPKRWQDVEELLAAGIDVYTTLNVQHLESLNDVVGQITGIIVRETLPDHVFDRADEVSLVDLPPDELLSRLAAGKVYLPHQAERAVKNFFRKGNLLALRELALRRTADRVDAQMRAYRADQSINPVWHARERLLVCVGPGPGTDKLIRSTKRLAANLDADWIAVYVETPSLQRLPEEKRARILKGLKLAQELGAETTVLGGSSLAATLLAYARTRNVSKLVVGKSASSPLARLWRGSLVEELTRQSGDVDVYVVAHDLDPSDEKSGKRVPSLLFSDGESGKPQRGYLAAAAVCAATTALNHLLVPYFALSNVIMVHLLAVVLIATRYGRGPGVLASFLSVAAFDFFFVPPQLSFAVSDTQYLLTFIVMLVVALVISQLTARFRFEATIATYRERRTRALYDLGRELAGALTASQIIDTAVGRLEPLFRAKVMLFIPNSEDQLRAATEAGNGADTGVAQWVFDNLQPAGLGTNTLPSNAALYVPLKAPMRTRGVIALLPEETIPAFLPEQQRLLETCAAQIALALERVHYVEVAQDAIVAMESERLRNSVLSVVSHDLRTPLTTMLGLANMLNSPSLPPEQQADISQSIQDEAMRMNKLVTNLLDMARLQSGVKLNKEWQLLDEVVGSAVRACEHSLRRHHLALKLNRDLPVLEYDAVLIERVLVNLLENAAKYTPAGSRIELAAQHDGARVRISVSDDGPGLPANMEQKAFEKFSRGAPESTTPGVGLGLAICRAIIENHGGSIEAGNLSPHGARFSFTLPAGAPPELPPEDA

SEQ ID NO: 6221 - protein, 239 aa, Chromobacterium substugae
MNDAPISVVIIEDEKPIRRFLSSALDEERLTVYEAETGKQGQIEVATRKPDMVILDLGLPDMNGIDVIKSLREWTDIPILVLSARTQETEKVAALDAGADDYLTKPFGVAECLARIRVLLRRRIQGSAAPQQNFHFGDIKIDLVNRLVHKGDAPVHLTPIEYRLLSTLIRNAGKVITHRELLLAVWGPSFSEHNQYLRVYMGHLRQKLEDNPAMPRHIVTETGVGYRLVESDPSRNQTA

SEQ ID NO: 6222 - protein, 99 aa, Chromobacterium substugae
MYDCQQDSYADFSFAIYDAVGRPRPLCGSLSATPLPSSDDSALYDLAAFAREQGYSLDHHEQHLTVHDISLADALAINTRFGETLIISCDLRRDPPVRF

SEQ ID NO: 6223 - protein, 465 aa, Chromobacterium substugae
MLFELNHASRSEILREGRQIARLALPMMVAQIAQVATGFVDTVMAGRVGTDDLAAVSLGASVFITVYVTLMGVVAALNPILSHHLGSGDARGFGRDAGQGLWFGLLLGTLGGALMIALEPALRQWLHLPQEVIAKVMLFITGAAVGMPAAMAHRALHAYASSLGHPKAIMVVSLIALALNIPLNYILIHGLFGFPRMGGAGCGWATGAVFWFNCLALLGYVSWHKKFAGNRILAGIARPDWRRFAAFLKLGLPIGLSFFVEVSLFSFIALLIAELGTVVVATHQSVLNFSSLIYMLPQSVATALSVRVGHHAGAGDYQAARFISGVGLLMGLAMAGMAMVLVLLLRAPIMWMYSADPRVISMGTTLLLFAAVYQLTDAAQTIASGALRGYKVTAVPMLIHITSFWVVGLGLGILLGLTDHIVPRMGIYGFWTALVISLTVAGLLLTYYLARASRRRLRRDQGILL

SEQ ID NO: 6224 - protein, 341 aa, Chromobacterium substugae
MSLQFSADYDLRPHNTFGLAARAAHFCRLDDLADLSALLAHPLYRQGPVLWLGGGSNLLLTRDYPGLVVKVALTGIRLLEQNGDDVLVEAAAGENWHDFVLHTLAQGWYGLENLSLIPGTVGACPVQNIGAYGVEVKDHLQEVACAQLERGGEALTLSNADCRFGYRDSVFKHEAAGKLLVTAARFRLSRAARPRTGYGDILQQLERQGISAPTPLDVSRAVIAIRQSKLPDPAALGNAGSFFKNPVVSLTRAEALLAEHPQLPHYPAPDGQVKLAAGWLIDQCGLKGYRDGDAGVHEKQALVLVNYGQARGSEIEALARKVQDTVAQRFGVRLEPEPLIL

SEQ ID NO: 6225 - protein, 202 aa, Chromobacterium substugae
MSKKPTVLVFDLGGVLVDWNGIDPLIRLSGGRLSREEARLFWMHFHWTEKLDLGACTPLEFSAAMADELRLDLSAEAMQAQLRSWNRGAFPGARALLEKLSADWQLAALSNINSLHWQQVSEEFQLLDLFGHTFASFQLRLRKPQPEIYRHVQQTLGLAPADIAFFDDNIECVAAARAEGWQAFHTIGFDSLQRTLREQGWL

SEQ ID NO: 6226 - protein, 127 aa, Chromobacterium substugae
MPFVLWSLLLAALLPLIWAGVAKAGVKYDNHRPREEAARASGYRQRAGWAQQNAWEALPTWTAAVVAAWLMKVPEAAMNAAAAVFILARATHGLLYLADKASLRSLSWLIGLLAALYLFLRASGVLG

SEQ ID NO: 6227 - protein, 224 aa, Chromobacterium substugae
MDLSALQFGAWPLGLANALALAALAWAGAGVRWRELEHGALNAWMGACVLDLALWLLRAGLLPGLSFHLLGGALFALLMGPRLALLALAAVQAALAAGGHADWRALGLNWLLTALPAVGVAASALALARRFLPPHFFVYVFVNGFLAAGASLFAAALCGMAALAAAGAYPWETLLDDAVPYYFLLSWSEAFTTGLLLAVLIVYKPQWVATFDDGRYLGDKPGNR

SEQ ID NO: 6228 - protein, 280 aa, Chromobacterium substugae
MPALPAQHLIAQQVGQALAEDIGQCDWTARLIDADKTGAARVIAREDAVICGQAWFDECFRQVDSRCAVQWRVAEGESVAAGSELCRISGPARALLTAERSALNFLQLLSAVATETRRYVEAAAGHRARILDTRKTVPGLRLAQKYAVTAGGGHNQRVGLFDGILIKENHIMAAGGVAEAMRQALQDLPPGVTLQIEVETLAQLEDALENGAKLVLLDNMSLEQMRAAVALSAGRAQLEASGGIDLDSVRAIAATGVDRISVGKLTKDIRAVDLSMRFTL

SEQ ID NO: 6229 - protein, 625 aa, Chromobacterium substugae
MDLTPRKHGSRSARHAKWGAALFLLVTLGLVLLDLAVSYRQVENEAGHQASGLSQLLAERLSSGIHEAGLILQSSNQIPEVQHLLRSGGQSPEAQQKLQQKLQQQLQLAPYLSQIEIVDTACQTIFSSSRSSLPRSRHNEFCRWLHRIDPQESNYTAVTHSPTEGGIVLANKLHDGDGNLIGMATGLINHNFFQDEVSRLTVGEHGEILVLDQRQLTVARWPQVAGHDPQSYRPLQAHMILSHDANQTLFSAPSSFDGSMRLYSMRQTGNYPFQVAVGISRQDFTRYVWDKAWLALPGWLFVAALTLLALRKHLSNLRQHQQLLRGSERIRDSEEQARLVLDTAPLALLLVNPRTCRIQHANAPARELLRLPPRAPDESASHELNLPLKLQPVEQWLAENEDVMQREVELELEDQSRLWAIVSLQKLGRGNHPSSLIALYDISGRKLLEQQLHESNLQLAEMAVTDPLTRLYNRRHADTVLRDEISRCERYGQTMAIAVFDIDHFKKFNDQHGHQAGDNVLVAVANALRDTTRNTDINARIGGEEFMVIFPYTRLRDAQKVMSRMQMALTRSTVSVVEQPITFSGGITDWRPGDTPSQMASRADKLLYEAKLAGRNIILCDQETP

SEQ ID NO: 6230 - protein, 203 aa, Chromobacterium substugae
MWSMEADAAAALIARRLESYDFTGKVADLPCRPAGPELRPAAVLLPLVWHDDGATVLFTRRTEHLSSHPGQVSFPGGKVESGDRSTLDAALREASEETGLDPAGVRVLGRLPDYVTITGYVVTPVVGMLTPPLALAPAPDEVAEVFEVPLRLLLDRAAYSRHDYVRDGIAGRYLSFEWQRYTIWGATAAMMWMLADALAAGGA

SEQ ID NO: 6231 - protein, 212 aa, Chromobacterium substugae
MEWSGRFFQMEWFSAIGTAAFAFSGYLVGIRKRLDLLGVSIVALVTAIGGGVIRDLLVGRVPLVFYDYTNLFIIAGAVWIAWLAGLHRRKSRTLERLFIVADSLGLVAFSLAGAQVGLLFGLNAFGVVSLGFVTAVGGGVVRDMMVNEVPFILHRDFYGTVSILAAAGLFLADRLGWVSVASLQALFWSGLALRLLAHRNEMTLPTLGGRGR

SEQ ID NO: 6232 - protein, 402 aa, Chromobacterium substugae
MAISNEIDGASRLRKQDLIFALLKNQAKKGESIFGEGTLEVLPDGFGFLRSPDTSYLAGPDDIYVSPSQIRRFNLHTGDSIEGEIRTPKDGERYFALVKVDKVNGEAPENSKHKILFENLTPLFPTEQFKLERDIRAEENITGRIIDLIAPIGRGQRALLVAPPKSGKTVMLQHIAHAITANHPDAVLIVLLIDERPEEVTEMQRSVRGEVVSSTFDEPATRHVQVAEMVIEKAKRLVEHKKDVVILLDSVTRLARAYNTVVPASGKVLTGGVDANALQRPKRFFGAARNVEEGGSLTIIATALIDTGSRMDDVIYEEFKGTGNCEIHLDRKMAEKRIFPAMNINRSGTRREELLIPQDQLQRIWVLRKLLYPMDDLEAMEFLQDKIKATKSNQAFFDSMRR

SEQ ID NO: 6233 - protein, 108 aa, Chromobacterium substugae
MSDLIHHVSDNSFEQEVLQSDLPVLVDYWAEWCGPCKMIAPILDEVSKEYEGRLKVAKLDIDQNQATPPKFGIRGIPTLMIFKGGQVVSTKVGALTKSQLTAFVDSNI

SEQ ID NO: 6234 - protein, 261 aa, Chromobacterium substugae
MGFLQGKKILITGMISNRSIAYGIAQACHRQGAELAFTYVVDKLEDRVREMAADFGSKLVFRCDVQNDDEINQLFVELAKEWDGLDGLVHSIGFAPREALEGDFLDSLSREAFQIAHDVSSYSFPALAKAARPMMQGRKASLLTLSYLGAVRAIPNYNVMGLAKASLEASVRFMAASLGKEGIRVNGISAGPIKTLAASGISGFSKLLNMASSQACLRRNVTTEEVGNAAAFMLSDLSSGITGEITYVDAGYSINALNVPE

SEQ ID NO: 6235 - protein, 282 aa, Chromobacterium substugae
MNVADACTDRLEALLNHFPVRARMFHSGALCGVTDFAAPGEGGQLHLIRSGALEIMRAGQPALRVDVPSLLLYPRPVARRFVADAGRGADLACAELSFDGGADNPILGALPEMVCLPLAAIAGADSVLALLFEEAFGANCGRHALVDRLFEAVLILVLRQLMESRQVQGGMLAGLSHPRLRKALAAMHAQPGRAWPLEALAELAGMSRSVFAGAFRDVVGSTPGAYLQAWRVRLAQQALLRGRQLKMIASEVGYGSEAALSRAFKAQCGLTPREWRQGRLAD

SEQ ID NO: 6236 - protein, 141 aa, Chromobacterium substugae
MSIDTILYRAHATVAGGREGHAASSDGALDVQLSMPRELGGAGGPGTNPEQLFAAGYAACFLGSLKFVATREKVALPAAASIAASVGIGTVPTGFAIEAELLISLPGLPPETAQALVEKAHVVCPYSHATRNNLDVRLRLA

SEQ ID NO: 6237 - protein, 337 aa, Chromobacterium substugae
MKTKLHIVAASLAALCAGSALAAGSPGVERHTQAFLETLAQGGGQPLETLSPAEARDALARAQKGAKLAPADVSEKIISVDGQPLKLTVVRPAGVRGALPAFMFFHGGGWILGDYPTHERFVRDLVADSGAAAVFVNYTPSPEARYPVAIRQAYAATRWVAEHGAAIQVDGKRLALAGNSVGGNMAAAVALMAKAGGGPALRAQVLFWPVADADFEDASYREFADGHFLTRNMMKWFWDAYTPDPRQRSDIYASPLRAAPAQLRGLPPALIQTAEKDVLRDEGEAYARQLDAAGVDVVATRYNGMIHDFGLLNALSGLPATRAALHQASEELKMRLR

SEQ ID NO: 6238 - protein, 252 aa, Chromobacterium substugae
MPDNDHQLAADIAAQAAELLNQLRQGNTAGDKALGALGDAKSDALIAHLLRQARPDDGLLSEESAPDDARLRLRRVWVIDPLDGTREYSERERDRSDWAVHVALTEDGLPTACAVALPALGQLFSTAAPALAGAPPGPIRILVSRSRPPAIAERVAGMLGAELAPMGSAGAKAMAVLRGEAHAYLHSGGQYEWDSCAPVGVALAAGLHASRLDGSPCRYNQPDPFMPDLLICRRELAPALLDAIARAQAESA

SEQ ID NO: 6239 - protein, 822 aa, Chromobacterium substugae
MSKRFAILVVDDNESNRVTLRALLSRLSGCEVLEAGSGEDALLRTLERDVDLILLDVQMPGMDGFETASHLQMTERTRGIPIVFVTAIFKAEEFIGRGYGLGAVDYLMKPLDDNLLLNRVRMYQTLHDREAALEKRRLALEEANGQLQQALGELQRQSVALSEARDASEAANRAKSEFLAVMSHEIRTPLNGVIGMADLLLKTRLDERQRHYVNVVHRSGENLLSIISDILDFSKIEAGKFELDRQPFCLSLLVEEIVERLAPVAYGKGLELLCAQPASAVEVIGDSKRLGQVLTNLIGNAIKFTQAGQVVVRVALEGRGERETSCQVSVEDTGIGITPEQQSRLFQPFAQADSSTTRRFGGTGLGLVISQRLMAMMGSRIELASQPGVGTRFHFRLTLPNGPQTQPPPPVERLSRLRVLVVDDNATNLEILEQQLTAWHCRVCALQSPLAALDRLAEAKGEQQFDLVLSDMMMPELDGLMFLSQARQRLGEAMPPAIILSSAADDFQQLKDAASLARQVLTKPLRRSELYNALIQAREPDAQPAGRGPARQERQERAFGKLSGHVLLVEDNLVNQEMAQAMLQNMGCSVRVASNGQEALALLGEEKFDLALMDCEMPVMDGWQTTRAIRDKERGADARLAIVALTANAGLGDKERCLQAGMDDYLAKPFTQRELAATLARWLRAAGKEAAPESEAPAEASVAGGEWIEPQVLQAIRDIRAGLLPRMLEAWMQECPGIHMAVHEAVKKADGGELFRTAHSLKNSASSVGALQLAALCATLEQLGRAGDLPAAACLIDQLDQAFYYSMEALKKLLAADPPPPA

SEQ ID NO: 6240 - protein, 566 aa, Chromobacterium substugae
MSVNLQHQGELCRAAILGRLDAADERAALQELLRGPADDMLELCFYDADLLPAELIAALAARLDSGGKLKIVAYHALLAHSLMRLGLPVRQVSAQPPAAGERPPLRALALAGSALSLERILHIVEHLPLSDMVVFVAQHVQENQINLLDQLLKSRTEYRVLMPQHLTPAQAGTLYVAPPGHHMRVAHGLVYLTRDRQIQFARPSIDALFESLAGEYGDGVLAVLLCGYGSDGVDGCAALRAAGSCVIVEDGDECAPARVMPDNARNAGHYDFLMKLPAIASVAAAAAMGDAARPDGALLELFLQALVSHYGYDFRHYQRESLKRRIVNLMGQFNLRGFAEFQRAVLCDAALFERLCAELPVGVTSFFRHPAQLKQLREEILPYLASFPMIKLWSAGCSTGEEAYSLAIVLDELGLLDRSHLFATDLNPYLLELGASGLFPSAPLALNRQHYLASGGPRLFDAYLAGNGRYLAMDDRLRQRILFHRHSLTDEGIFNEFQLILCRNVLIYFDAELQRQVLRRFARSLHAEGFLALGPQDGLHRLALEEGFEPCRGGSHIYRIGRSAEA

SEQ ID NO: 6241 - protein, 1233 aa, Chromobacterium substugae
MKLTVGKNMALLVATALLGLAMLTALEQYLLEKVYDGANFGNINAVPSLKVLGELRRAFLEVNIQVGRLDYDEDRALRLKIEQRLQTAREQVSDAIRSYETNGCDGGSCFADATDKDWLEREKPVWQKFQSVLEPILAIRGNDAQSVANVHQMLLALDPLSIQLQKMIDGHIDYNMVIARKFSDEAAQTKRGAIQLTLVISAAMLLAIGLLGWLTSRSILSRLGGEPTEAADIASRLAEGDLSMDIRLREGDGNSLMARLQELVDALDRLASRAYAIGQGDLSQEVQLASNQDKLGIAINEMIRMLRGARSEDERRNWLKDGYGQISAALTGDLTTEQLADSAIGMIGRYLDAGRGVFYLYQESEQVLLLIGSYMYTERNHIGASFQLGEGAVGQVARERKPIILEVSNEDVAPIVTGTLLETPRFTYTYPLLHEKELVGVIELSSFERFDDKKQEFLANVGGMLASFLFVAEQRAHIRKLLAASEASEKEMRQQSEQLRESNARMEEQQQLLQQQAEEMQQTNAQMEEAQQLLRQQTEELQQTNAQMEESQQQLEQQNLELDEARRQQEAKARQLDQASQYKSEFLANMSHELRTPLNSIILLSKMMVSDEDGKVEGEALKWAQVIHRSGEDLLRLINDVLDLSKVEAGRMDVHLSPVSSRDLCSELQGMFEHVARDKGLSFTVEDELRRHFVSDPDKLSQILRNLLTNAIKFTRQGGVTFRLSHHPDQPLPIRLSVRDTGIGIPEEKRNVIFEAFQQADGSTSREFGGTGLGLTISLRFAQMLGGTIELLSAPGEGSEFIVLLPEAGAAAEPQPGHAASHPAAAPRPRLDAPGDDRGAVSPGDRIILLIDDDPVFGQMLVGMNRRLGYKTLLAQNGADGLALAGQYRPHGILLDLGLPDMDGAQVLHEIKTRPALSSLPVYIVSARDRDEALLQQGAIGFLSKPAADHLLAAAEATLISAVGSKGGERILVVENGGIRGDEVQSLLGRDGGAIVAAAPDADWPALLRQKPCQLAIIDLGAGPAADALVTAAALREADAAISLVFYADSHPGDEEEAALRAYSDCVIVKAPQAGQRLMENVERFLQDVPRQHAARKTPAAGGDSKLLSGRQILVVDDDPRNLFVITAALERHGAKLFSAVNGRRALEFLPQQPVDLVLMDIMMPEMDGYQAIAAIRADPALAAIPVVAITAKALPAEREKILATGADDYLSKPVDYDVLVAKAAQWCAGRKT

SEQ ID NO: 6242 - protein, 714 aa, Chromobacterium substugae
MPAPGDILVVDDTMTTLMMLLALLSTEGYQASSAQSGAEALELVRKHPPDLILLDFSMPDMDGLQVCRQLKASSRTRDIPILFLSSIADTQAKVDGFAAGAVDFIGKPFERSELLARVNTHLDLARLKKRLSKLVDEKTESLRLSEQRFRAMIEQAPEAIMVYDLDSSRYVDANQQAEALTGRQQKDLIGMTPVQLYSPEQPDGLPTAESVRLHAARAMKGEVQVFERVIARPDGSNMPCEVRLSKLPSETGRLLRVSYIDISPRVAAQEKINRLAYFDALTGLLSQSGLLEKLDNLFNIRQEANLQGFAMLLIDLGDFKSINDVYGNSVGDLLLCEVAERLRRLAGAGNLISRLAGIEFVAVLSGIHSREKAEQAADEALEALSRPFIIDEMTLNITVSIGVSLGPEHGASGQELLRNADMALYKAKQQSKRRVQVFEAALSQQMRERVELEKELRHAIEENQLVLHYQPQIELASGRVVGVEALVRWQHPRKGMIPPAQFIPIAEQSGLILPLGRWVLQEACRQLSRWQAKEPTRIRMAVNLSVAQFTDHELPEFVAGILKQTGIPPSSLELEITESCAMLSPQQSIDMMRQFHQMGVLSSIDDFGTGHSSLAYLTRFPLDTLKIDQSFIRNISSDERDTALCDTIAYLAHRMGLQVVAEGVETDEQLTFLTSIHVDVVQGYLLCKPLPAAQVEAFILQRPDQSPRPGVEYF

SEQ ID NO: 6243 - protein, 488 aa, Chromobacterium substugae
MTAKTIMIQGATSDAGKSALATGLCRLLARRGVRVAPFKPQNMALNSAVTADGGEIGRSQAVQALACRVEPHTDMNPVLLKPNSHTGSQVIIQGRAIGNMEARGYHGYKPIAMQAVLESHARLAEQYQCIVAEGAGSPAEINLRDGDIANMGFAEAVDCPVILVADIERGGVFAHLAGTLALLSESERARVVGLVINRFRGDPSLLKTGVDWLEQHTGKPVLGVLPYLYDLHLEAEDSMGLDKLGGASGGGDKLRVAAPAAPRVSNHTDFDPLRLHPQVEFTLVRAGETIPPADLIVLPGSKSVLADLAWLRAQGWEEAIRRHLRYGGKVLGICGGLQMLGKKLHDPDGLEGEPGSGDGLGWLDMETTLAPEKRLTRMRGRLTLGDAEAAGYEIHMGVSQGPALAHPAVRFDDGSVDGARSEDGQIFATYLHGVLDEPAACQAILRWAGLKEPEALDYPALREANIDKLADMLEKHLDLALIRDCLPR

SEQ ID NO: 6244 - protein, 312 aa, Chromobacterium substugae
MNSALFLPIALLLDRLLGEPPRWHPLVGFGRLVKAMERLAYPAAPQAEPVWRMRLRGAAAIALLLTPPTLIAWGLARLPWLGAIVPIALLYLAVGARSLAQHAEVVRKALADGDLALARERVGWIVSRDTSELDEAGVARATIESVLENGSDAVFAALFWFLVLGAPGAVLYRLSNTLDAMWGYKNDRYLHFGWAAARFDDALNYLPARLAALTYLLLGHAADGWRCWRAQAPTWYSPNAGPVMAAGAGALGVSLGGGARYHGQWKERPPLGCGPTPTHEDIGRAVRLVNRGMWLWAGLSLAAAILIGAIHA

SEQ ID NO: 6245 - protein, 328 aa, Chromobacterium substugae
MLEHGGGLLRAAAEYGIPAGDWLDLSTGVNPNGWPVPPLSADSWLRLPQNGDGLEAAAADYYGSDKLLAVAGSQPAIQLLPRLRAPCRVGMLALCYAEHPHHWQKRGHQLFRLSPDELAAGIDQLDVVLLCNPNNPTGDRFDAALLESWRQRLAARGGWLVVDEAFLDAAPEDSMLPHIGKPGLIVLRSIGKFFGLAGARAGFVFGWPELLQALAEELGPWTVAGPAREAVKLALRDVEWQRDMASKLQRDSSRLQRCLERHGLPPAGGSELFQWVPDAHSLATHRYLAGRGILTRYFESIPSLRFGLPKTDQDWVRLEQALADWNRF

SEQ ID NO: 6246 - protein, 63 aa, Chromobacterium substugae
MHGALVDDTRRASEGTSFRLLIHERSLCVSPGTPRPVSACVDTYDGRSPGSRVAVRAPPSRPC

SEQ ID NO: 6247 - protein, 348 aa, Chromobacterium substugae
MHPSTTLSTGRRLARHAPILAGLILANLLAWAWAFAAFADHPAQLATALLAYLFGLRHAVDADHIAAIDNTVRKLMQEGRHPSAVGLFFSVGHSAVVVIAVALIVFAASALQSRVTGFKEIGGVIGTSVSAFFLLALALINLSSLRAVWAAFRRARAGEPICDEQLNLLLNNRGLIARMLRPLFKMVTKSWHMLPIGFLFGLGFDTATEIGLFAIATSQSANGVALWHIMVFPVLFAAGMALVDTLDSMMMVEVYGWAFINPVRKLWYNLTITFVSVVVAVGIGGLEGLGLLVDKLQLSGGLWDVIAALNDDLAHFGYFVVGVFLFTWLASAAIYKWKRFDQMAPEAQ

SEQ ID NO: 6248 - protein, 109 aa, Chromobacterium substugae
MRTHDKHVLMCTGPRCTPDGEGSEAMFLHLGRTIDACDGLRAKRTRSHCFAVCKEGPVMVVYPDGVWYRKVSEADVERIVCQHLKGGVPVEELVFHKTGSGDIETEPQA

SEQ ID NO: 6249 - protein, 1374 aa, Chromobacterium substugae
MSAEIALLSHAGTDLAALSRARWPEDFPAVTGIALQGITDEAAMRALLDGQLASARAIVLRVLGRADAIPGLERLLAHARRLQAAVIVVSGTGEPDPELQALCSAPVSLQQDVHAYLQAGGSVNLGEMMRCLADRLLLTGFGYQSPQPLPEHGVYHPELAAPCSLEDWLEIRHPDWPTVGLCFYRAHWLSGNTRFIDLLVDCLAERGVNALPVFTSSLRTIDQGGLPAALTLLADPRANVSLLINTTSFAMGDINNDGPTQPGWAVEASDQLDLPVLQAITSSMTREQWEASDRGFNPLDTAMNVALPEFDGRIIGVPLSFKQPAEAGQAEQYAPLPDRARRLAGIAARLARLRHLENAGKRIAFIFTNSNSKASQIGNAVGLDSPASLYAMLRGMQGRGYRMDPLPPDSDALMHELIDRGAYDQDYLSAEQMKNAAARVPAQRYQAWFDELPEALRDKMLQRWGQPPGGAYVDGDELVFSGLDYGNVFVALQPPRGYGMDPDAIYHTPDLPPTHHYYALYRWLRDDWRADAIVHVGKHGTLEWLPGKGVGLSQNCFPDALLGDMPLFYPFIVNDPGEGSQAKRRGHAVIIDHLTPTMTTADSYGPLAQLTQLVDEYYQVELLDPNKLPLLQQQIWDLIKEAKLDTDLAAMLKHDHDHDHDHEHHHDHDHSHDHPHGGHQHAPAAVHGKYRAQAAKPAAAMKPAAAAAAKYRPAKAAHSHDHGHHHHHHGDHDHHHGHHDHHHHDHHSHDHHDHDHDWDDTLNEDGVPLSLAKMDGVDVAHLIEDIDGYLCELGAAQIRDGLHVLGNAPQGEALVDMLLALTRLPNLGIPGLPASVAAACGGDWPLWQQDQGKRLAEAPASLQALAGQALVTRADAHDAVMKLARALIADLAARGYHAAAIPAAVENILPGIEPHADLERVLNFVCAELCLKLARTAEEIDNLLRGLEGGYVPAGPSGAPTRGMAHILPTGRNFYSVDPRSLPSQAAWRIGDGLAREMLARHLKETGQYPESVAISVWGTSAMRTHGDDIAEILSLLGVKPRWQQESRRVQGLEVIPLAELGRPRIDVTVRISGFFRDAFPHLIALVDEAVHTVARLDEPAEQNFLRKHYLADLKNELLGKLPDSDAQSLYRVFGAKPGSYGAGILPLINEQNWQNDADFATAYVNWGGYAYGRAANGADARDALRHRLAGVEVALHNQDNREHDIFDSDDYLQYHGGMIATIRSLSGRQPRAFFGDSHNPEAPAVRGLKEEVLRVFRSRVANPKWIAGIQKHGYKGALELTATVDYLFGYDATAQVVDDWVYEQLAQSYALDPAMQQFFADSNPWALNAITDRLLEAAQRQLWAEPDPDTLAALRQLHLDSEALLEARGENKA

SEQ ID NO: 6250 - protein, 638 aa, Chromobacterium substugae
MSPIYPFAAIVGQEQLKQALLICAVDPTVGGVLVRGDKGSAKSTAARGLAAVLPAIRRATGCGYNCEPDHPLPLCPVCSGDARALHDGPVPFINLPLGATEDRVLGSLDFEKALQGGKQAFKPGLLAAAHRGMLYIDEVNLLADHLVDVLLDAAAMGVNTVEREGLAVSHPARVTLLGTMNQEEGDLRPQLLDRFGLMVDVAAPREPALRAEVVRRRLAFEADPAGFAAQWQTDSEALRANIAAARALLPQTRLSDSLFHFVSELCCEFDVSSLRADIVLNKAARALAALDGRADASAEDIRDAARLVLPHRRRRKPFEQSGLDQDKLEQMTRQASNPPPPPPPSPQEQNHTQPPPDADGEQEPNPASHGSEQIFAAAPAGDIARIRVQAPSSGDAAGRRSDGASRQRGHYVRAEANPQPAQLALDATLRHALLRDPDNFAVTRADLHDKVRVAKQGNLILLVVDASGSMAARQRMEQVKGTVLSLLEDAYRRRDQVALIAFRGQQAELLLPPCNRVEQAELALRELPTGGRTPLAHALALAADTLSRQLGGPAPLLVILSDGRANVALDGDGDPWRQALDLAGQLAGAPALVLDTEQDFVRLGRARELAEALGAEYLACDALTGEQLTLTIQQRLGR

SEQ ID NO: 6251 - protein, 253 aa, Chromobacterium substugae
MTGKVYLIGAGPGDLDMLTLKAARCLKLADVALVDDLVHPDIRSMLRPDAEIVPVGKRGGCPSTPQAAIEQRMIDEARAGKTVARLKGGDPFVFGRGGEEMLTLQAAGVEVEIVNGLSAGLAVPATLGIPLTHRHFVHGVTFVSGHPHQDGDEPNWQALAQSGMTLVIYMGVKRLPWIRAELLRHGLKPDTPAAAIENGTLPQQRQVLSTLDALEQDMRAAGIHSPALIVIGPTVALASCSPSAANETTKEYA

SEQ ID NO: 6252 - protein, 233 aa, Chromobacterium substugae
MIICIGAGPGDIGYLPQRSAQLIREADVVAGFNAVVDVVRPLIPDSAEVIQMGYRDQVAQLDIVAERHHAGKKCVVVFMGDIHFSGFQYLERVERACGHPVETIPGISSAQILASRGKVCFDETSFITFHRRGDLTPFKRHLVHVLQDGRNAIVIPCPWDEARSFMPWHIAAYLLENGIPAGQPVEVWENLTRNEAAWRGTLAECAEQRFSDMSIMLIRTLAPMDSQIEPTHK

SEQ ID NO: 6253 - protein, 521 aa, Chromobacterium substugae
MSQSDYAIVLAGHGSRDPDGVNEFMQLVDALKARAGVRPVAHGFLEFARPTIDEAVEQVIAAGAKTVVMVPGVLLAATHAKNDMPSELLALQQTHPGVDFHFGAALDLHPRLLALCRQRIVEAEAASPHTISRNDACLVVVGRGTSDPDANSEISKLARMLEEGLGFAASFVCYSGTAKPLVADGLRAAAMLGYRRIVVLPYFLFDGVLVKRIYGAAADLAARHPEIEVLSAGYLGPDPQVAEVFLERAQEGVEGRAAMNCALCKYRVQIVGFEQQVGEPQRGHHGKVRGLLEREPTANQPPAWKRYTPHPIEAESMRIIDEGRDWSAFPAEQRTALMRLVHTTGDFNSVDDLFFSAGACETGMRALLRCRRVVTDVTMVETGLKREVLRQLEVETWCGVHDEETRLLAEASGLTRSAAGIRRAWQKFGNDCVVAIGDAPTAIREVVRLVRDHGWRPQLVVGLPVGFVGTRECKEELRALLQVPRITNRGTRGGSPWAATVVNALMIDAIEHVHQQQQREE

SEQ ID NO: 6254 - protein, 374 aa, Chromobacterium substugae
MRQPYDLAAPAPNGMRRGRTTGSCATAAVKAALMLLLDGIDADEVFISLPDPDFYLAVPVENVAWLDENTVRAEVLKYAGDDPDNTDGATIFAEVRINGSGALRFLAAPGVGMVTQPGLRIPPGEPAINPVPRQMMRMAVDEALAGRPDPGIDLAIGCVDGDKIAKRTFNPMLGIVGGISILGTSGIVEPMSQAAWIASIEVYVRVALGELPTAIAFTPGKIGRGYAADRLGLAKKQVVQIANFVGDSLDFAESVLIEQGRILDTLWVLGHPGKIAKLLDGVWDTHSGKSGMAMDAVADVAADLGHAPELVAQIKQANTVENVVQIMSSQPDARGYWMEIERRTAARMAAKVPSVRQVAVRLFSMDGTPLGEAA

SEQ ID NO: 6255 - protein, 242 aa, Chromobacterium substugae
MKLGTLIGIGVGPGPAGLIPVAALAALREADIVYLPRATSSDTSVARLCLAGLELDESRFREIEFEMNPDRGALSRHYGALAERLAAELKTGRNVAYLTIGDSMTYSTYGYLLAALREMLPQLETQTFPGVTSFAATASALSWPLGEGKERILILPCPDDMAELQADIDSHDIVVLMKIGKRLPDVLALLNDMGIAQLCAFARRIGLPGEVLCADASQLTADASGYLATMLIRKTARERRHS

SEQ ID NO: 6256 - protein, 267 aa, Chromobacterium substugae
MKVYFIGAGPGAADLITLRGSRLLGAVPMVLYAGSLVPAEMLSHCRPDAEIHDTAELNLDQQEALYRRAQAEDKDVARLHSGDPAIYGATNEQMCRLEALGIKYEVVPGVSSFTAAAAALGSELTRPEVSQSIILTRTSGRASAVPETESIASFAAHRATMCIFLSGQRLKQTVADLSLHYPPSTPVALVRRASWPDQSVHRSTLGKMLSEVKQKDWLLTTLLLVGEALSREGGVESSLYAAGFTHIFRDGDERKTKRASLRKENQA

SEQ ID NO: 6257 - protein, 248 aa, Chromobacterium substugae
MSRAVWLVRAEALPLGQKLASALDAKLYQPWLDADASGREQFRAAFHLHSHWVLVMASGIAVRYLDGLPQSKYSDPAVVVMDEAARFAIPLLSGHEGGANDLAYEAARLTGAIPAVTTATEAIKPLTLGIGCRRGKSAEAIEQAVSQALAGRPLSDVREVATIDLKADEAGLLAFCAHHALPLRVIAREDVAARGWTGAPSDWVRRNVGVDGVCEPCALIASPRGRLIVPKMALDGVTVAVVEDGPIV

SEQ ID NO: 6258 - protein, 60 aa, Chromobacterium substugae
MCGSARWAGKGAARPAPLQPQAAPASREFPANIRLARRCRTRRALASHGSNKRQLKTLPA

SEQ ID NO: 6259 - protein, 514 aa, Chromobacterium substugae
MTGKLYLVSVGPGRAELIPDLARQALAASDVIVSYDLYLTWVQPWIAGKDIRTLPLTQERERAQLALDEARAGKTVALLSSGDIGVYAMATLAYEDMREDDSFDVQLIPGITSANSCASLLGAPLSHDFATLSLSDLLCPWEWIETRARHIAQADLAVVFYNVQSRQRQEGVYRILDIMLEHKKPETLCGIVRNAYREDQAVEIVTLAELRTRRFDMLTSIVIGNRFTRRKRNWMFTPRGYFNWDNTSDTVKADALPAGAAWVFSGTSDGNALSRAIAETGRAVVVSSASDYGNEQAQQAVPGVATVSGRLGVERRRELLSGSRASAIVDATHPYASEMSQQLMALAEELALPYLRYERPASGSAHPVIRCADSDAAARMAMAKGHRIFLATGSKELHRFLSADAEHKHQWFVRLAPDPQHLQRALDLGLPRSRICAMQGPFSQAANEALWRDWGIDCVISKDGGEAGGFDAKAAAAAALGIPFIVIDRPQLDYPQSFDDFESVLAVLPQGGQA

SEQ ID NO: 6260 - protein, 368 aa, Chromobacterium substugae
MSAPRLPVTVLTGFLGAGKTTLLSKLLENNKQRRLAILVNEFGEVSIDGGLLRDADAGGVEIHDLANGLVAYDDDADFLPTMLALWQRRQQIDHVLIETSGLALPSAVMAQLQSEALAPYFVLDATLAVVDTPLLLAGHFSPAGNGGEADAVAELFDQQLGHADIVVLNKIDALSADELLAAEETVRRQAPSIRFIELAYQARLDTRLTLGLHLHEAAPAAHRHYGPVASMPGLAMRPLANQTLLDGHSHGGQAAHSHGLSTHKHFHEQDPGWQSFMIRSKEPQHADKLAAALEAIAREEPLLRIKGFAACADGPGRLLAQGVRKRIELSRDEALAAPRQAQLVFIGYHPSRPRVVALLRDITGAHWS

SEQ ID NO: 6261 - protein, 266 aa, Chromobacterium substugae
MSALELCGLDWSPDPRCAPEERLLRGIALTVRPGEFVGVIGPNGSGKTSTLRCAFRFNQPLAGEARLDGADIWRQSAAAFARRVAVVLQEFPEDFGLTVREAAEMGRIPHQSLLRGAPADDADIVDDALRQVGLLERQHQSFATLSGGEKQRALLARALAQQPELLILDEPTNHLDLRHQLSLLRLVRRLGIAAVATLHDLNLAAAFCDRLYALQEGRIVASGSPAEVLTADLLREVFGVRALIDAHPLAGHPRITLITEEHSHEI

SEQ ID NO: 6262 - protein, 322 aa, Chromobacterium substugae
MRFDFPLLLAAGLAALSAVQAHAGHYPLTVQSCNRQVTFQRAPERAVSHDINMTEMMVALGLQKRMAGYSGISAWNKLNAPLKQALGALPELAGDYPSAEALLARRADFFFAGWDYGMRVGGPVTPASLAPLGINVYELSESCAHVMKRPAASLADVYRDIGNLGRIFDVEPRAQKVIAEMRAKVDSASARVAKRQATPSVFVYDSGEDRPFSAGRLAMPNALIQAAGGRNILDDVDASWTRVNWETVIARNPQAIVIIDYGKVTAQQKIAFLRNHPALGKLDGVKNQRFIVLPYDSATPGIANADAVVALARGLHPQAFAR

SEQ ID NO: 6263 - protein, 343 aa, Chromobacterium substugae
MSAPAFARGPAPLPPILLALLAALAASVLLTVGLGPAPVGLADSWSILLHQLGAPVAPAWQPGQDLIVWQLRLPRVLLGGLVGAGLALVGAVLQAATRNKLADPHLLGVSSGATLGAVSVLLFTGNLAGSLTLPLAAFAGALLSTALVMAVALRQRRLQAERLLLAGVAVSFFMMALANLLIYLGDHRSTSSVLFWMLGGLGQARWELLPVPALALGSGLLALAALGRPLNALMAGEQTAVTLGIQVSRLRLAVFAVSSLMTGVMVAVSGAIGFVGLMIPHIARRFVGADHRRLLPVCALSGAIFLIWVDAAARTLIAPEDIPVGVGTAAIGGAFFIWLMRAR

SEQ ID NO: 6264 - protein, 200 aa, Chromobacterium substugae
MKTDPASHQRMAEKRKAGFEKKKAAATKEKGLLIVHTGTGKGKSSAAFGMGLRTVGHGMQLGVVQFIKGALHTAERDLLGGFPNCDFHTMGEGYTWNTQNRDADIATARKGWDEACRMLASGEYDMVILDELNVVLKYEYLPLDEVLAAFAARPADLHVVVTGRHAPEALIEAADLVTEMRLVKHPYREQGIKAQQGVEF

SEQ ID NO: 6265 - protein, 430 aa, Chromobacterium substugae
METRHCPALFLTAPASHQGKTTLTAALARHHRKQGRRVRVFKTGPDFLDPYILEQASGHTVYGLDLWMNGEDDCRARLHQAAAEADLILIEGSMGLFDGTPSSADLAELLGVPLVAVIDAAGMAQTFAAVAHGLASFRPGLVLHGLVANHVASERHAEMLAQQLPVHLPLLAALRRDEAARLPERHLGLVQAQEIADLDARLERSAAQIAGTALAALPPPAAFPAIAQPAVPRQLAGKRIAIARDAAFAFVYPANLETLRQLGAELAFFSPLADAALPDCDAVYLPGGYPELHLETLSANTALKADLHGHVEAGKPLYAECGGMLYLLDRLTNRDNDNAAMLGLLPGHATLQARLCGLGLQQMDFPGGALRGHTFHYTRLETALEPIARAERASGAGQGEALYRRGSLLASYFHAYFPSNPLATASLFLS

SEQ ID NO: 6266 - protein, 214 aa, Chromobacterium substugae
MNRYPQADIDAIYRAIRERRDMRHFLPDPIDSETMRRLLAAAHFAPSVGFMQPWRFIRIRSAELRGQLHALVEQERIQTARALGEREDEFMKLKVEGLLDCGEVLVAALMDGRERHVFGRRTLPEMDLASVACAIQNMWLAARAEGLGLGWVSIFDPAKLAALLAIPAGARPVAILCIGHVEAFYEKPMLEQENWARRQNLADLVYDDRWPGQA

SEQ ID NO: 6267 - protein, 363 aa, Chromobacterium substugae
MKTAKTMAALWLLAIGHLAHADATVPRWAVQAEGRQVRHADGWQATWPGVNWQVRVAAQAVGVTLDDAVNYYALEVDGKAVQKIGPAAGERTLWQDLPDRRPHIVRLFKLTQSPDNPGWFKGFSLRQGQVLEQPPKPRRQIEFIGDSWTVAYGNLSTTRDCTDQQIVERSDASQSFAAYLGKRHGAQIQNDGMSGMGMVRNWGGNMPEVDYRSYHPRLLQNLPASAPGNNAEHRDNWRPQLVVIALGVNDFGTDVGPGEKRSQQQLADDYVQAYHGLIARLKQRYDNPAFLLAATYLWPADRMRPLVSRIADEERQQGTTVAYVDWQNIELTGCNWHPNLSDHAKMADQMDAAIRTLGNIWDK

SEQ ID NO: 6268 - protein, 140 aa, Chromobacterium substugae
MKPRITLLTLGVDDLQRALRFYRDGLGLASEGIVGAEFEHGAVAFFELEGGLKLALYPRASLAHDAGLPEPRAAAAGVSIGHNVSSRGQVDETMAQAARAGGTIVKPAMDTFWGGYAGYFQDPDGYLWEVAWNPQWEVRD

SEQ ID NO: 6269 - protein, 260 aa, Chromobacterium substugae
MFEQDVVRYQVEDGIGRITLNRPDCLNAMNRPLLRQLLAALELAAVDESARALILCGSGRVFSAGADIRFLSQASAAEVRELARLAVAVTSRIEALGKPVLAAINGDALGGGLEIAEACMLRLAAPHARFGHPEVRIGAVAGFGGTTRLPRLIGKGRAAELLLTGRLIDAEEACRLGLINRVVAAADLLAESEALLREVMAQSPVAVRLTWEALHRGLSLTEDEAARLGADYFGLAAQSEDFRIGTRAFLDKQAPHFKGR

SEQ ID NO: 6270 - protein, 155 aa, Chromobacterium substugae
MPAIIRQALPSDLETIVLLRMRLFDDAAALNGVGPDETIRAATIAYFRQALQGGDCVTWVAEEAGQVVAIGSLAVFARPPYPGNAAGRDAYLLNMYTLPDHRGQGHARAIVRSALALAQRRGYGKVWLHATEAGRPLYRQEGFLASADYMEWAAG

SEQ ID NO: 6271 - protein, 112 aa, Chromobacterium substugae
METPPPSPCIGICRLDESGQVCVGCRRTLDEIAGWSSYGKEEKERVWQRLLALPVPVQAKTCARCGGGFTCGAGGEAGGCWCADLPRRLSPSAADSDCLCPACLQRQLRVEN

SEQ ID NO: 6272 - protein, 407 aa, Chromobacterium substugae
MQVSKLSTLTLAVAAAVALSACGKKEEAAPAGAASAPAQASAGGDVVKIGFAAPLTGPQSHYGEEYKNGVTLAIEDANAEKPTIAGKPVTFELDAQDDQADPKTATQLAQKFVDEKVAGIVGHFNSGTSIPASKIYSDAGIPMIAMATSPVFTAQGFKNTFRSMTSDTQQGGVMGKFVVQNLKAKKIVIVDDRTAYGQGLADEFEKSARAAGGEVVKREFTNDKATDFTAILTSIKGANPDAVFYGGADAQSAPMTKQMKRLGIKAPLISGEMTKTPTFLQLAGKEADGTIASLAGLPLEQMPGGKDYESRYKARFKSDVATYSPYGYDAARTLIQAMKDANSADPKVYMPVLAKITHKGVTSSNWTYDDKGDLKDGGITVYKVENGQWKVLETVGGGVAKDASAAK

SEQ ID NO: 6273 - protein, 1197 aa, Chromobacterium substugae
MQFEAFAHHQTALRDAITAAYRRDERECVQALLAQAAMSPEQVKSVQQLASRLVTEVRRERTRSSGVDALMHEFSLDSSEGIALMCLAEALLRIPDRVTADKLIRDKISRGDWKAHLGNSSSLFVNAAAWGLLVTGKLVSSHSASGLSAAMTRLIAKGGEPLIRKGVDMAMRMLGKQFVTGETIEEALANGREREARGYRFSYDMLGEAAMTEADAQRYLKDYVTAIHAIGKESNGRGIYEGPGISVKLSAIHPRYARLKHERMMSELLPRLKDLFLLAKQYNIGLNIDAEEADRLEISMDLVEALANDPDLNGFEGIGIVVQAYQKRCPYVIDFLIDLARRTSHRFMVRLVKGAYWDAEIKRAQVDGLPGYPVYTRKVYTDVSYLACAKKLLAAQDAIYPQFATHNAYSLAAIYDLATGLDYEFQCLHGMGETLYDQVVGKDKLGKACRIYAPVGSHETLLAYLVRRLLENGANSSFVNRIVDEAVSIAELVTDPVAEAARHAGAPHGKIALPAELYGNGRRNSKGLDLSSEHVLATLQLGLQASEQQRWAAFPMLGDGDVSDGQLLEVRNPANHADIVGKVIEASPADVERALTQSAGYAAAWAATPVAERAACLNRMADLMEANMPALMGLAVREAGKTLNNAIAEVREAVDFCRYYAAQIAAEFDNASHQPLGPVVCISPWNFPLAIFIGEVAASLAAGNTVLAKPAEQTSLIAAYAVRLLHEAGVPRAALQFLPGRGEVVGAALTGDARIQGVIFTGSTEVAQIINRTLAKRSDDTVLVAETGGMNAMIVDSSALPEQVVTDVLSSAFDSAGQRCSALRVLYLQHDIADKVVKMIKGAMDELTVGNPAKLTTDVGPVIDAEAQAGLLAHIEKMKKSARAVHQTRLSSECEQGTYVAPTLFEIDNLSELKREVFGPVLHVLRFAASDLDQVVAEINATGYGLTHGIHSRIDETIADICGKIKAGNVYVNRNIVGAVVGVQPFGGEGKSGTGPKAGGPYYLYRLSRAAWQPKLAAVNAAVELPALEALAAAAKAQGLALDGAIAAARKESPLAHSVALPGPTGENNTLGFAGRGRIGCVADDAQALAEQLAAVFAAGNRAVLAKDGAGAKLAAQLGSHVELAADVLAADVDAVLFAGSGAEEARRRLAARDGALAQLILRDAHGYNIHRLVVERALSVNTTAAGGNASLMSMSE

SEQ ID NO: 6274 - protein, 529 aa, Chromobacterium substugae
MKKNLPVDSIELFLLPHRPIVTKTDLKGQITYANRAFIDISGFSEEELIGQSHNVVRHPDMPEEAFADLWTTIKSGRPWKGLVKNRSKQGHFYWVEAYVTPICENGRPVGYMSVRSAPSKTQTAEAEQLYARVREKRQAFPQTRHTTPLPLSLAMLLAQLPSAALALAAAALPGGAARVSLLALLALWAPLAGYLAARWQTPPIDAARKALMRLAEGDFSSQIAPAGLREPRAVLEEMETLRIHLRAILADVVAGAEDISEAASATHAEAESLNSRGEHTQEGIIRVAAALEQLSVAVNEISQATRTGADFAGQATELATQGETQMNGTRQAALEVVNEVSSTRNTIIKLEQSVESINTVTGVIKEIANQTNLLALNAAIEAARAGEQGRGFAVVADEVRKLAERTAGNTLEIEQSVAFLRERSSEALADVKAAVDKVHIAEATIQVAAQGLEAIRGANEKVAESSASVANMLRQQSSASTEVAQNMETMSRLTEQNGHSISTTLQVAQKLHLTAGDLRRLVSQFEKHM

SEQ ID NO: 6275 - protein, 334 aa, Chromobacterium substugae
MIFANRYFPATRMRRMRKDAFSRRLMRENALTVDDLIYPVFVMEGSNQQIDVPSMPGAPRLTLDKLLYVAEEALELGIPMLSLFPVITGDKDNEGSEAYNPEGLVPRVVRELKKRFPELGVMTDGALDPYTIHGQDGVIDANGYVLNDETTEILVKQGLCHAEAGVDVFGPSDMMDGRIGAIRQAFEEEGFIHTKILAYSAKYSSGFYGPFRDALGSSANLGKADKNSYQMDPGNIEEAIQEVAQDLEEGADMVMIKPGMPYLDVIRRVKDTFHVPTFAYQVSGEYAMLKAAFQNGWLNEEKCMMESLLAFKRAGADGILTYFAMDAARLLRQR

SEQ ID NO: 6276 - protein, 73 aa, Chromobacterium substugae
MDVLHATWFWVAVIAAPAIALIGTLARLARKEPPIKLPSGVAPLRWDDDEEDAPSGEAKPPVAGNGDRVPPKH

SEQ ID NO: 6277 - protein, 401 aa, Chromobacterium substugae
MNHTYLAHLQATLAQIRADGFEKPERVIATPQSAGIALAGGEKVLNFCANNYLGLADDKRLVLAAKAGMDEYGYGCASVRFICGTQSIHKQLEKSISEFLGTDDTILYSSCFDANGGVFETLLSEEDAVISDELNHASIIDGVRLSKAKRFRYKNNDMADLEAQLIAAEAAGARFKLIVTDGVFSMDGIIANLKGLCEVADRHGAIVMVDDSHAVGFIGESGAGTPELCGVADRVDIYTGTLGKALGGASGGYVAARQPIVDLLRQRSRPYLFSNTLAPAIAAASVEVLSILKSGEGAELRAKVRRNAELFRKEMAAAGFTLVPGEHPIVPVMLGDARLAGEMAARLLKEGVYVIGFSYPVVPKGKARIRTQMSAAHSEEQVLRAVAAFIKVGRELGVIPD

SEQ ID NO: 6278 - protein, 341 aa, Chromobacterium substugae
MKALAKLKAAPGLEMTDVPMPEVGHNDLLIKIVKTAICGTDIHIWNWDEWSQKTIPVPMHVGHEYVGVVAGMGSEVQGFKIGQRVSGEGHITCGYCRNCRAGRRHLCRNTTGVGVNREGAFAEYLVIPAFNAFPIPDDISDDLASIFDPFGNAVHTALSFNLVGEDVLITGAGPIGIMAVAIAKHVGARHVVITDVNDYRLELAQKMGATRAVNVAKQDLKEVMQELGMTEGFDVGLEMSGNPQAFRQMLETMNHGGKVALLGIPPSNTAIDWNQVIFKGLEIKGIYGREMFETWYKMVALIQSGLDISPIITHHYKVDDFEAGFASMLSGQSGKVILDWS

SEQ ID NO: 6279 - protein, 519 aa, Chromobacterium substugae
MAHEIRMKTRLVALGVINLSTLLLLVVAGIYQLSAMNRDMERQLNHVAQQSRINRSVQLANLHFKIQVQEWKDILLRGNAPADYQRHFNAFQAEGRTVDQTLEQAAQLQKDSGQDRSALNAILQQHSQLDSRYRAALASFRQSDRLSGQTVDRLVQGQDRDMTEQLLNASAAIQDGFERLLRDQIAESRSHYRDERGWFIAAALLSLAALAAAIIYIGRSLFRQVGGEPAEVAAIAKRVAAGDLTVRVAPRPGDDISVLAAMAQMVRQLTGVIEELGSNAESLNLTSEEVSASAQALSQSASQQAASLEETSASVEEIAATVAQNSDNAGITNEMAGKAAEDADQGSQAVGQTVSAIREIARQIDIIDDIAYQTNLLALNAAIEAAHAGKQGKGFTVVAAEVRKLAEHCRTAARDIGKLAVDSVALAEQAGGLLGQMLPSIRKTADLVQEITMASKEQSEGLMQINTAVCQLSMTTQLSASTSEELSSTADQLNSQALRLKQMMAFFKTRRAADAPPHD

SEQ ID NO: 6280 - protein, 441 aa, Chromobacterium substugae
MIAVIGAGVSGLSCAWWLRARGAPVRVYEAAGRVGGKVWTRTEGALCEAGPNTLLADEALLRWFEELGLSPVWPAGGGRPRHVLKDGRYHPLPQSVSQWLAGGFPGWSAKLGVAAGLLKSGDPRAGEESLAAFCRRQFGRAALDNLLDPLAGGVFAGDPDELLLAETLPELAVAAQSPGPLWRALLRLRGQRAARRVCTLAGGLESLPRRLARDLDIRLNAPATALARDGSGWRLRAGADWERFDQVVLALPAGAAADLLEGSEPAAATLCRQVRYAPLAVAFTLARAEALTRPLPGFGGLHPHSEGALALGHLMSSNLYPHVCRPGERLLTSFIGGRRQAALLELDDDALLARLNWELERLFGLKGAPTLQRVARWPQALPQGTAIQRALRAATAPWAERGLHLCANWLDGASLPDCLDKGRRLAARIAGADGTALLRRR

SEQ ID NO: 6281 - protein, 296 aa, Chromobacterium substugae
MLTFQEIILTLQHYWNRQGCALLQPYDTEVGAGTSHTATFLRALGPEPWNAAYVQPSRRPKDGRYGENPNRLFQHHQFQVVLKPAPANIQELYLGSLKELGLDPTQQDIRFVEDDWENPTLGAWGLGWEVWLNGMEVTQFTYFQQVGGLDCKPVLGEITYGLERLAMYLQGVENVYDLIWTHLPDGQPVTYGNVFYQNEVEQSRYAFEHSNVELLFRQFSDYEAEAKALLEASLPLPAYEMILKAGHTFNLLDARGSISVTERATYIGRIRTLSRGVAQAYYDAREALGFPMCRKD

SEQ ID NO: 6282 - protein, 142 aa, Chromobacterium substugae
MKACIAILLCCSLPAWAEQPADWVVYQDGKSLQLAIDGNSLWLGKDGLVHFIHQERFARQRYEKSYRLHFYIRRTTGYADCKQYQYVFVGSEYFDQNNKHLFSTMFPVPRYAWKWQPVNEDSVAHAMMKVICEAAGAASQNN

SEQ ID NO: 6283 - protein, 686 aa, Chromobacterium substugae
MNATLLIELLTEELPPKALPRLAASFAQTITEELKKLQFIAADAEAVAYASPRRLAVQLPQVLAMQPEQRVTRQGPAVAAGMKDGQPTPALAGFARSCGVEVSELAVVSNGKQDVYAYSSTKAGEALSALLSDVVALALKKLPAPKLMRWGNLDVQFVRPVHGLVMLHGDAVVDGEVLGLKSGRVTRGHRFLSQGEVSIADADGYARAMHEEGKVIASFAARRELIGHKLAEAAAKLGATIAAPDALFDEVTGLVEWPVVMEAGFEAEFLQVPQECLILTMQQNQKYFPLLDQNGKLMNRFLLVSNIAPQDPSFVIGGNERVLRARLSDAKFFFEQDQKVRLDSRLPRLANVVYHNKIGSQLERVERLQSIAGAIAHELGADAALAARAAYLAKADLVSDMVGEFPELQGIMGMYYARHDGEHAEVAAAIEGHYHPRFAGDTLPEGKIATAVALADKLETIIGIWGIGLIPTGDKDPFALRRAALGVVRMALEADLDLKRLLDIVANAFPTGKLSAGVADEVFGFMMDRLKNFLAADCKADEIDAVLALSPSRLSEVRAVLAAVAQFKALPEAAALAAANKRVKNILKKAEGDIAAVNPALFAEDAERALFDAVETLAPAVDAKFAAHDFAAALAQLSSLKAPVDAFFDGVMVMAEDAAVRANRIALLARLAALFNRVADISLLAE

SEQ ID NO: 6284 - protein, 179 aa, Chromobacterium substugae
MKLVILDRDGVINEDRDDFVKNSVEWVPIEHSLEAIANLTQSGWRVVVATNQSGIARGLFDVHALNAMHEKMHRLVNQAGGRIDAVVFCPHGPDHGCECRKPLPGMVLEIAERFNVKLEGLPLVGDSLRDLEAVAAVGGQPILVKTGKGAKTMASGKLPESTLVFNDLYDAAEHLINHH

SEQ ID NO: 6285 - protein, 258 aa, Chromobacterium substugae
MISLWIRNLLYWLVLCVITPLFFCLLLLAAPLPRRGRHVFGVSWALTLLWMLEHVIGLKYTVVGRENIPDEPSVICSKHQSGWETLALQKIFPWQVYVAKRELAWIPLFGWGLVLMNPIMINRSDRSRSNQRLLEQGLERKRHKFWITVFPEGTRTKPGVPGKYKLGAARMAKQFDMPLVPVAHNAGEFWPRNAFLKYPGEVTVVIGPAVRPADDAGPEAMMAEAEAWIESQQRLIGGVGPFAHPDEKRQRLAPPASA

SEQ ID NO: 6286 - protein, 113 aa, Chromobacterium substugae
MSFYQEVLGMKLLRRSDFPEGRFTLAFVGYGDEADHTVLELTHNWDTASYELGNAYGHIAIEVDDAYAACDMARAKGGKVTREAGPMKHGSTVIAFIEDPDGYKIEFIQKGSR

SEQ ID NO: 6287 - protein, 469 aa, Chromobacterium substugae
MNHKLLGMAALSMTPALAQAADMDGAAMGLAWGVPFAGILLSIALFPMLAPGIWHHHFGKITAAWTALFLAPFAVSFGLGHAATLVLHALLTEYIPFIVLLFALYTVSGGILVWGSLHGSPRLNTALLAIGTCLASIMGTTGAAMLLIRPLLKANEGRKRNVHVVVFFIFLVANVGGGLTPLGDPPLFLGFLKGVTFGWTFQHMLAPVATLAALLLAIFYFLDRHLYAKEAQEGTLKPVDASHDKPLKLYGKRNFWLLAGVVGAVLMSGLWQPGIVFELPGAHLELQNLLRDAALLLLALASLWITPKQVRAGNEFNWLPILEVGKLFAGIFITIVPVIAILRAGAHGDLAGLVQMVSAPDGKPLDGMYFWMTGILSSFLDNAPTYLVFFNLASGDAATLMGPLGSTLLAISMGAVFMGANTYIGNAPNFMVKAIAEHRHVKMPGFFGYMLWSGAILMPCFVLMTWLFF

SEQ ID NO: 6288 - protein, 267 aa, Chromobacterium substugae
MPKILLKSLAAALLVLPTLAGAAALKITVANLAYEEKVEEYFHLTAASSDDSFNANRNYAAASSSNRYLEVEGTKVRIDRGEMRRFNADIKGELLKLRTVQLVEAQGYRPSKNNETLFDVIARIKRGEFRGADYVLFGTVSNIDVQDDANPIAGTSTVSLSRNMQLVADFSLVNTKTYAVKAAFSAMGAGSDVKLVGEQGAVLNPNNGKIVSEVSKSLGHNVVEQITEQFGALGTMRDNGGYADARQPTYAAPQEEVMVLTPAAPAK

SEQ ID NO: 6289 - protein, 199 aa, Chromobacterium substugae
MNARNLTRSALCALAIAALSGCAQTNSPTLGDGSVSYGDSKAVELVSNEFGSTDLQRLAESMTRSLVQVPVIRGKRLTLADVQNKTSEYIDTAEITKSIRVQLMKAGTVRFVADVAHMEGQTQELMRQNQSGLYDKSKSKKIGKMVGADYRLTGGISSIVKKNSDVKDVYYKLSLELVDNETGELVWADEQEIRKTSRR

SEQ ID NO: 6290 - protein, 129 aa, Chromobacterium substugae
MNMRHIRRCLLLAALAAAPLCHADGLESKLETLGKMDNIKVESARVVKRNDFLNVQAELSNSATKQQMLFYRFKWLDGSGMQTGAEETWKQLQLQGLERKSIQTVAPTPQAADFRLELQSPDNSVNLFR

SEQ ID NO: 6291 - protein, 464 aa, Chromobacterium substugae
MKRKSKLANSVLIIGLAASLSACGSMRSYQGEMKTALAAANEGRIDDALASVEANNSSEDKDLLYHLEKGQLLRLKGDLQGSVDAWLKADEKIRVWEEESKLTTSKAAETAGSLLINDKVRRYDGEDYEKVMLSTMLTLDHALSGNYAGARTEIKKTYEREALIASLHEKEYDKVEEEAKENNVQTTFKDLQGYPVETLDDPEVLNLKNGYQSAFSHYLAGYIFESLREPSLASAGYRKAIELRPNMPLLEQGLKGLNSRIAQKAAGTDVLFVVESGLIPTRTSLAIPMPFSLDGKPIITQIAFPVIMPGHSYQPLALQVGDKPVALTPISNFDAMARRALRDEMPGIIMRSTVRAVAKGLAQKELGDQFGALGSLAGITATVLTEQSDERAWSTLPARIAIGRVNLKPGRYSVSVPTPSGERQVELDISGSHAIVPLRLFEQTVIPPQGGKQPPAAAVKTAGI

SEQ ID NO: 6292 - protein, 456 aa, Chromobacterium substugae
MHIHILGICGTFMGGIAAIAKQAGHKVTGCDANVYPPMSTQLEEMGIALTQGFGAEQIELNPDVYVIGNVVTRGKPLMEEILNRGLPYISGPQWLAENVLQDKWVLAVAGTHGKTTTSSMLAWILEDAGLAPGFLIGGIPENFGVSARLPGKPALDPASVSPFFVIEADEYDTAFFDKRSKFVHYRPRTAILNNLEFDHADIFADLAAIETQFHHLVRTIPGNGRIVSNGREANLERVLERGCWTPVERFGADAGWQLGELHEDGGFDVLLNGQMQGTVRWGLMGEHNRLNAVAAIAAARHAGVAVKDAIDALSRFANVKRRMEVKGVAGGVTVYDDFAHHPTAIATTLEGLRRKVGQARILAVLEPRSNTMKLGTMKDALPGSLALADQVFCSAAGLNWNPGEALEAMGAKAQTFTDFDALIDAIVAAARPGDHVLVMSNGGFGGIHQKLLDRLA

SEQ ID NO: 6293 - protein, 311 aa, Chromobacterium substugae
MVTFQALQPFIDTVQGCLIVASPDDGRIASANQLACILLACPHDELLDRSIFDFIQDPELAAGIRAELGSDNMIYNRGMQLRTASGRDFEAQLSVRKVSLNDRPMLVFSFSDRTEAKVMGQLLDFERQLVERSLSIVKTLKEEGGQTDDEDKLTGVAGMHRLLAVANAETSRARRYGGPLSGLTLELVNAPEMVPDQDDGSAYAHLIRLAGSLCLQNARDSDLVARRSANAFIILLPNTPMSGANEMGRRLIKSLRQLTFVYQGAEHQAAACVGLSALRPTETSPAPMLERLQQAQGKAREGGANYIIKLP

SEQ ID NO: 6294 - protein, 452 aa, Chromobacterium substugae
MRFQKTNTTKKQDMARSQWGSRLGFILAAAGSAIGLGAIWKFPYVAATNGGGAFLFIYLGICLTLGLVLMLAEMALGRATGAGAVGAFRKVAGGFWPVIGYMGVLVCFLILSFYSVVGGWTIAYIVKSLQGGIMTSDPKALGAIFNGFISDPAQPLLYHGGFALLTLAVVAGGVQKGIEALSKLLMPALFALMLVLIARGLTLPGALEGVGYFVAPDFSKASAAMLVDALGLAFFSLSLGLGIMITYGSYVGRESKLLGSALWVILLTVATCFLAGLMVLPAVFAFGFDPSAGPGLTFITMPAVFAHLPLGQLFAVLFFCLLLLAALTSSVSLLEVVTSFAIDEWGMSRRAAAWLMAAGIFLLGIPASLSLGVWGDYQLGGMNFFDLLDFVTSKLLMPAGELLLALFVGWKAWPVVKAELSSGRSPRAMQCMRGFCMALAPLLIGWIMAAGI

SEQ ID NO: 6295 - protein, 233 aa, Chromobacterium substugae
MRWMGLLLFGLLAGAPRAETLQVLTTQIPGVIALAADGVTMEGTGIDLMREVGRRAGVDFRFAAYPQARARLLVEQQVDACSPMARLPELGERYKWTATLLPMRLVLLARDGDARRLRSLDEARGLRIGAMRGTMAAARLRARGLAPEESADYFGGLEKLQLGRLDLWAMLDVGVASLARRLGMPQPRVALVLDTLDVALACNRKLDDAVLARLDRAIASMHQDGSINHFDLR

SEQ ID NO: 6296 - protein, 412 aa, Chromobacterium substugae
MKVRLTLLSGCLLLAACATPPNPASAPAPIVAPVPEEPASAPAVETLPQTPPPASAPVQVPSLPIARPVQPPAVISDSQGRALLDRLLPPGIPDRKGWSNDVMGAFSHLKIPYTPQFFCAVLAVAEQESGFSSDPVVPNLSKIVWGEIDQRRQKYLIPSFVVDAAMSKKSPDGRTYKQRVDALRTKREMNALYEDMVRELPFGQTIFEHKNPIRDGGPMQVSVAFAETHVRAWPYPYNYSSLRDEVFTRRGSVYFGTAILLQYPAPYHEMVYRFADYNAGRYASRNAAFQQAVARLSGRKLALDGDIMLYSDKMNRVLSGAVSDTQRALQSIAGRLGMSNAEMQRDLQQEKLSGFGQSQLYQKVFALAGPKAPREIIPQIVLVSPKFTHKLTTEWFARRVDGRYQRCLQRGG

SEQ ID NO: 6297 - protein, 150 aa, Chromobacterium substugae
MKVSINGKEVELGSSPDTPILWALRDELGLTGTKFGCGAALCGACTVLKNGLAIRACVTPISTLAADDSITTIEGNAGKVAQAVKQAWHDLDVVQCGFCQSGQVLAATALLSANPHPSDRDIDLALSGNLCRCGTYPRIRAAIHAAAKLL

SEQ ID NO: 6298 - protein, 722 aa, Chromobacterium substugae
MSVSGISRRAFLKAGGMVGGALCLGFVLPNGGLARAAGAGGAIPTPNAFVRIEKDGGVTIVSNKSEMGQGIYTSLAMLIAEELECDWSRIQVVSAPAAPIYVHTAFHIQITGGSTSTLSSYDQYRKIGAAARDMLIAAAAQRWRVPAAQCRAENSRVFNNANGASLGYGELTEAAGKLPVPDTVALKPRHRWKLLGTRVHRVDGGEKLDGRAQFAMDVRLPGMLTALVKRCPSYGGKPKGFNADAARAVPGVKAVFAISNGVAVLADGFWPAKKARDLLEVEWDRGANASLDSARLRAHYRELASRPGQHYRGVGDADSALAGAAKQLEAWYEAPYLSHSPMEPLNCVVWLKPGSCEIWSGTQSQTIDAGMAAAMTGLKPEQVSLHTTFLGGGFGRRAVPVGSDWLREALEVAKQHGQDLPVRLMWTRDDDLAGAYYRPMWLDRVRGGIAADGKPAAWLQTGVGQSILAGTPFAPMMVKNGIDAVSVEGTDDMPYALPALALDLHTPEIPLPVLWWRSVGHSHSAFAKESFIDELARLARRDPVAYRLALMDKAPREQAVLREAARMAGWGRKLPKGHGLGAAVHASFGSHVAQVVEVAVKGKELKVLHVWCAVDCGVVVNPDQVAAQMEGGIMFGLSAALFGAITFKDGEVEQKNFDGYQIVRMFQAPKVDVSIVASDEAPGGTGEPAVPLVAPALANAVHAASGKRRRELPLIRHGYQMV

SEQ ID NO: 6299 - protein, 181 aa, Chromobacterium substugae
MRKTMILGWALAAALPAAWAGGDPSASLRAYGEVAKVLQSPRCMNCHTVTDFPRQGDDRHPHAQLIRRGPDNMGAPSLMCMACHQAANSADGLVPGAPNWHLAPLAMGWEGLSGGQICRRLLDKTRNGNRDVPALVAHMTADPLVQWAWKPGAGRATPPLSQQDFHAAVRRWADSGAYCPR

SEQ ID NO: 6300 - protein, 330 aa, Chromobacterium substugae
MQGNVEEVLSQALSWLESGRRAALVTVLSTFGGSPRPPGAMALIRDDGAVFGSVSGGCVEDDLGREIVAGGFFGRETAVRVRSFGVSVEERQRYRLPCGNSLRVAVEPAPDAGQLRLLLDAVRAQRCLWRTVRYRDGAAALSDAGPPGEFAEDEQGFGVLHGPRWRLLIIGASELGAYLAQIAVTLDYAVTVCDPRSEYSQGWSLSGARLSGEMPDDLVLAFGCDSRTAVVAVTHDPKLDDLALMEALRLPCHYVGALGSAATTLKRKARLAEHFGLSPAQLERLHGPVGLAIGSRTPAEIAVSIAADLIASRSERARPGVAGAARTCRA

SEQ ID NO: 6301 - protein, 184 aa, Chromobacterium substugae
MLAAGAGRRFGGDKRQAALPDGRTLLEASLQAFVGQVDVLAVALPEDDAFGAALCRQLGATPLACRLNRAGLGHSLACAAAWALALPQCRGLVLGLADMPLVRPHTVSQVAAALWHGRPVLPCYLGQAGHPRGLPGACLPALLDLSGDIGARDALDWSQALRLELDDAGVLLDIDTPEDLLRLG

SEQ ID NO: 6302 - protein, 615 aa, Chromobacterium substugae
MRFTVAHKLVLLIAPLVLALFFVAIGYAWNQRQLLQALNRDQTLTENIAMVGELIQSLQDERGLSYGYLNRHQALPAQLGRARDGASAALQKLLRQPQAELSDALRHYLETSAPRPEQLAQLRRDVDNRHISPDPAFNRYSDMIEQLSRIITLFNAQTQDVQALILQWSAVNCQKEYTGRTRGLITGVLTVGSFTITNFRQVSGVVSQEELCRTQYRQYGGDDALLRNAMMRSRQFESARDAVLARGAGAMQSATPEEWFAAASQRVASLYQVQQDLLQQIRQRVEGQAHSARLHGYLVLLGLLFLLLPIALAVLVGRNIIRTLGAEPDEVAQGMRELSAGRLDFFLPLAAGDDHSLAAHIRQMGDRLSGVILQVKQDADAVANASTELNSASQGLSQGAARASVDVEGASSAVDEIARSMAEMAGDANRAGGMADTATGQAADGNQVVQQTIAAMREIARRTTIIDDIAYQTNLLALNAAIEAARAGEHGRGFAVVADEVRKLAKRSQAAAKEIDQVANRSVQLAESAGRQLSDIVDSSQRTLELVRGISQEATVQSQRVGGINEAMQRLNQLSQGNAAASEELSAAAQEVAMRADSLRRQMQYFQQGDDDKPA

SEQ ID NO: 6303 - protein, 334 aa, Chromobacterium substugae
MAFLQIDHLNKRFGQQAVVHDFNMKVEAGEFVTFLGPSGCGKTTVLRMIAGFETPSGGAIRLAGDDITHQSPQKRGIGMVFQSYALFPNMNVADNIAFGLKMQKRGADEIRRKVGEVIALVELNGREKHFPHQLSGGQRQRVALARALVVEPRVLLLDEPLSALDARIRKNLREQIRDIQRRLGLTTVFVTHDQEEALTMSDRIFVMNQGKVEQEGAAETIYTQPATEFVARFMGNYNLLSAQQSQALLGLDIQGHLAIRPESIQLADAGEAGADTLPAVIRQHQLLGNIIRYQVESRGATLQVDRLNRNAGDLLASGTEVRLRISREDIREVR

SEQ ID NO: 6304 - protein, 266 aa, Chromobacterium substugae
MKTAATSRLGAWIAILLGSGYFLLPLIATFEFSLKMKREGYSFEAYKVVLSDPGFQASFGYSALLALLTILAGILLVVPTAFWVQLKLPRLRPLIEFLTLLPLVIPAIVLVFGYLRLYGSGGWLPLTGNERGTDLLLVFGYVTLALPYLYRSVDTGLSAIDVRSLTEAAQSLGSGWFDILRLVIFPNLKTAILSGAFLTFAIVIGEFTLASLLARPAFGPYLQLIGANRAYEPAALAIIAFLVTWAAMGLMQVVSRNRAALGADEH

SEQ ID NO: 6305 - protein, 302 aa, Chromobacterium substugae
MSASSDTMSPPGSRLSSGKPQRGSILSWLGVAPFLLFALLFLILPTALLMVGAFQDAQGDFTLGNIIRLFEPNILSAYQISLEISAASAILGTLLGLALALAAIRGGLPAWIRPTLTTFSGVASNFAGIPLAFAFLSTLGRMGLMTMLLRKYLDFDLYGSGFSILSFAGLTLTYLYFQVPLMVLIIAPAVEGLKDEWREACESLGGSGFAYWRHIALPVLWPSLAGAALLLFANAFGAVATAYALTGSSLNIVTILLYAQIHGDVLHDQNLGYALALGMVLITGSANAGYIWLRKRSHREAA

SEQ ID NO: 6306 - protein, 365 aa, Chromobacterium substugae
MKNKLGYAAVVGALSMIANSALADNLAALAQAAKKEGELTVIGLPHDWCGYGNVIAGFKAKYGIKVNELNPDAGSADELEAIKANKNNKGPQTPDVIDVGLSFGPQAKAQGLLQPYKVSTWKSIPDNAKDKDGYWYGDYYGVLTFQVNKDLISKAPADWADLLKPEYKNAVALAGDPRAANQAIQGVFAAGLSQARGDVNKSADAGLKFFSQLNKNGNFVPVIGKAASLAQGTTPIIVRWDYNALADRDTLKGNPKVEVVVPKSGVVAGVYAQGINAYAPHPNAAKLWMEYLYSDEGQVAWLKGYCHPIRFNDLTARKKIPADLIGKLPDAAAYKKAVFPTIEQQESYKAGITKQWDSVVGSSVK

SEQ ID NO: 6307 - protein, 419 aa, Chromobacterium substugae
MSKQYDIVIAGGGVIGASCAYQLSKRGNLKIALIDAKRPGNASRASAGGLWAIGESVGLGCGVIFFRMTSAKRKREAAGAAVNVSAGAPHILPKSFFDFALASNALYPALHQELRDKHGVDFKFEETGLKFVIYDEEDRLYAEHIAAQIPHLASQVRWLDQAQLRADEPYVSHSAQGALEFLCDHQVSPFRLADAYTEAARQNGVDVFFNVNVTGVARQGSRVTGVSTAEAGDFSCGTLINAGGSWADELCQWATGLSIPVKPVKGQIVLSEKMPKLLRGCITTSDCYIAQKDNGEILIGSTTEDKGYDVSTTYPEIQGLVQGAVRCLPELARINIKRCWAGLRPGTPDELPILGPVDGVDGYLNACGHFRTGILTSAITGVLLDKLAHREALPLDITPFLASRFAEQPRDWRLEALHA

SEQ ID NO: 6308 - protein, 468 aa, Chromobacterium substugae
MNGKPLIVGGGPAGIAAAMELARHGVHSILLDEASRLGGVVYRGPLRQGVVLDYLGERYRENMQALHREFEPFRPQIDIRLETRVVGGDGGQLFALSPDEQVQPIAYSQLLLAAGCHERSVPFPGWTLPGVIMLGGLQLQLKSGVVKPLGRTVLAGTGPLLPLVACQLHRAGADVAGIYEACAFGRLAKEAIALLNQPQLFLDGLSMVAYLKRHGIPLHYGWGIVEGHGQDELRDITVAPYDADWTADLSRQRRLPAQTLAVGYGFIPRTQLTQQLGLAHQYHDDGFLKPDSDDWQRSSLPHIHLAGDIGGLRGGEAAMLTGRIAAISMLWQRHILSEQQALRQRQACLDQLAAILRFRVGIDRFTRRGAGQLALPRPDTVICRCEHATRQDIDAALEQGVNDLISLKMRTRISMGDCQGKMCVGYCSDRLREHTGKQDVGWIRPRFPLDPLPFSAFPTTAPQPTEEV

SEQ ID NO: 6309 - protein, 103 aa, Chromobacterium substugae
MSLHRDHDIQALQGQTLTIHIDNQAVAAAAGETVLSVLNAVGLRRLSRNDQQQIAGSYCGMGVCHCCQVRIDGRHKRRACQTVVQAGMRVETAGNRLDTEGLK

SEQ ID NO: 6310 - protein, 172 aa, Chromobacterium substugae
MKLKNIGIQWLAPLIAAASLSACVVTPPRAQMVYQPATVRLEMPRDWRPAEHPYYLHAMSDLRAARAYLAHGDYPQIMDDERRAVSEIDAALGEMQRAAIEDGKQPWRYEQPDARLSPTDRFHKALELLESARRDASHQEDDPWVRDLQHRILHHVDAAHHAVQQAINDALR

SEQ ID NO: 6311 - protein, 167 aa, Chromobacterium substugae
MKFSGILMMLTMAAAGNAVLSSQAMADGWRDGDAWTWQQHQWHPEEHPYYLHAMTDLRAARDLLARPDYPRVMDDERRAVDEINRALHKMRDAAIDDGKNVDDRMPPDARWRPEDRFHQAKLLLDKARQDATHREDDPYLRSLQRDIVHHIDEARRAIDYAVSDALR

SEQ ID NO: 6312 - protein, 335 aa, Chromobacterium substugae
MEYSMSRILVLYTGGTIGMDHTPDGLAPVPGLLPRLLQRFVRPGLEFDVVEFEQLIDSSVLVPSQWNQIIDALAPRYDAYDGFVVIHGTDTMAYTASVLAFALQGWKKPVVLTGAQLPLVHPRSDGWANLADALEAACQPDLHEVAVAFDRLLLRGCRARKLDVECFAGFNSPNDLPLAEFAIHAHWHKPRWLPGEGERRAQRVDENLKLAALMLTPGHGSALAGQVLQREGLDGAILLCYGSGNAPADPALLAGVAAMTARGCPVLTLTQVARGGVEVGAYAASQPLARAGALPGADLTPEAALAKLQVLLSAGLAWPELAAGLVRPLRGELSA

SEQ ID NO: 6313 - protein, 184 aa, Chromobacterium substugae
MMRHKQAQAPVRVAIVGPESSGKSTLAREWAEQLRREGRRAAWVAEYSRAYYADRPYISSMADIEAIAAGQLAAEEQAAAAADILLCDTTVLTCKIWAEVAFGQASAELLRLYRPQDYALTLLTRPDMPWQPDPLRSHPTQRDWLLELHRAELARAGIAAVELAGGREARLEQAARALWPLLPA

SEQ ID NO: 6314 - protein, 76 aa, Chromobacterium substugae
MDVQKMKETFRLNSEYIALCDLLKACNVCQSGGEAKHFIAEGNVQVDGAQELRKTCKIRAGQKVSGDGFLITVEAA

SEQ ID NO: 6315 - protein, 64 aa, Chromobacterium substugae
MDDATDAMPQPPFEVDDDMCCGSGCEPCILDIHQQELRAYRARLAAWEARQAEGLAAGDADGRH

SEQ ID NO: 6316 - protein, 285 aa, Chromobacterium substugae
MAGIDLHFHSRVSDGALTPTEVVDRAALRAPSLLALTDHDCTGGLAEAAAAAARNGIDFLNGVEVSVSWGRHTVHIVGLGIDPGHAPLAAGLQRIRDGRVERARQMGESLAAAGIAGAFDGAMRWCDNPEMIGRTHFARHLVASGAVKDVRTVFRKFLTPGKPGYVAHDWASLEDAVGWIAGAGGMAVIAHPGRYDMGKTLIERLILDFKAAGGEGIEVACGSHSLDDMHKFALHAERHQLYASSGSDFHAPGEGGRDVGYTEPLPPLCRPAWLALSGRVIRAAA

SEQ ID NO: 6317 - protein, 207 aa, Chromobacterium substugae
MAQFFMIHPDNPQARLIREAVKILRDGGVIAYPTDSCYALGCALGDKAAMERILDIRGLDLKQRMMTLVCHDLSELANYARVDNSQFRLLKSATPGSYTFILQASREVPRRTLHPKRATIGLRVPDHKVALALLEELGEPILSCTLMLPGDAEPLSDPYEIRERLEHLVDAVIDGGWCGTEPTTVIDMTDGVELVRSGKGPLSPFGF

SEQ ID NO: 6318 - protein, 398 aa, Chromobacterium substugae
MFANRILSGMRPTGSLHLGHYHGVIKNWVELQHSHECFFMVADWHALTTNFDDVSIIGRSIDEMVIDWLASGVDPEKSTVFVQSRVPQHAELHLALSMVTPLGWLERVPTYKDQMEKLSHKDLTTYGFLGYPLLQAADILVYKAGLVPVGEDQVPHIELTREVARRFNHMFGREPNFEELARAAVKKIGKAGKQFDQLRTAYLQDGSAEALEQAREILAGSQNLGAADRERLMGWLENKGKTILPECEAKLTAASKMPGLDGQKMSKSYGNTITMREAPETVSKKIRGMPTDPARVRRTDPGSPAKCPVWQLHEVYSDGATKEWVKAGCTSAGIGCLDCKQPVIDAVVREQQPMFERAEKYLANPKLVAEILADGNARAEKVARETMCDVRQALGLGR

SEQ ID NO: 6319 - protein, 441 aa, Chromobacterium substugae
MAFFNRKLISRLEQTTAQRDKARDMLAAIERSMAVIEFSPAGEIVHANDNFLRAMGYRGDELIGQHHRIFCPAGYANSPAYAAFWQKLARGECQSGHFLRLRKDGGEVWLEANYTPILDADGKVSGVIKVATDITAQVAAEQDNKALRQAIDHSMARIEFDLQGHILDANDNFLQTFGYALAEVKGKPHSMLCESGYAHSQAYQDFWAQLRQGRFMQGQYHRVDKQGRPVWLQATYNPVLDPDGRPLRVVKFATDITEQVERLQQQAENAQSAVQASENTAQLSVQGSAVLEQATTEISRVADSVESSSTILSKLGDSSSRIGSIVNTISDIADQTNLLALNAAIEAARAGESGRGFAVVADEVRKLAERTSQSTGEISGIVKSIQDDSRSAIDAMGEMQALTDSSLQLADQARGAISEIRDGARDVVQVVREVSELLQQK

SEQ ID NO: 6320 - protein, 862 aa, Chromobacterium substugae
MMKHTLLLAGLGAALPIAALAADSAPQDNALERVTVTGSNLRASSKAKANPVQVISAADIASSGKTSLPDVLRSLAVNSGNSFNEQYTGSFSAGTAGISLRGLGQRNTLILVNGKRVANYATAQELQETFVDLNSLPLKAVKRIEILKDGASAIYGSDAIAGVVNIILYPDYQGAELGASASRDASTGQNERQFNLLAGKGDLERDGYNVWFSFDAQKRDRLDQTDVSWLKDNDFRNQQGGSLVRNVTNYYNGAPAQRFPNAAGPLQDIDYGAVNPGKSGRVWAYNPALYTTLMPGIERYHAALRGSYRLNAGAEAYAEFLYGASHSNQIFGPPLTISSSLRAWNSATQSLVPISNVLPVGNPGNPNATPTPINATLFDLGQRNKTDSVSFRRLLAGVKGSGDAWDWDVSGLYSDSRLREYAYNFVNRYAYEALLANGGYNFADPSQNNDQARNSLRISTLRPAWYRTASFDATASTELGQLPAGPLGFAAGYQLRREMMNAGTSPEVASGAELRPALDLINGARTVQAAYGELNAPIVKNLSLSAAARADHYSDFGSAFSPKLGLRYQPLQSLTLRGTLSKGFRAPSLPEITHSTAVSYGSVQDPYDPITPNQSIGFTHLVVANPAIKPEHSTNANLGLVLSPTADSSIAIDYYRIRQKDVIGLEDIDNLVRNPGAYPGQIVRDSQGRLQTITQQFTNLGNRETTGFDLDLRQSWKLGGGRVTLAAQWSRLLSFRQPLQQGGALREGAGSNLLGALPRWKGQTSASWDSHDWSSTLTWFHTDGYTQAFSSGAGDQTRVGSANTFNLSASYKGIKRATLTAALQNLSNRRPPWDSHAGIYYDSSQYDPTGRTLTLGVQYKLD

SEQ ID NO: 6321 - protein, 42 aa, Chromobacterium substugae
MFMRVRRGCSDGAQASAGQARTADGWKDEAGEHGFHFWIQNT

SEQ ID NO: 6322 - protein, 82 aa, Chromobacterium substugae
MNILPAILLLIPALACAAPGASAPRGQARFGEMKAKLLQEHAQRIQILQASQSCIQAAQTPPALKACVETQRQQMEALRPPR

SEQ ID NO: 6323 - protein, 233 aa, Chromobacterium substugae
MAKFTNSHYATILTLFALLAAPPAQAGHSAEQAVRQQATQLIQQRLADAGLDQPGITLQLIPPRDLPACARPWQVEATDSRAFSRMRFSVACPDGDWRGDYIARASVSARVASAARDLPAGAPLQKEDISWSRRPVSEPADLFGQASTPLGLAPRAALSQGQLLRRKQLQAPQLVKRGDEVRIVARQDGIEVSNAGEALANGRMGEVIRVRNVGSGKVISARVSAGGEVEAQD

SEQ ID NO: 6324 - protein, 118 aa, Chromobacterium substugae
MGMHLDKALSIHPEALRLRAERTRVLASNLANENTPGYQARDIDFKAALASASADSPLALDDGGGDLLYRLPNHPSRDGNTVELGVEQAEFSQNVSEFQTSLTFINMKLHGLAKVIAG

SEQ ID NO: 6325 - protein, 134 aa, Chromobacterium substugae
MSFRDISRIAGSAMTAQTVRLNTVASNLANADTAAGTEQAAYRGRKPVFSSQMQGEGMGVQVLDVVQNQEPVRKAHEPGNPLADAGGNVFYSNVNAVEEMTDMLSASRAFQTNVEVLSKAKSMQQDLLKLGDNA

SEQ ID NO: 6326 - protein, 230 aa, Chromobacterium substugae
MSVDQAQAKPFAAGGNGQQAGGQGVAPAAGQGSGGNDMFMTLLLAQIRNQSPLDPADPSQFVSQLAQMSQMQSTQGMLSQLQSQGAMLRELQGVALGAQVGKNVLVQTDRIRSDGQGNLSGRVTLSGAEESATLTLVDAAGKRTNIALGKRPAGASDFSVKLSDYGLAAGDYQVEFATESKKAGLLELQAAVSGVRLPVNGGEPTITLAGLGDFPSSSISALLGKPGSSA

SEQ ID NO: 6327 - protein, 393 aa, Chromobacterium substugae
MSFEIALSGINAVNNQLGSISDNISNSGTYGFKSGRVTFASAYAGSQAMGVNANPNNQNIGRSGGVVTTGRALDAAIDGRGFFVSKSVAGAMAYSRVGIFNTDKDGYLVDNYGGRVQGYAKSDTGALGAMGDIQIPTGNIPAKPSDSLQYTGNMSAGWAVQTVPFDKTVSQSFNHSNVSTVYDSLGNKHNLTQYFCKSADSTVTVHYALDGNLLGTTTDLKFDTNGKLTAPTAAVNLGLGSPAGASALNVAVDYTGTTQFAGEPSTSRNATNGYAPGARTGVSLGENGEVIVSYSNDQKMTVAQLAIANFANENALTAGSQTSWQESAGSGAALYSVAGSSMAGKLATGSLEQSNVDVTAELVSLMTAQRNYQANTKVISAENQAMQALMQAV

SEQ ID NO: 6328 - protein, 243 aa, Chromobacterium substugae
MDALIYTAMSGADRMLKAQQIHANNLANAETGGFRADIDAATSQAVPGYGYDARLLSQNAPTVLDSRNGAVVETGRDLDIALQGDGFLAIAAPDGSEAYTRAGSMTVGADGVLSVNNRPVLGDGGAITLPEGFTKVSVAADGTVSVLNPGDTEMQPVDKIKLVKPEPNAVTKSADGLIVSRQGLPLPADASVSVQSGHLERSNVSAVEEMVATMTLNRNFEMQMKLFNAASDMNEAGNRLVRA

SEQ ID NO: 6329 - protein, 262 aa, Chromobacterium substugae
MNPALWISKTGIQAQDARLTAIANNLANVNTTGFKRDRMVFEDLFYQVDKQPGSKVDDNNISPSGVQLGNGTRLVGSQKVFTEGNLTTTGQSLDVAIVGQGFLQVKMSNGETGYTRAGQLQLNANGQLVNAQGLPLEPEITIPPTATKISISETGAVSVTEGGSGTPTNVGQITLANFINPTGLLALGDNLFQETAASGNPTTGNPGADALGKLKQGSLEGSNVQVVEEMVDMIAAQRTYEMNTKVLSAADNMLQQLGQAVR

SEQ ID NO: 6330 - protein, 217 aa, Chromobacterium substugae
MRLIRLAPLAALLLAACAQFQPAPPEADPLPDLLQQQAQTSRGGGVFTPAGALSLTSDNHAFRAGDVLTVVLEETTQASKQAGTSFGKKSGAKVGPTLLGNTTFNAQVGIDASRDFNGSSTSTQQNALAGSLTVVVHKVLANGLLQVKGEKQLALNQGEETLRLSGYVRVEDIDTDNRVSSLRIANARIGYSGTGALADANNAGWLMKFFASPLMPF

SEQ ID NO: 6331 - protein, 368 aa, Chromobacterium substugae
MKLGFFRRLLAVVVLAACAPLVCGQPLRQMVNVEGIRDNQLIGYGIVVGLDGTGDNSQVKFSGQSVANMLKQFGLKMPEKTDTRVKNVAAVMVSASLPPGYSRGQTIDVTVSSLGDAKSLRGGTLLLTQLKAANGEVYALAQGSVVIGGLSAQGKSGSSVTVNTPTAGRIPNGASIEREIPSDFEQGDSIRLSLRRPSFETASNVVKAINQSYGKIASTRNATTIEVKAPADPTERVAFVARLERLNVNVGAELPRVVFNSRTGTVVISEGVTVRPAAVSHGSLRVVISESSQVSQPGPFSNGDTKVVPNSNVNVEQGSGRMFKWPAGASLRAIIDAVNRTGATPDDIMAILQALDQAGAIDGELIVI

SEQ ID NO: 6332 - protein, 140 aa, Chromobacterium substugae
MLNNDLQNQNLPAGGDAPVAPASAEYRKKAEKAAEQFEAQFVREMFKQMRKTTREVAGEDSVFANSINGDMMDLADGALADQLAHQRIFGVANAILAQLLPADGNIAIKPPADAVASQQQGHDNGQGLAAFATPMFPLNK

SEQ ID NO: 6333 - protein, 455 aa, Chromobacterium substugae
MRMINNALSGAQAAQVALNTASQNIANQQTPGYSRQGVVLTTQAPGMGDPTSAGYGVAVGSVRRFSDDYRNLLQWQAASSLGEQSSAQPYFTQLEKVMGSDGSSLSSGFDKFFAALNAASLDSNTMRDQVVREAGSLAQRFNNLDGVLTSQLAAIAEQRRATLTQINSVTANLATLNDKLMSARAQGINTSGLEDERDRQIDALSSLVEVRVVAQPDGSKSVNLKNGLPLVAGDSAAVLDSEGQPDGTQQLKLVFGTEKYAIPGGDLGGQLGGLNQFESDNLRPIQTQVRTLAGELANRVNSQLAKGFDLNGQPGKPLFQYDAGAAHGLLQTTGIAAADLGFSADAAKPGNNDNLRAVLTIKQQTFPLAGIGQVTLGDAYSQMIGHLAISSQQNQSALDTANVIRAEAEKNWQSTSGVNRDEEAVNLIEYQKMYQANMKVISVANQLFESTLAIL

SEQ ID NO: 6334 - protein, 302 aa, Chromobacterium substugae
MRISSNQYRSTLQLAMQNTSSGMADLLQKMSSGKSMLAASENPIASVRLLRLQREEASLKQYRDNIGALKSQLSKNEALLDGISANLRDARDILVAAANQPPAEDLKAMAAPLTSLRDSILFAANTKDSEGRYMFSGSAINTATIAVDPSQPAGSRYSFAGNTDSQLVTVGEGVTQSSNVTLQPMAGLLNQLDKVIATLQSPTLDNKDPALGASIRGVMDGVDGALSEVSGRISELGGSQNVLQTLDDNHNSLSLANQQSILELGSLDYGTAYMDMNNLSMALQTSQKAYGKVSQLTLFDVI

SEQ ID NO: 6335 - protein, 345 aa, Chromobacterium substugae
MSSTLSSIKHAGADKRWGKDGAAIAPAASRAVAGGGRPALASAQPSASAAAGWRYSTQLNEQLTAAQCAQGFVDDMLRQLEDFKGNLSLQLTQRRVDDDGLAAQRDQLQQSWLQRQDDSAGSLDGQLRLSLGAPSRQLFSARGLDLDSLSQGQPETLVFSGGGGAPAGAVRVGDGVGREEVLRRLNQALGPASVRCELDNHGRLGFSCSEADWSRLRDSLAVRGGGVRFPGGVPQPLALDAEPPALAPAQWQVGDHAQVRQTLQGVLRAIAQLQQTRATIGNAIAEARQSISQLARQDEPSWADGFVSDFNARLNQGGDFGQLQQLLPALMGISRYRVLSLLSLR

SEQ ID NO: 6336 - protein, 404 aa, Chromobacterium substugae
MRSRCWPLALILSSTLARADFTIPGFELVHTAPQHAGLDTPDLRDPAVVWSELFDSARTQIVLEQFYAADQAGSKLTQVMDRLEAAGRRGVKIRFLMEKKGMFASEAATIARLQRIPNLEYRQLDYSQLTGNGIIHAKFIVADGKTAYVGSQNFDWRSLQHIHETGLKVDDAAMAGRMQAIFEQDWAAQETLATGGKVAPLRAAEQAADLSQPATLLASPNAYNPDGVGDSEEALPRLMAEAKREVRIQLLDYAPLSFGKPRQYYPLFDNAIRGALARGVKVKLMVSDWNLEKPGVDYLRSLAALPGMEVRYVTIPRDGACIPFARVIHSKTMAIDGQIAWVGTSNWSGGYMDKSRNLEVVLRNPAMAQRIATLHEQTWSSPLARSIEPGKAYTPPDKACRQAS

SEQ ID NO: 6337 - protein, 616 aa, Chromobacterium substugae
MCGIAGWISFERNVRDYREVIDNMTRTMRLRGPDAGGVWLDRHAALGHRRLSIIDLEGGSQPMLAEEDGKTLACLVYTGEVYNFQELRRELIALGHGFRTRSDTEVVLRAYLQWGEALTERLNGMYAFAIWDARAERLLLVRDRMGVKPLYYYPLPDGVLFGSEPKAILAHPEAKRVVKAEGLREMLDLVKTPEAAVFDGMREVRPGQTVTVDRAGLRKHRYWKLEAREHGDDLPATIRTVRELLDDIVERQIVADVPLCTLLSGGLDSSIITALAACSTARQGKGKVRSFSVDFIKHGVEFASDYLRSSPDAPFVRDLAAHAGTDHQEILLESRDLADPALRAAVLGAQDLPPAYWGDMLPSLYKLFEAIRAQSTVALSGESADEVFGGYRWFHDAAAVAADTFPWLSGATASFFDGQSLVSPDLLRQLDMAGFRRDSYAQALAEVPTLASDDAKEKRMREISHMHLTRFVQGLLDRKDRMSMAVGLEVRVPFCDHRLVEYVFNAPWRMKNFDGREKSLLRAAGKDVLPDSIVQRVKSPYPATQDPAYEQALRQGLARVLDDAAAPALPLLDRAAAWKLLDRPFGKTSSAPERAGLEMALGLNEWLRHHRVVLDL

SEQ ID NO: 6338 - protein, 297 aa, Chromobacterium substugae
MTIYGQQEIIKDLIAARLKTEFPLLFDAADVQIHDTDGFSPYVSFSHGGEQQTLECDFIVGCDGFHGICRPHISDSLTQFSYNYPFTWLAVLAEMSPISPDVIFSSHETGLALFTMRSPNVSRIYLQCSPDEDPNEWSGSRIWDLLQLRLEGRPEKVNGGAIIEKSIVQLRSFVAEKMQKGRLFLAGDAAHIVPPSAAKGLNLAVSDANILARAFEQHYGKGKEDLLLSYSDIALKQIWRDVQFSHWMAMLLHRFDDNSHFHRRLQIAELDRVLGSGPAAQSFAELWVGNPPFAASI

SEQ ID NO: 6339 - protein, 638 aa, Chromobacterium substugae
MTTTFPFQEDECFFLMRRKNEPTVLACTGKVERFRHLADIPMKSGLADSHTFDSVNLIPFAQARERGFPVHDDGEPIVSLQIENSQYFPLSQFVEMLPNEQVDISNISFTTDQAEYEAIIRNIINCEIGTGQGANFVIARECVAHIGNAELSGILSIFRSLLLNEFGAYWTFAFYDGEHYYLGASPERHISASCGEVMMNPISGTYRKNSAYEVAESEKDFLEFLQDEKEIFELFMVCDEELKIMSEICDQGGSVIGPMLKEMSRLIHTEYLLVGKTDKSIIDLLRRSMFAPTVTGSPVLSAFRVIHRYEKQSRGYYGATIALVGRNKDGSATLDAPILIRTLQIDRAGKAVARVGATLVRGSNPMHEVWETETKIAGLFNAVRNAGKSPAPPERLLDKMDHEQIQRLLQSRNAYLSRFWFESQDADFGTEPSLRGKSVTIVDAEDDFSVMLKRLLEQLEMQVSLVSFADYNPQLHQSDLLVAGPGPGNPLDSQDGKMMRLRNIIAARLESGQAMLCVCLSHQILCDILGFPVITKAVPLQGTQQVIDLFGTQQRVGFYNTYVGLATQTLEQVRVASDEESREIHALQGERFFSVQFHPESILTPHGFELTRKILSRLLLTRQFEDRERPVLIGDAVL

SEQ ID NO: 6340 - protein, 185 aa, Chromobacterium substugae
MRLMGLEHEHRQISVFRNVDEFRAINPAVKAPTLICDDGEMIMDSSMIIDYLESRVDPSRSLMPKDSKQHRKVLSLIGLGLTVCEKAVQLEYEHNKPGEYQYAPWLSRITEQLHAALALLEEAAAQANPWLATAQLSQADVTVAAAWRFTQFRVSHLVDVQTYTALAAYADQVELLPEFVDTPLK

SEQ ID NO: 6341 - protein, 147 aa, Chromobacterium substugae
MEVDAKSWAILAALQDNARQSLTELAQAVGLSVPAVSERVKRLEEAGVIGGYHARVAPLRAGYALSAWVGITVPQPDKKTLLARLEAMPEVMECHHVTGVDSYVFRLLARDVGHLEQLVSQLNDLGETRTSIILSTPLQGRPVRPPR

SEQ ID NO: 6342 - protein, 202 aa, Chromobacterium substugae
MFWQAALIGLAIAAPMGPIGLLCVSRTLRGGPRLGLATGLGAASADGLFAMAGVAGSGAALHLAGALARPLAWGGCLLLAWLGVATLRRPESQPAVREEGRVGLRRAYAGALLLTLSNPMTILSFAAVAAGLSGGLAASGAQQLAIVAGVFCGSAAWWLILAYGGGALLARLGARGRRLLDAGCGLLLLGFAVLLAWRAAGG

SEQ ID NO: 6343 - protein, 693 aa, Chromobacterium substugae
MSHAQQQWGRLSTRIILVAAGAITVAFAAMIALIAHLNYKSAIDTGYQLASEQAGSYAKDAENTLSQGFLLPRHLADAVVGIKRGGKADRKQTDNIILQMLDHAPQSIGLWMLWEPNAFDGDDNPYRLDWPRHDPTGRYQPYITRNAQGKAQMDVMMSADRIKDFPKFKDHPQTYQPDYEKPGWGDFYYVPKQRGRDTITEPYPYEVQGKKVLESSLAVVMKDDAGKMLGVSATDVALDQLQKSFGQIRLYQTGYIRILSEGGVYVVHPQADQLGKNVGKDDALAGHLADIKKGEDFVYEDGGFTHFFHPIAIGDTGQFWTLGISVPTAALTDGARREMLTAIAIGAVALALILLLLAIVIRTQTRPLQHLAETMEQLASGGGDLTSRIAIANRDEIGRTASAFNRLLDSLRDMFVNVREQSRQVSDAAARLSHSAGQVHDASAQQSDAATASAASVEQVTVGAQHIASTAQQAGDIARETGAMTEQSVAKVNRVTSEIQRMTDSMHELAERMSGLGERSNEVTTIVGVIKDIADQTNLLALNAAIEAARAGELGRGFAVVADEVRNLAGRTAEATVQITRIVEAISSETRQAVGDVQRSSQQVDLSVGIAEEANQAMREVQGYNQQLVTSIVDIAAATREQSSASLEIAQNVERISSMAQNNNQVVSEVSQAVKQLRELSGGLEQLVSHFKL

SEQ ID NO: 6344 - protein, 52 aa, Chromobacterium substugae
MLLRVTHGDYLRGCWLIRVLHETGLIRINSYLKRIYRHPARAGNDLRQWRSG

SEQ ID NO: 6345 - protein, 338 aa, Chromobacterium substugae
MTQRQDPPDSQEPAAGDAPAAAAKPRRQSARSRNVARAHDESVHIIQETSQQPVALQVALAPHGSDEDSGSAELPASYPYSSRMRRAEYERLKQELQIELLKVQSWVKESGQKIVILFEGRDAAGKGGTIKRYMEHLNPRGARVVALEKPSDQERGQWYFQRYIAHLPSAGEIVFFDRSWYNRAGVERVMGFCNAHQYLEFMRQTPQLERMLVNSGIKLFKFWFSVSREEQLRRFISRRDDPLKHWKLSPIDIQSLDKWDDYTAAKQAMFFHTHTGDAPWTVVKSDDKKRARLGCIRHFLSRLDYPGKDPRVARAPDPLIVGEPGDMSYQEEQDVLTF

SEQ ID NO: 6346 - protein, 233 aa, Chromobacterium substugae
MWSVQMRQVRKHYRLDQVTVPALQDVELAVRPACFTVLSGPSGSGKTTLLNLIGGVDQPDSGEILVAGQDIARLGDDALSDFRARHIGFIFQNFNLLPVLSAYENVEYPLLLAKVPAAERKARALAMLDAVGLADKAGNRPGQLSGGQRQRVAIARALAHRPSLVLADEPTANLDSQTGASILALLRGLQQQYQLTVVFSSHDPQVIAAADDHYQVRDGRVSHAPAISRKEPA

SEQ ID NO: 6347 - protein, 458 aa, Chromobacterium substugae
MNTLKLAWRNLLRNRRRTLATLGTMVVGVVALLLFGGYNRTVQYGLQTSFVRGGGHLQIQHRDYFLYGNGNPAAYGIRDYRRVMRVVENDPVLKPMLIAATPTLSLGGIAGHYAAGASRTVIAQGSEVTGQNLMRRWDDYHFGDKPKTVALTGSAPDAAVIGVGVARVLQLCDALKVKGCAAPAKAESGGTAMPADLQALSDAAPQAAADNRIELLAATAAGAPNVARLTVVKAQSMGVKELDDMFVSMHLSAAQRLVYGGGEPRVTAIALQLQHTRQIPAAQARLRQLFATSLKDQPLAAYDFATLQPQYGQITGMFGTIFGFLSILIGCVALFTIANTMNMVVLERTVEIGTLRAMGLRRGGIQRLFLCEGVMLGMLGSAAGIALALLLAQLINHAGLTWLPPGQVDPSPILVRLWGETGMMLATALGLMLMATISAWWPARRAARAVIVDALRHA

SEQ ID NO: 6348 - protein, 254 aa, Chromobacterium substugae
MKNMWMAALALLAGLAQAAPDAQTILANSDAVRNPDKSFGLIVSLVSYKDGKENERSALAVYSRADPRSGQFRSLLRFVNPARDAGKLMLKNGNDLWFYDPASKASVPISPQQRLLGQASNGDVVTVNLALDYQAALAGEEDIQDGDRQTRHCYKLRLSARNPGVTYHAIELWVDTAGYRSRKARFFAESGGLLKTAYYRAYQPVLGQQRPTETVIIDGLNPKWVTVLRNSDFAWREVPEAWLQRDYLPRFRAE

SEQ ID NO: 6349 - protein, 404 aa, Chromobacterium substugae
MRLSMLALAGLLCGPAWADDDAAALQLADQASLPAEKPRDLKLLLEAAAIASPGGQRLSVDLRWDGRLGPQWRAVFADRLDQDFADSPQRGHGVNTLKEAYLSHEFDAATMLDAGRINTRYGVGVGYNPTDFLGVGTVRSVVSADQASLRENRLGNAMLRWQRLWDNASLTAIWSPKLADGPSGHGMSLDFGASNPRERALLAYSYRFSEALNPQWLLLQEQGRSPQLGFNLSRVLGDATVAYVEWAGGRQAPDWRRWQGEADDSWNNRLASGLTWTGSNKLSLTLEGEYDGGAPGLDDWRRLARSPFYRLYRMQMATGGVLPARCAALARASWQDALLDNLDLTAMRAASLDDHSGMNWAEARYHLGPVDLALQWQRFDGGALSQYGAGLAKPSWQLVFDYFH

SEQ ID NO: 6350 - protein, 340 aa, Chromobacterium substugae
MNASRRWSDEARELAVCSAINLAIGLFFAALGGWKMVYDNLLISFCIGYCCWLTGTLLGGWLQLNRIAVCLAVLLFSVPFGFKLATWLGAFDVLARAFRVPERAYLFLLPTFLVATGAMTVSMLYYRSRALAGELEATRRREAESRAAQTAAQLAMLQAQIEPHFLFNTLANVQSLIELDPPRASEMLRHLNTYLRASLERSRNADGTLGQELELVSALLDIAAIRMGARLRVRMEVDDALKALPLPPLLLQPLVENALRHGLEPSVAGGELAVFARRESGVLRLGVSDSGVGIAEFAPAGVGLANIRERLAALYGPAAQLRLTPRQPSGVLAELLLPIA

SEQ ID NO: 6351 - protein, 240 aa, Chromobacterium substugae
MPTALIADDEPLLAAALQSALNRLWPQLDIVAIAQDGAAALAAISRLRPDFAFLDIRMPGVDGMAVARSVSGCKVVFVTAYEQFALQAFEAEAAGYLLKPLDDARLLRCIARLQAGHQAPAPALPAARAEAEGWLNWITAGLGNSKRLVSVDEVLYFKASDKYTELALAGESLLIRTPLKELAARLDPERFAQIHRGLIVRLAAVRGIEQDLLGRSTVLLKHGGGSLPLSRSFAARFKAM

SEQ ID NO: 6352 - protein, 62 aa, Chromobacterium substugae
MKELAARLDPERFAQIHRGLIVRLAAVRGIEQDLLGRSTVLLKHGGGSLPLSRSFAARFKAM

SEQ ID NO: 6353 - protein, 95 aa, Chromobacterium substugae
MSCRGVFRYGDQVCEVGPGDCLCCPAGTGVAHQLANPFDEDLVYLGVGANHPHEVCFYPDSGKTLVRSLHRVGYLHEAPHMDGEPERPKIFELLK

SEQ ID NO: 6354 - protein, 555 aa, Chromobacterium substugae
MASPAFRPRLLDSLKHYNSQLLRADLMAGVTVGIVALPLAMAFAIASGVTPQAGICTAVIAGLLAAALGGTRLCVTGPTGAFIVILYGIVSKYGVANLLVCTFMAGAMLVLMGVFRLGQVIRFFPMPLITGFTNGIAVLIFLTQMKDFFGLPIARMPSGFFNVVLALRGHFSALHWPTTLLSAALLALILAWPKRLNRILPSPFAALVLATAATAAFGLPVATLGSRFGGIPQGLPAFAGLDLSPAHLSDLMAPAFTIALLGAIESLLCAVVVDSLTADRHDANQELIGQGIANMVVPFFGGIPATGAVVRSVTNIGNGARTPLAAIFHALLLLAVLLLAAPLAAHVPLAALAAILVAVALKMGDWDIRKAWRFPRHDTAVLILTFVLTVIFDLTVAVEIGLLLAAVFFIRSMASHTSIKQLKPEYAQLFERHTIAGKVVPDGCAAFRVEGALFFGAADAVDVVLKQAPHERVVILQLHRLVLLDASGLLALDALRERLAEQGKTLILCGAADEVMDMLVGSRLAERLGADNLQPDLVCALARAERQLTDGVVWG

SEQ ID NO: 6355 - protein, 251 aa, Chromobacterium substugae
MAAIIRSTRVMPAKLDAAQKEQLAAELFQVHDAIFSGTDYPTFKGLVFSPPAEHSCLLLHRDENQRLVGYCAMHRFRRQIGRRACSVLRVQSGLFKEYRGKNSNFAFMVRQVLLHWLSHPLRPMYFFGVMLHPSSYAVLHKFAHKLWPAPGQDERHPLAAKAYELFSSFQLTPVSPDRPFIANLGILTRDSKDDHQFWQSSSKPSTRFFLSMNPGYSQGDGLMALVPLSPVSVAHALYRWLRLRREKSAGK

SEQ ID NO: 6356 - protein, 308 aa, Chromobacterium substugae
MILVHTPNPKEVAAYLELFRAAMPEQRFGSLADIQPDTVRYLIAWGIPDGLIASLPKLEALFALGAGVDKLLSRPDLPESLPVYRLLDGGMAAQMIEYIRYGVLGYQRNMDIYRRQQAAGQWRMLAPKPPEDVHVGILGLGEIGAAVAKALAHDGYMVSGWSRNPKHIHGVHSLHGESGLEKLLETSQVVACVLPSTPQTQGLLNGERLSLMPAGSMLINAGRGDLLDQDALLALLDNGHLRCAQLDVFAEEPLPAGHPLWRHPAVAITPHIAAITLRQEAVEQIVGKLQQLARGVEADGLVQRQQGY

SEQ ID NO: 6357 - protein, 256 aa, Chromobacterium substugae
MHFIFDIDGTLCFDGANISPAIQDALSELEGQGHSIGFASARPYRDMLHLLDERFHHGLFVGSNGAMTWHGGALADIAPLAADTLQQLLDLAERHSASYLVDLAWHYHYQGEPGHPFMTLVDPQRRARQVARDEIHQPVKLLVTECADSDALQQALRGRDDIHIHHHSDQQIVDITAAGVDKMSALSRHGIAAEQLVCFGNDSNDLPMFRAARHSVLIGAHPQLLPHASERLARGDDVETLLIGTMRRLGERYAAR

SEQ ID NO: 6358 - protein, 526 aa, Chromobacterium substugae
MAVNGGFPIALRPQSAFAAVRVAAPAGAPSNPSGAAPLLDIKGLEVGTPESRYGFSMQTLQLLKQYDVRDMSGKDLDALSELMLARGEMDGDVSGTIRSDIQGHGWKTAGSSNALEIFSARRDETMASVKAGEVSLKLADFDLKGNARVTEALNKLAGIHDALQHDDSVTAAAEGGMSQAADIQRFDSWLRQTTRWRELGEAEPQPDAETIDAVGRVLQRLGISLAGEGNSAERMAQAWQAYQGWQAQHPGEQPRMDLQPPAETPAEPPRAAPAAAAVASTPAAAAKPAREAAPRFLLEAQYGMSLPMLQVLKSFDVANASVEQVKQLGRLLQDNGELSQDDADSLLPLTQRGTADSMNYYRRDLRWLADSQQHGETPQYRTPQGLVDLASPAGRARNDQQAQAVLDRLAALHQALQGDDRVQEAVDGGLQQGSDLAAFNAWAQAEGKGARSGDDAQPAFRNRQDVDGIFRTLQRLGVELTPQDGAVSPGQRLEQAWKDYQGWRASHPDAQPGLRLAPARRINDYA

SEQ ID NO: 6359 - protein, 399 aa, Chromobacterium substugae
MIGADMRYLLGERSLRSLSALPGRRAAAGILASDVEGPLFLGDFIAEALSARVRPRHYAVDATPSYGHLLYQEGYAAFSEATAGLRRPHCRNGCAQEGTDTIFALPMLLACGADAGYLDLLARRSAPTPGAARMLAELDRMGMMAVGITTAPQQPYRNLVAASGLLPRERILGSPFPLNEAAELLRGHRRWDEEIGAVNRYLDDAFAIIDGYSEIYRGVDGQIRRLSDCGRQLLQARFIRHCRDELGISHDPATRRRRTAPTLLGEIIEACAMMGDRSKAATALNLGRSLRGGQPLVAMGDGGNDAEMLRRVPLSIGVNGPEAASAAKIGVVTADMACVLPILRQMLLGERDIDAIIVRAQAEVGDAALIHRGGGRLAPALLARHREMKRQLRGAFVTF

SEQ ID NO: 6360 - protein, 273 aa, Chromobacterium substugae
MLLGVLSGLLSMVCVQLGSAWSVPAMREQGPYALTWLRLCCAALALLAWARPPLWRLLRAHGGQLAALGAAMAGMMLCFFAAIRSMPLGLTVAINFLGPLLVALAGAGRRLALAWPPLAFLGVGLLAWHGGQWQGDAAGLAFACGAAVCWGAYILLMKRVGRLGGGLDGLAASMLMAALWCAPFGLAGLHGRPLPDLPQTAVLALLTPLLPYVLEMLALRRMPAASFGILASLEPAIAVLAGWLLLAQPVAPAQLLGVAMVVGASLGSLLTAR

SEQ ID NO: 6361 - protein, 448 aa, Chromobacterium substugae
MAATLKLSQLISALSYALDITEGQPEGHCLRSCWIGMHIGRAIGLEEQALWELYYTILLKDLGCSSNAARISELYLADDRRFKQAFKQVGASLPQMLNFVFSQTGTHADGWRRRAASIFNVLLRGKEMADELINTRCHRGADIARQLRFNEGVAMGIQCLDEHWDGSGRPRGLQGDGIPLNARIALLSQVTDVLHATHGRAAALDEATGRAGGWFDPELARALAGIGRDEAFWRQLEADDVEQAVLALEPSQCEVPLDEDYLDEIAEGFGLVVDSKSPFTAGHSLRVGHYADRIAERMGVAPERRRWLKRGALLHDVGKLGVSNTILDKPGKLTPEEWEAVKRHAGYTEAILSRIDSFGELALMAGAHHERLDGGGYPRGLKADAIALETRVITTADIFDAINAERPYHPATPIAETLDIMRRSLGSAIDPACFSALEQVLRLEGVAA

SEQ ID NO: 6362 - protein, 168 aa, Chromobacterium substugae
MSAAITLDFLTDHDFDTVAALGAEIWRKHFIMMITREQIDYMVSSRYTPEKLSRYLDAPDRWFRLLRVGGRPSGYCSYALSGRPGEMKLEQLYLLEEMRGRGLGGRMMDEAEAAAGTQGCATLMLTVNRHNADAIAVYEKRGFTVREEVVADIGNGFVMDDYVMVKNL

SEQ ID NO: 6363 - protein, 541 aa, Chromobacterium substugae
MGGFLPRPALAMTADAASQRKIQEPGGAKLRYRHAMRSRRQPTAHHKDSAMIRIAFDHSYARDLPGAYEPALPDAPPAPALLYWNAPLAAELGLDAADASAAELAAAFSGAALPAGAQAIAQAYAGHQFGGLSPSLGDGRAMLLGEVIDHNGQRRDIALKGSGRTAFSRRGDGKAAVGPMLRELIIGEAMQALGIPTTRALAVAATGETVHRERPLPGAVLTRVAASHLRVGTFQYFAIRGETDMLRKLADYAIARHYPELAGRDDRYLALLAAAAERQAALIARWMHAGFIHGVMNTDNMALSGETIDYGPCAFMDAHHPDTVFSSIDRNGRYAYGNQPAIAQWNLARFAETLLPLISPADPGGAVPAATEIIEGFANRYQSIWLEQARRKLGLPDAQNGDLALIEDWLTLLAAQGVDHTLAWRYLADAAEGQRAPLAALFPAPQELEPWLLQWLTRLAIKTRRASDVAAAMRKQNPLYIPRNHLVEEALDAASERGDMEPALRLLEVLRDPFTEREGLMRYALPAAPEVAEGYRTFCGT

SEQ ID NO: 6364 - protein, 752 aa, Chromobacterium substugae
MTTPQAAAKPIDSYRKYWASRFGTAPFLPMTRAEMDQLGWDSCDIILVTGDCYIDHPSFGMALVGRLLEAQGFRVGIIAQPDWHSADAFRELGKPNLFFGVTAGNMDSMINRYTADRRARSDDAYTPNAEPNKRPDRAVTVYAQRCREAYPGIGVMIGSIEASLRRIAHFDYWSDKVRPSVLVNSKADILLYGNAERALVEISHRAAKGEKLSEMRDIRGTAFIVPHGWRPDDEWQEMDSSVVDVPGRVDPHLNPYQEIPEQAAEATKDIDPSKPQVIRIESREERLAKRRAERAKTVIRIPAYEAVAHDPVLYAHASRTLHLESNPGNARALVQMHGERDVWLTPPPIPLTTEEMDFVYGLPYARNPHPAYGDAHIPAWEMIKYSVNIMRGCFGGCTFCSITEHEGRIIQSRSEESILHEIEEIRDKTPGFTGHISDLGGPTANMYRLSCKDPKIESSCRKLSCVFPDICENLNTDHSHLIQLYRKARALPGVKKINIQSGLRYDLAVRSPEYIKELVQHHVGGYLKIAPEHTEDGPLSKMMKPGMGAYDKFKELFERFSRQAGKEQYLIPYFIAAHPGTSDEDMMNLALWLKKNNFRLDQVQTFTPTPMAMATTMWHTRRNPLKRLSRSSEKVDVVRDGYRRKLHKAFLRYHHPDNWQILHDALIQMGRSDLIGHSKHCLIPPTPPGDKAAAVRHRMGAPAARGKAPGQRAAGNAPQRGKPAVGARPQSGKPATAKSGGGKPGGKTSRSR

SEQ ID NO: 6365 - protein, 283 aa, Chromobacterium substugae
MGERIVSVAAGERDLVRKLEAGAVLHVPDFGFTLSPAEQALLNPALSDPKRKNISLEPNNGALHGVLGGDETQAAVRALISRYQQAAAGLLARVLPEYQGKTRAAPTSLRLVRVEDRKTSWRKDDSRLHVDAFPSRPTYGERILRVFCNVNPAGEPRVWRVGEPFEDMAKKMLPRVPAQWPGSAALLAALKITKRKRSGYDHIMLHLHDAMKADLEYQRSCPQETVPFAPGGAWICFSDHASHAVMSGQFMLEQTLWLPLDKMDDPAKSPLRQLERIVGRALA

SEQ ID NO: 6366 - protein, 53 aa, Chromobacterium substugae
MSIKDVDASHNENLRINLYANGIDNNGFNANFETWSDSAIYSLVASFVVVGDA

SEQ ID NO: 6367 - protein, 561 aa, Chromobacterium substugae
MSTENNAPVVNNFIRTIIDQDLASGKHSSIVTRFPPEPNGFAHIGHAKAICINFGLAEDYKGKCNLRMDDTNPEKESPEYVQSFIDDISWMGFKWDGDVRFASDYFDRLYGYAVELIQAGKAYVDDLSAEEMRQYRGSLTEPGKNSPYRDRSVEENLDLFARMKNGEFPDGSKTLRLKIDMASGNINLRDPAIYRIRRVHHHRTGDKWCIYPMYDYTHCISDAIEGITHSLCTLEFEDHRPLYDWVLDNISIGCHPRQYESSRLELLYTLTSKRKLLALVNEGVVTGWDDPRMPTIAGMRRRGYSPEGIRLFAQRIGVSKGENIIDMSVLEGAVRETLENESPRVMAVVKPLKVTLTNYDAAVTASRSAPFHPHHPEFGEREVPISREIWIEQDDFAEVPPPKWQRLTAGGEVRLRYSYVIKCEEVVKDAAGNVVELKCSIDHDTLGKNPEGRKVKGVIHWVSAEHAIQADVRWYDRLFTEPRPDAVRGEDGEYVDFRQFINPESLTLVPAYVEASVLQAAPESRFQFERLGYFVTDRKEHQPGVKAVFNRTVGLKDSWSK

SEQ ID NO: 6368 - protein, 548 aa, Chromobacterium substugae
MRVSPGSILLSLLAAGLLSACAAAPGKGGYVAGKTYKITILHTNDHHGRFWPNADGEYGLAAQKTVVDQVRAEVKAEGGYTLLLSGGDVNTGVPESDLQDAEPDFRAMDRIGYDAMAVGNHEFDKPLPVLMKQRGWIHFPMLSANIYQDGKRMFDPYAMFNLGGVKVAVLGLTTDDTAKMVNPAQIRGIEFKSPIAEAGQLVPALRKQADIVIAATHMGHYADGKHGVNAPGDVEMARAVKGLDLIVGGHSQNPVCMKAENVRDDAYMPGAPCAPDRQNGAWIVQAHEWGKYVGRADFEFHNGNLKLVKYRLIPVNLKKTMVDADGKAQKTLYEARIPEDGKLRSFLKNYQDRGQTELDVKVGELSARLEGDRAAVRSRPTSLGVLVGRAMMAKTHADFAVLNSGGIRDSLPAGAVSYRDVLKVFPFGSTVAYVDLPGSEALGYLRAAAKMTPGAGAFAQFAGVKLRIVGGELREAKVAGAAIDPARTYRVAINSFMAAGGDGYPKMAGHPGYVNTGFVDAEMLKAYLASHAPVQAGAYAPSGDVTRE

SEQ ID NO: 6369 - protein, 114 aa, Chromobacterium substugae
MAQQGVFTLPARINFGATVLTNAANVQNVAILVDNEVRATFSGSGITDKNLGTQVVNSGTGNVRVTVTVNGKASDLVSTQVILANKVNLALLGSEDGTDADYNDAIVLLNWPLG

SEQ ID NO: 6370 - protein, 451 aa, Chromobacterium substugae
MPPVKESRFAADARLEAAFPQVVCWWCQRRRYACAALSVHSFQVAIMSKLRAVYLQSGGPTAVLNASAQGAIETARRLGLSLYAAFDGLAGLLDGRLCDTDGVPDTAIAQLAFMPGGSFGVSRRMIGTFEEAPEDWLRLRDVLARHDIHYLLINGGNGSLGCAERLVDFEKHTGYKLGVIGVPKTIDNDLMGTDNSPGYGSSAKFLASAMREVGLDMTSMGWGRVFIMETMGRHTGWLAAACAAAARAPNEAPHLLLLPEVPFEPARFLAALDASLAKYGQCAIAVAEGITGQDGRFVAEAKQSETYGHEQLGGAGHWLAQLILRERGISAHVAQVDYLQRAGGHLASNTDVRQAYLMGERAVEWLLAGKTGLMAGIRRLNDHPYCWDVAEVPLSEVGDKEKRLPPAFIGADGFSVTPAFLDYVKPLMEGERIPPFKDGLPDYRPIAWPKV

SEQ ID NO: 6371 - protein, 459 aa, Chromobacterium substugae
MIMLSLYNTLTRQKEAFKPIEPGKVSMYVCGMTVYDLCHIGHARMLAAFDVIYRWLKASGYEVDYVRNITDIEDKIIKRALERGITPEQLVEETIADMHQDAAALGLLPPTHEPRATHHVGGMIALIEQLIANGKAYPAANGDVYYAVREFEGYGKLSGRTLDKLRAGERVEVDPNKRDPLDFVLWKAAKPGEPSWDSPWGKGRPGWHIECSVMSCHHLGEHFDIHGGGEDLQFPHHENEIAQSEGAHGHQYVNYWLHNGFINVDGEKMSKSLGNFFTIRDVLQHFDGEVIRFFIVRSHYRSPVNYTDGILNDAKHGLTRLYTALRGIELPAASGIDWNNAYAARFKKAMDDDFNSSEAVAVLFELAGEVNKSHDPQQARLLKDLAGVLGLLGRDPEAFLKGGVGEGELSAEQVEALIQARKDARAAKNWAESDRIRDELTAKGIVLEDGAAGTSWRRA

SEQ ID NO: 6372 - protein, 71 aa, Chromobacterium substugae
MKTDIHPNYKELSVTCSCGSQFVTKSTMAKDSFGIEVCSNCHPFYTGKQKIVDTAGRVDKFNQKFGGFFKR

SEQ ID NO: 6373 - protein, 549 aa, Chromobacterium substugae
MLTYSAQASSLAKPTEKPWVLLLLCFIWLWPGILGHDPWKPDEPFVLAAAQGMLHTGNWLLPTLQGAPYLDNPPLYYWLAAGLIRLFSPWLLPAHDAARLATPLLMSLSLLLAGMAGRELIGRRHGRSVVMILIGCIGLVESGHQLTPMIAGFAGFAAAFYALALALRSPGLAGAMLAASSVAIFLGGSLADLLLIWLAALLLPAFSGWRNRQYAITLLLALLLAVPAILVWPMLLLRDSPALFADWWGNYALGQTSGFHRLRLFHDFGYYSLNALWFAFPAWPLALWTLHRNRYLQSPKLQLPLLFSVVIALGLTLSDRANITDAMPLLLPLAVLAAVELDSLRRGAAAFLNWFALMTCGLFGLLVWLGWAAMNYGWPERLAGRAQYFSPFYQPHVSWWQAGGALAATLAWLWALTRPHLRGRQAITNWAAGLTLLWGLGMTLWLPWFDAAKSYRPVVAAMEAKLPADARCVATESRNRLAQISWRYYAGMDLVSFPAGETPPCDYWLIVRDKSEGMAEPGWQVLWVGHRPREQNMTFALLRRLPTAQ

SEQ ID NO: 6374 - protein, 70 aa, Chromobacterium substugae
MQAASPKALATHQRGGWRRISHDADAMKKALSICLADPGAQCWRYAVDDKTVWQGMVNKRISRIPLLAHP

SEQ ID NO: 6375 - protein, 281 aa, Chromobacterium substugae
MSRHQQSWGIEQWAAYLKDKDIPVLSATRDSFQALKSQGNDAPEFSPRELVDMVHDDPYLALKLLIEAERHRSRRLGKETTTQLGAILQLGSDELYSLISRSPVVAVNHPGWKAAVATAVLASGIARAWSNFRSDTSPEEISLATLLSETGELLLWHFAPELPAQAIAEFEAGRANRTGLAQLNTAGFTFRQLTLALADIWQLPQMISQLIRGVDRPRTHIAQIAIDCARHLMQNPDNPALPSDIGNISQYIPGVAKEKLVSVLPISETQQAHILAGLQME

SEQ ID NO: 6376 - protein, 653 aa, Chromobacterium substugae
MQASHHPIWTPSAGRLAGCHLTAFARLAQTAWNKPLPDYHSLWQASVDDPGRFWSLVWDYCGVIGDKGGVALAGEDDMLTARFFPEARLNYAENLLRRDDDALAVVFRGEDKVERQLSWHELNQLVSRLQQAMRAAGITAGDRVAGFMPNMPETLAAMLAASSIGAVWTSGSPDFGTDGALDRFGQTEPKILFCPDGYWYNGKQVDIRAKMIHLAEHLPSVRRIVVVPYLGDGKTFAAAVPRAETLDAFLAPHPARAVEFVRLPFNHPLYILYSSGTTGKPKCIVHGAGGTLLQHLKEQQLHADLHRGDHFFYFTTCGWMMWNWLVSGLASGATLMLFDGSPFADDGRVLWDYAAEHGFTHFGTSAKYIDSLRKTDIVPARDWQLPNLRALFSTGSPLVAESYDWVYENIKADLNLASISGGTDIVSCFALGAPTLPVYRGELQCRGLGMAVDIYDEQGRPVSQEKGELVCTRPFPSMPIGFWNDDSGEKYRQAYFGRFAGIWCHGDYAELTAHNGVVIYGRSDAVLNPGGVRIGTAEIYRQVEVFPEILESLAVGQSWQDDERVVLFVKLRDGAALDEDLTARIKAQIKNGASPRHVPARIVAVADIPKTVSGKIVELAVKNVIHGRPVSNVSALANPEALKLFENLGELAE

SEQ ID NO: 6377 - protein, 294 aa, Chromobacterium substugae
MKIVEVGPRDGLQNEKQLVPLAVKLELIRRLADAGLSAIEAGAFVSPKWVPQMADSAEVLKALDLGGAVAYPVLVPNDQGLDAALEAGAREIAVFGAASESFSRKNINASIAESLQRFESVMRRAQAEKLRVRGYVSCVVGCPYEGPIAPAKVAEVTQTLLDMGCYEVSLGDTIGVGTPASVHQMLDAVLKTAPAARLAGHFHDTYGMAIANIREALNAGIRVFDASVAGLGGCPYAKGASGNVASEDVAYLLRGEGYHTGIDLTKLVAAAWHVSDALGKPPASKLAHALGRQA

SEQ ID NO: 6378 - protein, 177 aa, Chromobacterium substugae
MEAAIIDCPGLALAGHSIATRKADGDNLRDIPAFWADYAARLRQPLLDALRLPHAAEYGVVYDFDPAGGGFRYLIAIECPDAAALPPGVERRRLPPARYAVFTTPPAAGPAEFGQRIAQTWQRIYQDWLPASADWQHAPGDVFERYDGRCAPGQTRLQMDIYLPIQPKLRQGKPCNT

SEQ ID NO: 6379 - protein, 160 aa, Chromobacterium substugae
MHIALEKIQQLRARGEHDAARKQALELLQHQPQHADLHYLTACIHDGMGLEAAAIPHYQQALELGLSGDNAAHAWLGLGSSLRALGQYADAEAALRHGLQHFPDNSALQAFLAMALYNRGQHKEATQSLLQLLAGTSGDAGIQNHRQTLRFYAEDLDRAW

SEQ ID NO: 6380 - protein, 651 aa, Chromobacterium substugae
MFNKILIANRGEIACRVIKTAKALGIATVAVYSDADANARFVKLADEAYRLGPAPAAESYLRADRILAIARQSGAQAVHPGYGFLSENEDFAAACEAAGIAFIGPPASAIAAMGSKSAAKALMEKAGVPLVPGYHGDDQDPALLQNQADAIGYPVLIKASSGGGGKGMRIVEKSADFSASLASCQREARASFGDDKVLVEKYLTRPRHVEIQVFADTLGGCVYLFERDCSVQRRHQKVLEEAPAPHLPQATREAMGEAAVAAARAVGYVGAGTVEFIMDVDTGKFYFMEMNTRLQVEHPVTEMITGQDLVAWQLAVAAGGALPLKQEQLAIRGHAIEARIYAEDPDKGFLPSTGTLVHLATPAESANVRIDTGVEQGDAISPFYDPMIAKLIVWGETREAALRQMDAALAQYQIVGLSSNVSFLRRIVNHPSFAGGHVDTGLIARHHDELLPPPAAPTARQLALLALAEALADQPTYPAPAGWRLNGEQTRRFSFRQDEEEHAATLRHAANAYAVAANGQTFAARASLQGQQLRATLDGAAIHATVARHGAQRVLFANGERLALDWVDPYAYAELGVHGETHLKAPMPGRVVALLAEIGKKVAKGSPLLILEAMKMEHTITAPGDGVVQDFYFAAGEQVNDGDELVDFAAE

SEQ ID NO: 6381 - protein, 262 aa, Chromobacterium substugae
MSHTTLQIEQAGKVATVWLNRPELHNALNEVLIAELTEAMRQLNRKQDVRVIVLAGRGKSFCAGADLDWMRRAAGYSEAENLADAQKLAAMLKAVYRSAKPVIARIHGAAMAGGTGLAAVCDIAIATDAAKFALTEVRLGLIPATIGPYVADAIGPRQARRYFLSAERIPAGTALKLGLIHELVSEELLDQRVAEIAEELAKGAPGALREAKLLLAELREGSPWDDQLLEHTAGRIASIRAGDEAREGLASFFEKRAPKWQE

SEQ ID NO: 6382 - protein, 532 aa, Chromobacterium substugae
MPILESKLSPRAADFVANTDKMRALVDDLKQKVAQAAWGGGEKARAKHTARGKLLPRERIDLLLDPGAPFLELSQLAAYNMYGGDAPGAGVIAGIGRISGIDCLIIANDATVKGGTYYPMTVKKHLRAQEIARDNRLPCVYLVDSGGAFLPLQDEVFPDRDHFGRIFYNQANLSAAGIPQIAVVMGSCTAGGAYVPAMSDETVIVKEQGTIFLGGPPLVRAATGEVVSAEELGGGDVHAKISGVADHLAQSDAHALAIARRIVSDLNWKKQGELDRAEPKPPRYAAEEIYGVIPADLKKPFDVREIIARLVDDSDFDEFKQNYGTTLITGFARLNGYRVGILANNGILFSESALKGAHFVELCCQRGIPLIFLQNITGFMVGKKYENGGIAKDGAKLVTAVACAKVPKFTVLIGGSFGAGNYGMCGRAYSPRFLWMWPNSRISVMGGEQAAGVLAQVKKEQLGDAFTAEQEEALKAPVRQQYEEQGHPYYASARLWDDGVIDPAQTRDVLALALDAALSAPVEATRFGVFRM

SEQ ID NO: 6383 - protein, 114 aa, Chromobacterium substugae
MNAAERIVQAQLDAYNARNLEAFAACYAEDVKVYRLPSMALSLSGRAALADHYAGKRFNLPKLHAALLHRIVQGSRVIDHEEVTLDGENRFRAVAIYDINADGLIAAVWFVDAE

SEQ ID NO: 6384 - protein, 389 aa, Chromobacterium substugae
MYSSLRFAFGETYDLLRESVRDFADREIAPRAAAIDQDNLFPADLWRKFGELGLLGITVGEQYGGVDMGYLAHMIAMEEISRASASVGLSYGAHSNLCVNQIYKNGNDAQRAKYLPKLVSGEHVGALAMSEPNAGSDVVSMKLKADKTDGGYLLNGSKMWITNGGDADTLVVYAKTDVNAGPKGITAFIIEKSFAGFSHGSKLDKLGMRGSNTYPIFFDNCFVPEENVLGGEGNGVKVLMSGLDYERSVLAAGPLGIMQASLDIVVPYLNDRSQFGQPIGDFQLMQGKLADMYVKLSASRAYVYAVGQALDRGETGRQTRKDAAGAILYAAENATQLALDAIQCLGGNGYINEYATGRLLRDAKLYEIGAGTSEIRRWLIGRELMAETR

SEQ ID NO: 6385 - protein, 156 aa, Chromobacterium substugae
MISVDIAGTRFNLRAAAIIEHEGKVLLHRLIRDDFWTLPGGRVDPDEEAAKTVEREMLEELGEAVRCGEMVMLIENFFSAGGQRNHELGLYFQTHLAAGSALPSRATPFAIEDGGARLEFDWFSREQLGELRILPQPMKDMLISEDRSLRHVINRE

SEQ ID NO: 6386 - protein, 165 aa, Chromobacterium substugae
MDKGRYHGGLLIEKEADMTIWVDADACPKVIREVLFRAAQRTGVELVLVANQLLTVPKAPNIRALQVPKGFDVADNEIARRIEPTDLLITGDIPLASEVLAKGAQALNWRGEAFSKETIAAQLTMRDFMDNLRASGVQTEGPPPLSQADRQAFARQLDIWLAKRR

SEQ ID NO: 6387 - protein, 407 aa, Chromobacterium substugae
MNASSNAIRYRTLAGTVLTQFALGSVYTWSLFNAQLSHKLGEPVSQVAFAFGLLSLALAVASSMAGKLQERFGVRKVAIASGLLLGLGFYLTSHAGSLIMLYLCAGLLVGFADGAGYLMSLSNCVKWFPERKGLISACAIGAYGLGSLGFKFINLALLSHFSLEATFQLWGLIAMAMVVAGALLMTDAPQQPAAAQTGGSRDFTLAEAMRQPQYWMLALMFLTVCMSGLYVIGVAKDIGESFVHLSATTAANAVAVIAVANLSGRLVLGVLSDKMPRIRVITIAQVAALAGMLTLLFAPLNAGLFFAAIACIAFSFGGTITVYPSLVSDFFGLNNLTKNYGVIYLGFGIGSIVGSIVASLFGGFLATFHLILALLIVALLFSLTIRQPGAAQADKEEFDAEPHLGKA

SEQ ID NO: 6388 - protein, 248 aa, Chromobacterium substugae
MLKALIVEDEYLARQELAYLIREHSGIEILASVEDGLEAFKFLQENEVDVVFLDIHIPSIDGLLLAKNLHKTTRPPRIVFVTAYKEFAVEAFEVEAFDYILKPYNEQRIAHVLHKLEALEPAPPPAAAASAPAADAAPASRTVNLAKGDSIIVTPCDDIYYVEADEKVTLVYTARDRYVMAMSISEFVSRLPADSFFRCHRSFCVNIHKIREIAPWQNSTYIIKLYDLKAEIPVSRSNIKAFRQLMHL

SEQ ID NO: 6389 - protein, 557 aa, Chromobacterium substugae
MIENNPNMLLLAVFERAALMLMALFFLTRIRPFQDLLRQQRHTPAELAGVSLLFCLFAVFSTYTGIPVDGSLVNVRTIAILAGGILFGPWVGIPAGIVSGLHRYLIDIHGYTSLPCLISSICAGLLATIIHFRAGRRRLWLYGVAAGIACESLTMALILWFTEPAIGRAIVGHIAYPMITGTVCIGLVIKLVQDLDDEKELLAARQAKLALTIANQTLPYFQNVDRDALVEVCTVIRNHIGADAVAITDTADVQAYVGLGKDYYEPAAHSAIGEITRQAVQQDQIIIENNLQRYRVADFHSVIIIPLRENARVTGTLKIFYRKSGGITSSLRELAVGLSQLISTQMEASRIKQLQEMARKAEFAALQSKINPHFLFNALNAISSLIRIQPSEARQLIAKLADYLRYNLSLGDTLIDIQEELKQVRDYVAIEQARFGDKLKVVFDVDDVHVRVPSLLLQPLVENAILHGIQPRKGPGEVCIAVKRDGARIHVCVRDSGYGISQEVIDGIADGKVESRSIGLMNVNERVKLLYGEGLRLTRLEPGTAVCFDLPAEEAAC

SEQ ID NO: 6390 - protein, 180 aa, Chromobacterium substugae
MNRIAIPAPEHIPAASQPLLAAVQQQLGMVPNLMKLLAHSPAALEGYLSLNGALGKGRLGAALRERIALAVAEFNGCDYCLSAHSYLAKHVARLGDDEIVAARDFSSADAKQAAALRFALNVAEQRGRVADAELAALREAGFDEAETLEIVAVVALNILTNYINNAAATAVDFPLVQTRA

SEQ ID NO: 6391 - protein, 299 aa, Chromobacterium substugae
MDRFHLMSVFVAVAEEEGFAGAARRLKVSPPAVTRAVAALEESLGVRLLNRTTRYVRVTEAGARYLDDARRILAAVAEAEDAAAGGNAEPSGLIRLTAPVLFGRLYVMPAVVDFLRQHPLVEVSAQLRDNVVNLMEEGLDAAVRIGHLPDSSLRALKVGEVRRLVCAAPDYLARHGAPAAPEDLREHTVIASTAASTSLEWKFGADGERRVRVRPRLTVSGNDAAIDAALSGFGLIRVMSYQVAEALAAGELERVLTAYESAPLPIHIVHAESRYGSTRMRRFIDLLAERLRADPRLKD

SEQ ID NO: 6392 - protein, 658 aa, Chromobacterium substugae
MAEAKTPSPWHAGELEMQRRAGSLERMAAAGPRNIRDHMPQQHRDFFPQLPFLAAAAVDEAGRPWAGLIESQPGFARSPDPRRLRVDSLPSRADPLRDCLRAGAQLALLGIELHTRRRNRLNGALAELDDAGFTLAAEQSFGNCPKYIQLREFSFARPPDGRIVGTVEWMDRLDDDARAFIAAADTFFVASAAPGASNWQVDISHRGGKPGFVRVDGDTLTIPDFAGNGYFNTLGNLLRHPQAGLLFIDFSSGDTLQLCGGAEVLPEDGQGFAGAERLWRVTAERVVRRRNALALRWQLREFSPYALATGAWPQTAARQWLPLRVARVVEESPQVRSFYLEPADGSPPPPFVPGQHLSVKVAGVDGVRLRNYTLSQTGGYRISVKLQGKASARLHQLAPGDIVEALPPRGDFILLPPRRPIALLAGGIGITPLLAMLHQLAGQPAAMPPTLLLYATRSVAERAFDAELEQLRRQSAGKLRIVTAVSRPETSSRAGVDYQHAGRADLALLRQSGADLDGDFYLCGPAGFMQALYDELIAAGVTDARIHAEAFGPAGLKRAGSATQALPPPADHAVPVRFAASAIDAEWQPGQSLLELAESCGLNPDFSCRGGTCGSCRGVLLSGAATYLQPPEYAAQAGDILLCCAYPAAGADKLEINL

SEQ ID NO: 6393 - protein, 203 aa, Chromobacterium substugae
MSAIQLYDFPLSGHSHRARLMLSLLGLEYEAILVNLAAGEHKQPAYLKRNRFGQVPVLVDGDAVIADSNAILVYLARRYGHGDWIPADPAAEAQVQRWLSAAAGPLAFGAAQARLHKWRGVPLDYPLAVSRAEALLQVMEQELAERPFLAGQAATIADVALYTYTAHAPEGEIPLAPYPHVRAWLTRVEALPGFVAMPANTAS

SEQ ID NO: 6394 - protein, 175 aa, Chromobacterium substugae
MAVQREGDAVDRILAQWARERPDLDASPMGVIGRLNRCAALLSQRMDAVFGQYGLSGWEFDMLATLRRSGAPYCLAPTELFSSLMVTSGTMTHRLKVLEGKGWISREASAQDARSTLVRLSEVGFALIERALEAHVANEHAILSALPPRSLDALEKRLAELLAALEDATAASGKR

SEQ ID NO: 6395 - protein, 292 aa, Chromobacterium substugae
MSLRRASALWSDVLITAMVPVIWGSTYIVTTQLLPPDRPFTAALLRVLPAGLLLACLGGWRPAKGQWGKLLALSALNIGVFQALLFVAAYRLPGGLAAVVGACQPLLVMALAWQVEKRKPARLALWASLSGVAGMAALLLSPGSRWDGLGMLAAFGGAVAMACGTYLTRRWRLPVPVAALTGWQLTLGGLMLLPLARIIDPPLPVLTAAQIGGYAYLTVFGALIAYWLWFRGIARLSAVAVTSLGLLSPLTAVVLGWALLGQALSAQSMLGLAIVLASVLAVQWSMLNAAAK

SEQ ID NO: 6396 - protein, 175 aa, Chromobacterium substugae
MPNPYTTAFSLRHLSAEHIENFWRVTDSVARERRYLAFLEIPQAASAEYARSQLARKAPHLLLLDGKQVVGWCDVAPQHFPIYQHGGTLGMGLLPRYRGMGLGGWLLDSTLQLAEQRGYRRLELTVHEDNLNAIKLYERHGFLLEGRKREAICIDGRYKDVLMMARLTPTASSKP

SEQ ID NO: 6397 - protein, 130 aa, Chromobacterium substugae
MNQAEFFTISDLAQEFDVTLRTIRFYEEQGLIEPQREGRQRLFNRRDRARLKLILRGKRIGLSLAEIREIIDLYQLARDEASQSQKLLDLLQSRRNQLESQRHDIDAVLDEIGALENHCRNVIGSQSTAA

SEQ ID NO: 6398 - protein, 562 aa, Chromobacterium substugae
MQQASYAQGASDQPLLGQTIGRFFDQACERHADRLALRVRQQDIRWSYAELRRQVDRLACGLLRLGLAPGERVGIWSQNRAEWVLMQFASAKAGLVLVNINPAYRRAELEYALNKVQCRALVLSPGFKSSDYVETMRQLAPELDACRPGELRAGRVPELRWVVRMGQQALPGILPFSELLAEPTAAELAALQAVGEALQCGDAANIQFTSGTTGHPKGATLSHRNILNNAWFVGAAMRLRADDRLCIPVPLYHCFGMVMGTLCCLCRGAAMVLPAEGFDALAVLQTVAEERCTALHGVPTMFISLLDHPRFAEFELSSLRTGIMAGSPCPVEVMKRVLSQLHMAEVTICYGMTETSPVSLQSAADSPLEQRVSTVGGVHPHVEVKIVDAEGRVAPRGQRGELCVRGYSVMLGYWDDPDMTRAAIDAEGWMHSGDLAIMRDDGLVNIVGRVKDMVIRGGENIYPREVEEFLYRHPKIQDVQAIGVPDARYGEELCVWIRLRDGETATEEEIRAFCQGEIAHYKIPRYIEFVDGFPMTVTGKVQKYLMRRKMLEKLGLPDVKTA

SEQ ID NO: 6399 - protein, 225 aa, Chromobacterium substugae
MTVTAFNDADLARLETLLTPLSASGSTMRPDEVQGFFAALVSGPDAVDTDFWLPEVLGDAPAFESQADEAELKTLLQKLFDTTRDVLAAGEELDMILYAEEDSEEEGEPDYWPWANAYLYALDLVDTDWFEVAEEDEGFESLMMPMLVLGGAFEEEDGEDLLTFTDEEVEGYKEELTDALQAVFGYWRAKEQAPTTVRRDGDKVGRNDVCPCGSGKKYKACCGSN

SEQ ID NO: 6400 - protein, 385 aa, Chromobacterium substugae
MNPALVFDYYNPTHLHFGAGQLAGLERLLPAGARILLLYGGGSIKRNGIHARLQQALRGHDWLEFGGVAPNPDVEALAGALALLRESRRDFILAAGGGSVIDAAKYLAAAALHDGDGWELVSGKQPVRAALPLGVVLTLAATGSEGNGTAVISRLSSQEKLAFRSPLLRPRFAVLDPDTLATLPDRQLANGVTDAFVHACEQYLTYPVGALVQDGCAEAVLRALYRLACRFDERGTPDWRQNMMWAANQALSGAIGLGVPHDWATHGIGRALTALYGIDHGRTLSIVQPSLLREACAEKAAKLRQMGARVFDAPELAAERVIDKVEDMYRALGMPVTLAEAGVPDAGAAADDVLALLRRDGRFGLGEGGILIEARVGRIVRAFCR

SEQ ID NO: 6401 - protein, 171 aa, Chromobacterium substugae
MAIDDDIIVAPIGGVHPRAGGARGVHALAQHGQRGRRQDTEDNADISLSHGRQAAQLLYSAVMDQVAQLAGLDVDPGQLQESALPGDSHSQHLLLGIAALFEHYCGRHPQLARQEAGQAFAPLAEAGLERGHQETCQVLRQLNAYPPATAAQLQGLCQLTARLLRERLAQN

SEQ ID NO: 6402 - protein, 217 aa, Chromobacterium substugae
MSISSLNSNQAGQTGGASQTQNAGYSAQTARNQLNSVLVESLDVSISSGKQSQTLLFHASITNINQILSADSGGQNSDGSGNASSSTLQINSTQLSISVQQQSGQNSDDDNSPQATAKRILDGATSLFGLYKQQHPELSSDQQAQNFVGLIRQGFEQGYQEATGILKNLNVFNGDVSSGIQQTHDLVEQGLDAFLQQNQSAGTQSSQAAAGDSQSGS

SEQ ID NO: 6403 - protein, 594 aa, Chromobacterium substugae
MPVYKAPLRDFDFVLNELIKVQDIIPSLPGYEEATQDIFSSYLEAAAQFCESELAPLNRQADEEGCQYDSATKSVTTPTGFKEAYKQYCELGFPALDCDPSYGGQGMPKSLAFPIMEMQCSANVAWSMYPGLSHGAYSAIHAHGTEEQKAAYLPKLVDGSWTGTMCLTEPHCGTDLGLLKSRAEPNGDGSYRITGTKIFISAGEHDLSDNIIHLVLARLPDAPKDVKGISLFIVPKFLDDKSRNAVSCGSLEHKMGIKANATAVINLDGAKGWLIGEPNKGLSCMFTMMNAARLGCGMQGLGIGEASFQGALSYARERLQMRALNGAQCPDKAADPIIVHPDVRRMLLTQKAYTEAGRALAALLALQLDIEDKHPDAGVRADAADLVALLTPVAKAFMTDNGYTAANLGMQVFGGHGYIREWGMEQLVRDARISQIYEGTNGIQAIDLLGRKVLLDQGAKLRKFTKLIHKFCQQYEGHAQLGEFVNPLAKLMKEIGEITMGIGMASLSNKDEAGAAATDYLRLVGHLTYAWLWARMAEVAYAKLGQGEDAFYNAKIATARFYYAKLLPEAEALKASIKTGAKPLMALEEAHFGF

SEQ ID NO: 6404 - protein, 185 aa, Chromobacterium substugae
MTWLKRKMRRFAGRRHQWFARPGMRRLAPYLDQPAYWAFNRRKVAMGVAVGLYSGVMPGFTQKATALALALLLRVNLPAAMVVSLYSNPLTVLPLYYLAYCYGRWLLGGPTSLSMAPPPGLGGAGLAAWLAGTVGWLVDMGWPLLVGMPALGLTLGAAGYLATRVMWRWAVVSAWNNRKAKCGSA

SEQ ID NO: 6405 - protein, 185 aa, Chromobacterium substugae
MDLLEKQLTSELVYEGGFLRVRKDQVALPDGKQAAREYILHPGAVAILALTPQRELVLERQYRYPAGREFIEIPAGKIDPDEAPEETARRELFEETGYRAASWTYLGTAHPCIGYSNEKISYYLAQDLILSERRLDEGEFLEVLTKPLDEAMEMALSGGICDSKSIVGLHWLAAYLSGRMRGVPI

SEQ ID NO: 6406 - protein, 105 aa, Chromobacterium substugae
MSRFDAYYDRRRGRRVSMGCKARIKSLLSGQTYYGECVDLSVDGMALRSAFVPQYGEKLNVIVLVPSVGGVSGKPFEAEVEVKRCNEVQRGLIYEIGVRILQRKS

SEQ ID NO: 6407 - protein, 642 aa, Chromobacterium substugae
MHPDIFSHYAVRYDKTREEEYTIQEYLELCRQDPGAYATAAERMLAAIGEPELVDTRHDSRLSRIFSNKVIKVYPAFRDFYGTEEVIEQVVAYFRHAAQGLEEKKQILYLLGPVGGGKSSIAEKLKELMELVPFYCLKGSPVNESPLSLFNYDEDGPILEEQYNIPRRYLKGIPSPWAVKRLHEFNGDIGQFRVVKRYPSVLRQVAVAKTEPGDENNQDISSLVGKVDIRKLEKYAQDDPDAYSYSGGLCLANQGLLEFVEMFKAPIKVLHPLLTATQEGNFKGTEGFGAIPFEGIILAHSNESEWKQFRNNKNNEAFLDRIYIVKVPYCLRVAEEIKIYDKLIRNSSLGKAPCAPGTLKMMGQFAVLSRLKEPENSSLYSKMQVYDGENLKDTDPKAKSLQEYRDYAGVDEGMSGLSTRFAYKILSKVFNFDHSEVAANPVHLLYVIEQQVEREQFPAETEQKYLTFLKEYLAPKYVEFIGKEIQTAYLESYSEYGQNIFDRYVTFADYWIQDQEYRDQDTGEIFDRTSLNAELEKIEKPAGISNPKDFRNEIVNFVLRARANNGGKNPTWTSYEKLRTVIEKKMFSNTEELLPVISFNAKASAEDAKKHEDFVNRMVEKGYTAKQVRLLCEWYLRVRKSS

SEQ ID NO: 6408 - protein, 52 aa, Chromobacterium substugae
MGHSHLSCAQPRAAGSVPKPAARRRARLCLLVDRRQPPDIANPPAPIGASGS

SEQ ID NO: 6409 - protein, 426 aa, Chromobacterium substugae
MSHIIDRRLNGKNKSAVNRERFLRRFKAQIKEAVSKAIKGRSITDIESGEKVSIPVKDISEPNFHHGKGGVWENIHPGNEEFIKGDRIPRPQGGAGGGGSKASQDGEGEDDFVFQLSREEFMNVFFDDLALPNLIKTQLMGIEELKTVRAGYTNDGTPANINIVRSLRGALARRVAMAAPTLSSLDDAEEELDTLIESDDDNALDVREKRQRIHQMRERLASIPFIDPFDLRYNNRVKQPKPTSQAVMFCIMDVSGSMDEQKKDMAKRFFILLYMFLQRNYEKIEVVFIRHHTSAVEVNEQDFFHSRESGGTVVSSALNLMSDVIRKRYASSEWNIYAAQASDGDNWDSDSANCGRILEENLLPYCQYFAYIEITEGEPQNLWYEYLKVKSQCPQFAMQKIRSASDIYPVFRELFKRQPANGRVGT

SEQ ID NO: 6410 - protein, 515 aa, Chromobacterium substugae
MKRTRKGEEEVGKPISTGSEWTFDLIGEYDRQIRTIAVDEFKLDVYPNQLEVITAEQMMDAYASVGMPVNYHHWSYGKHFVSTEKSYKRGQMGLAYEIVINSNPCIAYLMEENSMMMQALVIAHAAYGHNSFFKGNYLFRSWTDASAIIDYLVFAKSYISKCEERYGIDEVEELLDSCHALMNYGVDRYKRPQKLSLAKEQARQEEREQYLQMQVNDLWRTIPKRDKDDSGKPASRFPLEPQENLLYFIEKSAPLLEPWQREVVRIVRKVAQYFYPQRQTQVMNEGWATFWHYTIMNRLYDKGLITDGYMLEFLQSHTNVVTQPPVTARWYNGINPYALGFAMYQDIKRICEAPTDEDRAWFPDLAGSDWRESLEFAMRNFKDESFISQYLSPKLIRDFRFFAIRDDDKDDKLEISSIHDEEGYRDIRGKLAEQYNLGSREPNIQVWSVNVRGDRSLTLRHVMHNRRPLEDQSAQEVLKHVCRLWGFDVKLESVDGNGEVKQSYEVQAVRDPEMA

SEQ ID NO: 6411 - protein, 155 aa, Chromobacterium substugae
MPLLAALQSLPNQFCGEGINHEDQTFTGCLHWQALPGQRALLLHYTASGTSGDVLHRETTLLGYLPDGTLCLWPVMEELPFVLPHPAVRLAEGAHGTLEVVFASAPRSLTEQFRQEITIRLEANGQMQYTHGWGLPNCSFEDRSRCSLTPVAGTA

SEQ ID NO: 6412 - protein, 258 aa, Chromobacterium substugae
MTLRRNGRLLLQDISLALRPGELLIALGPNGAGKSSLLKLLSGLWRPDSGAIHLAGENLDDLPAAAQAGWRAVVEQHPVTPAGWTGAELVAAGAYRYPRLPSRQIREAISEALALTGAERLAARSLNELSGGELQRLQLARALCQLLLSPETERYLLLDEPTAALDFGLADELMAQVRQLCHRLQIGGLAVIHDLNLALRHADKVLLLNNGQAAGYGDNQEMMRRERLEAVYGVRLAELSHPEQPWRAFIPLPDSPQR

SEQ ID NO: 6413 - protein, 321 aa, Chromobacterium substugae
MRALTLTLTLLLLLALTSIASLLHHSHLLLASLWRLQPQPALEWQLLVELRLPRLLASAGAGALLASAGAAMQARFRNPLAEPGLIGVNSGAALASALALSLGAGLYGVAASAFGGGMAALLLVRLLGADQDGNRLILSGLAVSTLLGSLLTLLITMLPDGSLRIVTFWLMGSFASVEWPQALLMLLAAPLVWLALFRQWRFLNALQLGESTAFHLGFAVRRLEWRIVMLAALATGLVVSGCGMIGFIGLMAPHLARQLLGSDSRRLLLAAPLLGAWLAVSSDWLARGLLAPAELPVGVITSLLGAPFFLWLLRRQERRHA

SEQ ID NO: 6414 - protein, 267 aa, Chromobacterium substugae
MSQNIVIVGASGRMGRVLIESVLSAPGARLHAAIERSDSGFVGQDAGLFCGRASGVKITSDFIAALEGADVVIDFTRPEGTLEHMMACVEHQVQMIIGTTGFDDAGKAAIRAAADKIAIVFASNFSIGVNLTFKLLDMAARVLNEGYDIEITEAHHRFKVDAPSGTALRMGEVIADALGRDLKQCAVYGREGVTGERDPNAIGFATVRGGDIVGDHTALFATLGERVEISHKASSRATFANGAVRAARWLSDKPHGLFDMQDVLGLR

SEQ ID NO: 6415 - protein, 127 aa, Chromobacterium substugae
MRALIFAAVIAVSGCSSINPLDWTHKVEIQQGNYVTQDAVAKLKPGMTRSQVRFLLGTPLLTDAFHADRWDYKYSDTKQGRLETSSDKLLTVYFKGDVLDRVEGAAQPAPPAKQLDASMPAQETKQP

SEQ ID NO: 6416 - protein, 143 aa, Chromobacterium substugae
MSKASHLKDIGLKATGPRLKILDLFEEADSGHMSAEDVYRKLLAENIDIGLATIYRVLTQFEQAGILVRHHFETGKAVYELNQGGHHDHMVCVSCSKVVEFFDPEIEALQDRIAEQHGFRIVDHALYMYGECPDCLAKGGRRG

SEQ ID NO: 6417 - protein, 233 aa, Chromobacterium substugae
MIPWLGPEPVFPPVAQALSHPNGLLAAGGDLSPRRILSAYSEGIFPWFSLGEPILWWSPAPRMVLYPSRLRVSRSLAKALRRPDYEIRTDQAFFEVMEACSQPRAGQDGTWIVPEMVAAYCRLHQLGYAHSFETWIDGELAGGLYGVAIGRMFYGESMFARRTDASKLAFVHMVRHLATQGVEMIDCQMHTAHLESLGACLVPRDVFLATLKEKIRQPQPGQMWDYHYRHESS

SEQ ID NO: 6418 - protein, 243 aa, Chromobacterium substugae
MSHREAGQVAAIHFYATAPYPCSYLSGHQARSQVAIPAEAIDGGVYSQLVRLGFRRSGLYTYRPYCDACQACIPVRLAVDQFQPNRTQRKVWRRGGELTVEWLPLAFDAEHYALYRLYQQARHAGGGMSDDDAQQYAEFILKSGVDSHLAEFRLEGALKMVSLVDRLADGLSAVYTFYDPADAQMSLGVYNVLWQVEQARAMGLSYLYLGYWIADCRKMAYKAGYRPLQMLHGGRWQTMPEPS

SEQ ID NO: 6419 - protein, 154 aa, Chromobacterium substugae
MKTTTLSRITVIALLSVGALSGCATSDSAAVYSKSQMRQAQTVQFGTVVSVQNVKMEGQNNELLTLGGAALGGLAGSNIGGGKGQIAGGIVGALAGGYGAKAAQEALGKNALEITVKLDSGRVVSIVQEADIPFVANQRVKLLSGGGNDRVVPY

SEQ ID NO: 6420 - protein, 346 aa, Chromobacterium substugae
MLYPLLRPLLFKFDAETAHEHTLKMLDRAHRLHLGSLAGSPAAGHPVQAMGLTFPNPVGLAAGLDKNGAHVDALADLGFGFIEIGTITPRPQDGNPKPRLFRLPEHEAIINRMGFNNLGVAALLDNVRRCKFKGVLGINIGKNAITPIENAVDDYLACLDQVYAAASYVTVNISSPNTKNLRQLQQGNELGKLLAALKRRQSELADRHGRHVPLAVKIAPDLDDEQIAEIARLLIGNGIDGVIATNTTLSRREIAGHPLENEAGGLSGAPVRSRSTALIRKLAKELDGALPIIGVGGILSGSDAVEKLEAGASLVQLYSGLIYRGPELVGECARAAAQYLQARTRE

SEQ ID NO: 6421 - protein, 196 aa, Chromobacterium substugae
MSTPLSHATLEQLFLNARTHSHWQARPVGDDLLRQLFDLLKHCPTSANCSPARFVFVKSPEAKAKLKPCLAEGNVDKTMSAPVCVIVAQDMKFYEQLPKLFPHADAKSWFEGNDALIQTTAFRNGTLQGAYLILAARSLGLDCGPMSGFDNAAVDAAFFPEGNVKSNFLINLGYGEADKLFPRSPRFDFADACQIL

SEQ ID NO: 6422 - protein, 267 aa, Chromobacterium substugae
MASRRKRHEDEHENHERWLVSYADFITLLFAFFVVMYAISSLNEGKYRVMSSAIMDAFRSGTLVTVQTSPPNGGANTMIEIPQTKPISKSIKADHHVEEAAKLGQLTQNLAKVLGPLVQSGEVTITQSDQGINIDIRDSALFAVGQAVPNQQSLPLMSSMAKLLAGVDNSIKVEGFTDDVPIRTPSFPSNWELSAARAGGVVRLFQENGINAQRMVAVGHGANLAVADNATAEGRARNRRVTISVQANDAGAPEAQTTPPTATEVKP

SEQ ID NO: 6423 - protein, 119 aa, Chromobacterium substugae
MAAAAPRLICPSAELLDSGPAHRFEIEQADGSRLPAFAVRYRGKVHAYINRCCHIPVELDLEDGKLFDLTGHYLICSMHGARYHPDNGYCSWGPCRGQSLARLEVIEQNGQVWLNVMPD

SEQ ID NO: 6424 - protein, 217 aa, Chromobacterium substugae
MREFDLVVFDWDGTLMDSTGHIVHAIQQACRDLDLPVPGREAASHVIGLRLDDALLRACPAAGARLPELTAAFRRRYQAGLERVTLFEHAQSTLQAIRAAGIFVAIATGSSRAGLDRALQAAGIQDLFDATRTVDECHSKPHPDMLFQLTDYFGVACGRALMVGDTSHDLLMARNAGSVGVGISHGAHADEELLRCQPAALVHSLPELSSWLLPRLG

SEQ ID NO: 6425 - protein, 312 aa, Chromobacterium substugae
MTDIRKDSVTFLEVDAEDAGQRLDNYLQRLLKGVPKSHIYRILRSGEVRVNKGRADASYRVAAGDTLRIPPIRVAERAEKNVPAATFPVVYEDDAMLVINKPAGVAVHGGSGVSFGVIEQLRQAHPEWRYLELVHRLDRETSGLLMLAKKRSALTRLHDMMRDNVPDKRYLALGAGHWPENIKQVKLPLFKFHTADGERRVKIAEGDDGQYAHTNFAIQQRYTEFTLVEAHLRTGRTHQIRVHMQANGCAIAGDEKYGDFALNKELARRGLKRMFLHAKSLALPHPLTGAPLKLEAPLPPELAKFLKTLEPR

SEQ ID NO: 6426 - protein, 973 aa, Chromobacterium substugae
MKRMLFNATQAEELRVAIVDGQKLVDLDIETVGKEQRKGNIYKGIITRIEPSLEACFVDYGTERHGFLPFKEVSRSYFQGYDGGRPRIQDVLREGMEVVVQVEKDERGNKGAALTTYISLAGRYLVLMPNNPRGGGVSRRIEGEERQELKDLLSQLEVPHGMSLIARTAGIGRNLEELQWDLGYLMQLWRAIEGAAGAQSAPFLILQEGSLVIRAIRDYFHPDIGEVLIDTEEIHDQARQFMSHVMPNMLSRVKLYKDHVPLFSRFQIEHQIETAFSRSVQLPSGGAIVIDHTEALVSVDVNSARATKGADIEETAVRTNLEAAEEIARQLRLRDLGGLVVIDFIDMENAKNQRDVENRLRDVLKHDRARVQMGKLSRFGLLELSRQRLQPSLGETSHEPCPRCHGIGFIRGTESSALHILRIIQEEAMKENTGAVHAQVPVDVATFLLNEKRAEIHSIEERLDVDVVLIPNIHLETPHYKIVRVRHDDLAELGEAPSYSRVEVQEEDVITNFGQEKPKVERQEAAVKGITPQQPAPTAAPAAAKQPAAEAGLFSGLVSWFKGLFAEPEKAPEPEAKKKPAAAREQRGNRQRSQERRTGGQARREHEQRRGSPQDEGRQRRQDERGERKDAERSERADRAERKDPAGREAREERNEQAREPRGNRRREREGREPREAREPREQQPREERVSDKAEKQDKPEPRRRQAPAAAPQEAEKPVQDELRLDTEAEQAEQAEQQERGERRRRRSRRDRRRDTPEGAVAEAGAEAPAADAAEAVVVAAVAAEVVAEAAQPAVEPEAKPVVEAVTEPQVEAVVEAVAVVEPEAKPVEPVVVAEPAAAVFVEAKVDAAAAPAVVEPVEARAEPEAVPVAEPVSEAVVMAAVVEEEPQAAEPVAVAVEPVVEAEPIVVEAKPVEAKPMDLGGLVMVATKPVAEHSAVLEPELPQGPRRRDMAAGIDAAAQAPMELVQVETRNN

SEQ ID NO: 6427 - protein, 472 aa, Chromobacterium substugae
MPRAIVLNVVGLTPKLLRFAPALRQLAEDGCMRPLATVTPALTCPAQATFLTGAPPRQHGCVANGWYSRELAEPLFWKQNNALIQGEKIWHEARRRHADFSCAQLFWWYNMYADVEWSVTPRPIYKADGRKIPDFYSAPAELHQELRDRLGDFPLFHFWGPASDIRSSRWIADCALHLYRSRHPKLTLVYLPHLDYSLQKLGPDHPQIAREVAAVDQLCAELIAAARRDGTRILALSEYGITQVRGDIAINRALRQAGWLQVREEQGEDKLDCGASAAFALADHQVAHVYVRRPELVGEVKALLQQLDGVEMVLDEAGKKLYGLNHPRSGELVAISRADRWFSYYYWLDEAKAPDFARTVDIHRKPGYDPVELFLDPQLALPKLRIAWTLLKRKLGQRSLLEVVSLDGSLVKGSHGRPTDSPDDGPLLISSEAGSLADGMLPASAVRDIMLAHLDPNPAPSRQGNSAPATAG

SEQ ID NO: 6428 - protein, 295 aa, Chromobacterium substugae
MFDPHIHMSSRTTDDYQAMRREGIHAIVEPAFWMGQPRTHIGTFEDYFLSLLGWERFRASQFGIRHFCTLGLNPKETNNPDIADGVIALLDRYLDKDGVVAVGEIGFDDETAAEEHYFQLQLELAVKHELPVLVHTPHRDKKAGTIRSLALVRDSGIPEERVLIDHNTEETLPLVLDSGCWAGHSIYPNTKMSEPRMVALVQQYGSERIIINSAADWGISDPLKVPKTVAAFRAAGIAERDIETIVWRNPIRFFAQSGKLDIAEAEASLDVDQRQQWQGNSVLRGQQPQVDTLDQ

SEQ ID NO: 6429 - protein, 229 aa, Chromobacterium substugae
MLKNLIQLHIRQSAELPAAPAARQWLEQLPAALAALPDAAALQRLYSTAARSLQPLSQLPRQLQPELERAGAIAPLDWRPGDIGRLLLLLSLPESRDGQAHPCFARLYRGGDAGEQQSLLRALPLLPAPERHLPLAIDACRSHIQGCFEAIACENGYPARFFPELNFNQMVLKALFTRTPLSRIHGLRHRLTPQLRRMAADLASERQATQADIPDDVYLILKGSRHENV

SEQ ID NO: 6430 - protein, 283 aa, Chromobacterium substugae
MSDWRVFLKLGRVSNLPTVWSNVAAGAVLSGQPPSPPTLLILLLALSLIYTAGMFLNDAFDRRIDQLERPERPIPSGQVSAAAVFAAGFAMLGAGVLLLAAMGRPALLAGLLLAGLVLLYDLHHKGNAFSPLLMGLCRALVYIAAALAVTGGQLPPPVWLGAGALLAYLIGLTYAAKHEQSGRIQRLLPLLGLAAPLLYLPTQPPNWLLLPGLALFVAWVGRCVWLAMFRNQRDIRAAVGGLIAGISLADALLMASHGMAAWALAGALAFLLTTQFQQRIAGT

SEQ ID NO: 6431 - protein, 404 aa, Chromobacterium substugae
MRLATTASPAIELGHLCYCTNIHPAESWDETRAALGKHLPAIKAQVSPLQPFGVGLRLSALAARQLETQAGLLPEFLQFLARHQLYVFTLNGFPYGRFHGPGAKRQVYLPDWRHPERLEYSDRLARLLSHLLPPDIDGSISTLPGAYAAHLRQPDQELPLIADHLLRHAATLHHLHMESGRCIRLALEPEPECLLETTRDAILFFQRHLLTASALTRLANLCHCPPGHAETLLRRHLGVCLDCCHAAVEFEDIESSLDQLAAAGIALVKLQLSVGLKLADVQPGHQAQLQSFADDHYLHQVVQRTPAGLRRFDDLPAALSQLEQAQGAEWRIHFHVPLWAQQLGDFSSTQDCVRQVLARHRRQSLTSHLEVETYSWHVLPPGFRAGNLDDAICQELSWVKEQLQ

SEQ ID NO: 6432 - protein, 404 aa, Chromobacterium substugae
MPALDDGSKTNGISHDSIRQRFSVSYEYQVWFTRKLLQPDNPTLRDAICREASHIRHRFVVVIDQGVAQHHPSLAQDFQRYADHHRDCLQLAAAPRVLPGGEAVKNHPVMLEALQQWLHDEHIDRHSYVVIVGGGALLDMAGFAAATAHRGIRTIRVPTTVLSQNDSGVGVKTAVNAFGSKNFLGCFAPPYAVINDYDFIATLPMRARISGMAEAVKVAAIRDIAFFNWLREHADALRRGDDDACQWMIRRCAELHLQHIAGAGDPFEFGNARPLDFGHWAAHKLEAMSHYQLSHGEAVAIGMALDTCYAAQSGLLPQQAAAQLCLLLEKLGFTLWTPLLEQRDAQGQLQVLAGLDEFREHLGGELTVTLLQRLGHGIEIHQMDKSLLASSISWLRHGMPEACA

SEQ ID NO: 6433 - protein, 370 aa, Chromobacterium substugae
MTKRIPAFQIDKKFIQGLLSATTPAQLHFYLQKAIELEHSTIPPYLTAMLSLKPGQNREIGKLIHGIVMQEMLHMTISANILIAIGGHPRINTPDFIPNYPGPLPMGIADGLIVGIEAFSLDLTRKTFMGIEEPTDPIPVHEMIGLYAKGQEPEFHTIGEYYESIKYKLDELSGQLQFGQLPQQVLNYFPPQVLFPITDVDSAKKAIDVIITQGEGTSASPYQNPNAPEKLEDLAHYYKFESIANGREITPCPDGKGYCFGGKPIPFNQDGVWPMPPTPKPEDYPENSQERTLIERFAYSYSSLLNSLHQAFNGEPGQMDTAIGLMFDLKVLSASLMNPSMLLGYDKGQPKPPIGLSFVYRDVQNGMSYN

SEQ ID NO: 6434 - protein, 668 aa, Chromobacterium substugae
MSYLDAPRINFTGVFQADPSTVNNDVRYYDNEAFRPEYQRQHYPDGGPEGAEGYWNPEGTGIFRFIECKITGAQLGDRLLTCPEEDPVIGLRVENADQQPPGKIVDLDPQMQYVSQLWGVQVRLASPTERALFCGDLLPVPLMNLWQRQLNAQSRWEQPMAANYQSILHDVDWSGCADSAVLLALKEASEQGCLSINFNLYGYTRDNTSQRFTMGLVSGSIGPYHRDEPKHFVLGRHLTTPLQPTTPNGAPFPTQPLGGVYGFQCVNRPEQQTLYADFGLALPITDATGQLHNIGTLTLALARLDDDTDHIPSLVKSSEFVPLGTVDYLQEGWYTRTAGIQGFCYAAGESDNQATLENKQYIAAYLGQTPLLLLGPQQSSGKYPVLTYEAIDGQYARADGHVFRLNPDTPQQVDFYASQFGKPLATKLHVWQLPPGNPNSNPMGGTGMSNNSLTPPVDTPHVGFPEANLQVPEQLETDFHGKGSLTISASPPLGETPRGYIDGQLYALSYGFQPPPDSYAGKMATVPGGPYCEYWNFVSLLAFNKTAIPKHPTWERDIQPILQQYGNLYPIMSRHLVDLGNYESVRAHRHALLLAFSLPPTDPNYMPVSRDLSDANREMLLSWLSAMAPKQAETTPPEPEIVEIELRESAIRQPRPTASTSFRQKTAK

SEQ ID NO: 6435 - protein, 200 aa, Chromobacterium substugae
MAFLESLNQSLFLLINATPETSPLAIKAATLVAKDVMLLLPVFLAAIWLWGRPALRDTVLKSCLLTLVALLGNWLIGLAWPHPRPFAMPIGNTFLLHDATPSFPSNHGTIFAVMALCWCFSPARGWGWLLSLAGIAVAWARVFLGVHFPLDMLGALLVSIFWYASLSPLWSRRGTALTETLESLYRQLLAKPIAAGLIRR

SEQ ID NO: 6436 - protein, 409 aa, Chromobacterium substugae
MMSPGAFVPQSSSLLSVAGRAAIPRGVWVLGCVSLLMDVSSELAHSLLPLFLAGTLGVPVLAIGLIEGVAEATALICKVFSGALSDWLGKRKPLVLLGYGLAAFSKPLFPLADSASTVLFARFVDRVGKGVRGAPRDALIADITPPAIRGAAFGLRQSMDTVGAVLGPLLAIALMFVYRDDIRSALWWSLPPALLAVAAIWLWVREPAEHGEKRERAPMLNRAALSRFSAGFWGITALGAVFTLARFSEAFLVLRGAQLGLPLAWAPLVMVAMSASYALSAYPLGWLSDRVSRARLLQLSLLLLIAADLALGAASGPALLLAGALLWGLHLGCSQGLLSALVAQTAPAGLAGSAFGLFNLVCGLATLLASVVAGALWQEWGAAATFHGGAVFAAAAWLLGLVLRPLRQF

SEQ ID NO: 6437 - protein, 430 aa, Chromobacterium substugae
MSEREVRLWPEFVKALKQEVVPALGCTEPISLALAAALATRELGKPPERIDAWVSANLMKNGMGVTVPGTGTVGLPIAAAVGALGGDPDGKLEVLKSLTVEQVAAGKQMLADGKVKLGVAAVPNILYAEACVWHGDECARVAIADAHTNVIRIERNGEVKLKREAADAKPVESYELGDATARDVYEFALRAPLDSIAFIHDAAVLNSALADEGMSGKYGLHIGATLQRQIEAGLLSEGLLSNILTRTTAASDARMGGATLPAMSNSGSGNQGIAATMPVVVVAEHVKADQETLIRALALSHLIAVYIHTRLPKLSALCAVTTASMGAAAGMALLLNGGYPAVSMAISSMIGDLAGMICDGASNSCAMKVSTSAGSGFKAVLMALDGTRVTGNEGIVAHDVDVSIANLGKLATQGMAQTDTQILQIMMDKR

SEQ ID NO: 6438 - protein, 44 aa, Chromobacterium substugae
MEQLASGKTVAQVSDALGYASPSNFIAMFRRALGAPPAQYLASR

SEQ ID NO: 6439 - protein, 99 aa, Chromobacterium substugae
MRLAACWHPAAPPSPEQQRIIDVIVDEIRQAPRQELHLPMPADPRLRRIAAAILAAPAADRSTDEWASLGALSGRSLRRLIQADTGMSFSRWRQQAQLV

SEQ ID NO: 6440 - protein, 246 aa, Chromobacterium substugae
MPAGGQPHQRLQQRQDGQTYPAALAVAADGLHSALRRQWLPLAEPPATGALNLYGKARMACADDFDADLLRGPTIVFADGCTLVVEPMRFRAPMPACRPSPVDDYIYWALFGREASLGGRLPPDEGAAALRERVRAAARGWHPSLRALLERTDATAIIGREVRMAERVPAWPSGRLTVLGDAIHAMSPAGGVGANTALADAAMLAQCLAEGDIGRAVVRYEADMRQRAERALALTRAGAERLLRRA

SEQ ID NO: 6441 - protein, 309 aa, Chromobacterium substugae
MNFQQLRIIRETVRQGFNLTEVANALFTSQSGVSKHIKDLEDELGVELFIRKGKRFLGLTDPGKELLTIVERMLLDAGNIKRLAEQFSLRDEGQLTIATTHTQARYALPQVVTAFKRAFPRVHLVLHQASPDELVRLLLAGEADIGIATEAVTEVPELVSFPYYSWNHCVIAPPEHPLHRQALTLETLAEYPIVTYHHGFTGRARIDNAFAEAGLAPDIVMAALDADVIKTYVELELGVGIVASMAVDPQRDHGVKVVDGEPLFGQQTSRIAIRRGHYLRSYAYRFIELCAPALGEKSVRQALSPAVQE

SEQ ID NO: 6442 - protein, 359 aa, Chromobacterium substugae
MSIQVNHIRKAFGAFTALDDVSLHFPGGELVALLGPSGCGKTTLLRIIAGLEQADAGQVLLDGADASATHVRERQVGFVFQHYALFRHMSVFDNVAFGLRMKPRRERPSEADIARKVHELLELVQLDWLADRFPAQLSGGQRQRIALARALAVEPRVLLLDEPFGALDAKVRKELRRWLRKLHDELHITSIFVTHDQEEALEVADRVVLMNHGKVEQIGAPDEVYRAPASAFVYGFLGSANRFAGRSQAGGIAVGASLLEAEHQLAPGQAVQAFVRPHELAILPGADGAGLPAEVQRILTLGALSRIELEGRGELTGQQFDAELPADDPLLAEIAVGQPVRLQARGARVFATPTQAGEA

SEQ ID NO: 6443 - protein, 292 aa, Chromobacterium substugae
MSAAIPHPRAASDKAAQLESRAATRESRAVKYVILTLALGFFAVFLLLPLFVVFAEALSKGWSTYLTALAEPDALSAVRLTLLAALIAVPLNLVFGVAAAWAVTRFDFRGKQWLITLIDLPFSVSPVVAGLVFVLVFGNHGWLGSWLAEYGLKVIFSVPGIVLATLFVTVPFVARELIPLLEAQGREEEEAAVVLGARGWQVLWHVTLPNVRWALLYGIILSNARAMGEFGAVSVVSGHIRGETNTLPLHVEILYNEYNFAAAFAVASLLAMLALITLALKSWVEWRSVKEN

SEQ ID NO: 6444 - protein, 288 aa, Chromobacterium substugae
MPASPALLPAARPPRVLPGFGLSLGFTLSYLSLLVLIPLSAVILRAGSQPWDSFWQAATAPRVLASYRLSFGMALLAAAVNSVFGLLLAWSLARYRFPGKRLVDALVDLPFALPTAVAGIALTALYAGNGWLGQYLEPLGVKVAFGPLGVLVALVFIGLPFVVRTVQPVLEDLETELEEAAACLGARRWQVFRHVILPALQPALLTGFALAFARAVGEYGSVIFIAGNIPMVSEITPLMIISKLEQFDYAGATAIASVMLAASFLLLLAINGLQFWSARRHGRAGGSR

SEQ ID NO: 6445 - protein, 333 aa, Chromobacterium substugae
MRLRPLHQLALALLFAGSASAFADVTLLNVSYDPTRELYQEFNASFAKYWKAKTGETVTIKQSHGGSGKQARSVIDGLDADVVTLALAYDIDEISSQAKSIAPNWQQRLPNNASPYSSTIVFLVRKGNPKRIKDWNDLVKPGVEVVTPNPKTGGGARWNYLAAWGYALKQPGGNDAKAKDFVKKLYGNVKVLDSGARGSLITFTQRGIGDVLLSWENEAYLATRELGPDKFDIVTPSLSILAEPPVSVVDKVVDKRGTRKAAEAYLKYLYSPEGQNLAAKHYYRPRDPQVAAKYAGQFSKVKLFTIDQTFGGWQKAQKVHFADGGVFDQIIAR

SEQ ID NO: 6446 - protein, 266 aa, Chromobacterium substugae
MQQEGVEARLQWNEQEVFASFDGWWLSSSFFPQARLRDDRCQLLQYAARLRIFGQFGQALPANWLFAMNYAESKAVALLKLIRTLHLVNHLGRNGRHLPLRIDVDPRICHAYSDRIVDFTARLLEVLEFPARQAPLLLFLNDKTSELGLSLLRRYRQLGHRVGLGDFGECGEDLLRLWRLEPDFLSLAPRFMSRAIMYPQVRDRLLQLVPQLVEQGYALAVEDIVCQNMLGLAQQMGAEHLSGPLLSERLRRQKAAQLMDLNVINA

SEQ ID NO: 6447 - protein, 60 aa, Chromobacterium substugae
MAGFFAAACLSGCVIGNTDGYRDAAQLQKTADQALKTCGAGKVKSVSAGSFACVAAGEQN

SEQ ID NO: 6448 - protein, 324 aa, Chromobacterium substugae
MAGATDSRVAVRLLNAADAEAYRAVRIAAATHDPAAIHADAAEIAALSDSEIAGQITAGDTQRAVGAFIGGELAGVAALRRDGRAKIRHRATVQGVFTLPAHRGQGVARALLQALLDEAATLPGLLSLELAVHAENAPAKALYQAFGFRRVGLIPGAVMLDGRCLDEVLMQRPLVFSSSAAAPASIPNRDDYALIEAAPDVDTYRRLRAESGLSPKTEEAARLGLAGTAYAVQVRCGEEVVGMGRLIGDGGSFYQVVDIAVLPAHQGRGLGKRIMAAIRGHIDRELPVSAYISLIADGDAKHLYAQFGFEPTAPRSEGMALFKR

SEQ ID NO: 6449 - protein, 43 aa, Chromobacterium substugae
MFFGKGRFDDAIEVTPAMFDAMEAQFEPATADELNQAAAVATS

SEQ ID NO: 6450 - protein, 200 aa, Chromobacterium substugae
MSAETLRHQVLQAATALLLNDGYPALSIEAVAKRAGVAKKTVYRFADNREQLLAAIVDDWTAGLARAVETPEDEGKDLPHALEALLLAIAERVLSAEAVGMFKLLSNDFPGREQALESYAQHGIRRSAALLADWLAERQRRGQLRVDHPASCAELLLAMAIAEPLRQRVLGLAAPGVDAALQGWIRAAARLGYQGMRSAD

SEQ ID NO: 6451 - protein, 223 aa, Chromobacterium substugae
MNAQNRISSHDELLSSRPLPLETGIRRLDDGRLLVAVRTELPGCAGRMLEWWFKFFETTQHIRWWHPHDHLRMHGWDGRWKRGESYIGACVRAEESLGDFPPVTATLKFHESEDFFSPDALAQARREQRVSGVVCARIAFGDEPRLAADGDPLDGEMIHLARDKPQGAVLRSRFVLGGEAPVPDELGLGLMQHCYNEFSSLARFLPSLYYGEHANGEKGPLAW

SEQ ID NO: 6452 - protein, 46 aa, Chromobacterium substugae
MAIGIPACDGHSVSSLYSKTGYKIAWGYSMFCRQSKPSKKKPLAGI

SEQ ID NO: 6453 - protein, 248 aa, Chromobacterium substugae
MESKKLVCGVMALVIAASSMSGCSSAKKPRKNKYLAQASSAAAIKNIDIYYHKADYGVMDLGGSSGLQVGGLFGVVGLLASLGAEAASRATAKDRTVARSEEFSKLMNSLDGDNDIDLAQAKKLADMLTASGRTVRLVEIKRPQAERLLLDQTPNLPDSDENAVLVLRTTLGYGAESATASYKSIVVTEYVLQKINGEVVHRGKQTIHDDGQTYMTFSGLKEAYVETHQALGKDAQAIADRIFAAVVK

SEQ ID NO: 6454 - protein, 378 aa, Chromobacterium substugae
MKQVLNHARIVLADRVIENGALEIENGLIAAIHEQPLPEGEDLAGALLLPGLVEIHTDNLEKHLMPRNGVLWPTLPAVITHDAQCVAAGITTVLDALSVGDLEGDSVRLDTLHSAFAAINQGMDEGALRAEHFFHLRCELAYPGLLAELEPLIAHPAVKLVSVMDHTPGQRQYRDLEQYKKYYGKKKVGWNEDTFLAAVEERKAKQAEFASRHKQAVVEMAKARGIALASHDDTDAAHIDEALRDGVAISEFPTTLEAAQAARAHGLQTVMGAPNVVRGGSHSGNVAALELARAGLLDILSSDYVPTSLLHGAWLLHSQAGWGLPRAVATVSLNPARSVGLNDRGDIAVGQRADLVAMTVRGDVPLVRKVWNGGLRVF

SEQ ID NO: 6455 - protein, 235 aa, Chromobacterium substugae
MNLLIDAQNLSKTFTLHQQGGLRLPVLTDVSLQAAAGECVALAGPSGAGKSTLLKALYANYLVDGGRIGVFHQGAWVDMARALPHEIAAVRHHTLGYVSQFLRVIPRVSALDIVAEPLREWGAADAEARLAAGEWLARLNIAERLWSLPPATFSGGEQQRVNIARGMIAPRPILLLDEPTASLDAANRDVVVQLMREALARGAALVGIFHDAPTRDAIASRVFQVPLAQQTETAA

SEQ ID NO: 6456 - protein, 257 aa, Chromobacterium substugae
MMAPILTVSGLSKDYGNGQGCFDVNFELYPGEVLCIVGESGSGKSTLLSTLAGRLAADAGSVRFADRDGAQHELVCLPEAERRRLARSEWGFVTQHARDGLRMGVSAGANVSERLMALGQRHYGRLRQTAGDWLEKVEIDRARLDDKPSAFSGGMQQRLQIARNLVTQPRLVFMDEPTGGLDVSVQARFLDLTRRLVRDAGIAVIMVTHDLGVARLLAQRTLVMQKGRVVEAGLTDQILDDPQHPYSQLLVSSILQA

SEQ ID NO: 6457 - protein, 280 aa, Chromobacterium substugae
MTDARNDRYNFGFLDENTKRMLRRGLLKAVAIPGYQVPFGSREMPLPYGWGTGGIQVTASVIGRDDVLKVIDQGADDTTNAVNIRRFFGRVAGVATTTATRDATLIQTRHRIPETPLKPGQIMIFQVPEPEPLRTLEASEVETRKLHAHQEYGLMHVKLYEDIARFGHIATSYDYPVMVNGRYLASPSPIPKFDNPKLDRSPALLLFGAGREKRLYAIPPYTKVESLAFDDHPFTAQSWQQGCALCGSHDSYLDEIVTDDAGSRLFVCSDTDYCQRETQA

SEQ ID NO: 6458 - protein, 361 aa, Chromobacterium substugae
MYVAVKGGETAIARSWDLLAAARRGDEAAPELSIAQIRQQLRLAVARVMQEGSLYDEELAALALKQASGDSIEAVFLLRAFRTTLPRFGQTLPLNTAAMRVRRRVSGTFKDVPGGQILGPTADYTQRLLDFGLMETSQKVELEQAATPLPDALPSVLQLLDSEGLIETDLPADGDPEPVDLTREPLMFPAGRPARLQNLARGDEGWLLGLAYSTQRGYAESHPFAGEIRMGEVSVMVCPEELGFEIDIGEITLTECQMINQFAGSKSAPPQFTRGYGLSFGEAERKAMAMALVDRSLRAEELGETAHAPAQQPEFVLYHSDNVEASGFVQHLKLPHYVDFQAELALIRQLRAAADQEKADD

SEQ ID NO: 6459 - protein, 190 aa, Chromobacterium substugae
MLTAFAQPVDDAQQTFRILLSAMAEPLLPRALPVLPPALPGLQAGIAALLYTLADQDVSVWLPALPDETVSSLRFHTGMRMTDLPEQADFIVIAAGMPLPDLMSLKAGSAEYPDRSATLLIEVASFAEDQVEGSGPGFAMPRRFGAAGLPSGFWAEWQRNHARFPLGVDAMLISDTHIAGLPRSARIREG

SEQ ID NO: 6460 - protein, 144 aa, Chromobacterium substugae
MDTSTRQRWLGALANSPMERLQALLPPALPAAPRWLRRAETGLMMLQGRSGGSGARFNLGEISVSRASCEIDGHIGHGWVRGGDGRHAELIAQADALLQNPARHAELMAAWIAPLEAELAERRAARSREAAASKVEFFTMVRGE

SEQ ID NO: 6461 - protein, 240 aa, Chromobacterium substugae
MIERGSGVAVWRQIEDSLAAQIASGALQAGAQLPTELQLAERFAVNRHTIRRAVATLVERGLLRVEQGRGTFVQDNAIDYAISKRTRFTQNMARQNLSSDIDILLSDTVPANAELAGLLEVAVGDEVFRIKTLSRVEARVVDCATLFFPAARFAGLPQVYQRQRSVTRALREFGIDDYTRRFTRVTARLPDAETVDYLGIPKNRPVLHVKSLNVDLDGRPVQYGITCFNGDLVQLVMEDD

SEQ ID NO: 6462 - protein, 230 aa, Chromobacterium substugae
MRCALYYAPRPDSGLWRAGSLWLGRDAASGQSLAQPALDGVDPATLADLTAAAARYGWHATLKAPFELAPSMDAAGLLAAAARLASGFEPFALTLRVEWLDDFLALRPAAASAELEELAAACTTAMAPWADPGQALKPRPGLDARQQSLYRRWGYPFVFEQFRFHMTLSAGLARESALAASLERGARRHFAGLGPVEVDGIALFAEMTAGGPFRYLAHCGFDGKVARYGG

SEQ ID NO: 6463 - protein, 187 aa, Chromobacterium substugae
MAAETGALWYVIGPSGAGKDSLLAYVRQRVPADGGLMFAHRYITRPADAGGENHVALSPEEFDQRERAGCFALAWRRNGLAYGLGAEVGLWLAQGLDVVVNGSRSSLPLAVRRFPGLRPLWITASPEVLAARLRARGREGEEAIARRLAEAASFVPPAGCAVLVNDGALELAGETLLGWLRAQRRVL

SEQ ID NO: 6464 - protein, 180 aa, Chromobacterium substugae
MAEIILYQNSNFGGRSIDLTSNSANLGTDYNFNDQTSSIRVVSGTWLLYKDAGFASTCWILTQGEYPSPGTWGGSNDSISSVRALPGNYGDHYAILFRDSDYGGQMVSFTQSQANFNDIGFNDAASSAIVLGGSWSMYKDINFSGQSWIIASNKGPGNDGRYPSYSGFWDNDAVSSIQPL

SEQ ID NO: 6465 - protein, 544 aa, Chromobacterium substugae
MSLLQNIKVGPRLAASFMLLLAILLAVSASVWNGLSSIETSTHRIVGDDAGKLQLAAELDRHSQNAALLLLQIISTPDRPQRVPLYAAMDEANRRANQTFQRLKDLPWTPEQSDVLRQLSELRARYTAAFSNTVDLVESDDPAALARQYAGQTQPALQQLLAATTALASAQQNDMNRELADVLALMGNTRLLLLAFSAAAAVAGVLLSWRVTRSITRPLEHSVARMGAMAQGDLRGEVQIVGSDETALMLGRMAQMQSHLATLVRELRGSADIVAATAASTQSGAAEVAGGVERQQAEIHQINAVVEDFAGKLRSAAQTASQAQERAKSAAALALRGQSLIQTASGEITLIAGQIQGSAAAVDALRQRANSMRGMIESVTDIAEQTNMLALNAAIEAARAGEMGRGFAVVADEVRRLADRTAQATREISEVISAIDDQTTQAMRQIEQGQTEMARGVDMIRGIVDPLTELKDGATATSSELDRLAVNIAEQVRESQSIARSVAAIAQSADESLHATHSARQNSARLLTVSGALQEQMRRFVLDS

SEQ ID NO: 6466 - protein, 355 aa, Chromobacterium substugae
MSAADSLHWPISRFSRAVDAYHRLPSPRANPARWLDALRQAITRHGVDLVLPTCEETFYLSSGRDTLPCRVLTERFDLMRQLHHKHRFALMTRGWTAQAPETRLLESPDAVMRMRHAAPGWVFKPAYSRFASRALLRPSPAQLARARPSASRPWVAQRYMPGREHCSYSVLAAGRVTAHACYHPRYRAGKAAGVWFEPTDPAPIRAFIERFGAETGYSGQVGFDFIETADGACHVLECNPRATSGVHLFSDQPQQLVAALLDDIPPGEVLRPAASPKMVAAAMLLFAARRHGWRREFWTDFGRADDVLARRDEPWLLPAQCLGLLEIAGRGLLRGRGLLAASTADIEWNGQALDE

SEQ ID NO: 6467 - protein, 553 aa, Chromobacterium substugae
MAERKSHQGDPSQYILYSKGLRYLFDSIVTRLLALALLIVLTGSISRYYTLSNFLYEDLSKVVENQQLTLATYVAHDINGKVAQREDLLIHLAAVLPPQLLKRPPQLRDWLKEHYQYQPLFSIGLFVVRPDGSAIADYPLNPRRMTVNYRDRDYIRAALQGDPYIGRAVVGLTSKIPVLPMGAPIYGADRKVKAVLVGVTALDAPNFLDLLQHTHIGGHIDSFLLVSPRDKQFVSSSQPDMVLKPLPRPGVNPLHDRAMAGFRGAGITVNAKGVEEVSAIASVPRAGWFVVARLPSSEAFATVERVKGFTLRNTIAAMVVFALICCGGLYIVLRPLFQAARHADRMTRGELPLEPMPIRRNDEVGHLIAAFNRLLHKLNDQKAELARMAHHDSLTGLPNRSLLSDRLHMALAQAQRKRSAVALLFMDLDGFKLINDTLGHKAGDKVLWQVAQRLSNIVRQTDTLARIGGDEFVLLLSDLDDGAEGIANTVAQKCIEAFDAPFQTAGASCKLGISIGIALGDGLSTSDSLLQAADQAMYLVKKTGRSGSETIRI

SEQ ID NO: 6468 - protein, 1053 aa, Chromobacterium substugae
MSFRLKTILGIALIELMMLCILLYFGLGLLRDTSVREMIKRRQIIAEQFAQANQNAVLSTDLATLQSAAEQMVKSSDILYARVFDGHDRLLAEAGDPRSLALHDSAKQDSATQNIDQLSPDQPLTITRNIEIGGIHYGRVELGTSVANHRQLMQKALQNGLMLALSELALSALFSLLLGTYLTRQLESLQQASQKMAAGELGYQVEVQGKDELARTAEMFNRMSTQLALDRSQLETALNRAEESRKDLQRQEDLLDAINYMQSLFIGKVHPETLFSYARDILLLWFNAEHGFICELNNQASQPQFLPITPALSPPPQMDTDELLQCCLYQEQEQLLGLQQSSSGALSQGYYFLSIPIILASSVIGSFTLFFPRPVDPDHGNKLPAPLMKTLGQLMQASQAQRKLEQTQLQLSRQQILLSAVIDTSIDGIATLDRLGLFTSANKVTEYMFGLPRGSLIGTALLDCLEPSSRRALQPLLLGDDIKLSSLLQLTAKRADGTPFPIELAITHMPDTGKDYYNLNIRDITELKTAESELRRAKDKADAANQAKSSFLATISHEIRTPLNGVLGMLELLKLSQLDSGQQDMVDTARDSAHTLLLLIDDVLDFTKIEANQLELVKTPTDIWPLLQRVLSRYAHTAEQKDLNFDLQIDPLLAPTLLLDPLRLRQILQNFLSNAIKFTATGAITLRVQVEKEATGWQNLIFDVIDTGIGIPPEQLQTLFQPFSQGDSATSRRYGGTGLGLAISRRLAELMGGEVAIDSELGHGTRVSLHLCVEVAERKAPPPLALLPSAAPNAEKRILLVEDNPTNLKLATKQLEKLGYRPDTAEDGAQAFEKWRRDHYHLVMTDCLMPNIGGFELARLIRSYEAEHPVRPRSAIIACTANAAPEELQKTRDAGMNDYLIKPFALETLSAALEKWLQGAPPSVSPPAAGAQPEGPAPLDLLMLRTRCGESGKSESQLLGEFLKNTRRHTSYIRNAIISDNLPLIALTTRDIQTDATPIGAHNIAEAARHLEQAAEAEQKETIPRLVLQLEAACLEVEQWLTKRRAPHELSHG

SEQ ID NO: 6469 - protein, 202 aa, Chromobacterium substugae
MAKGQYDIVYFNPLHYVVFHDSAGYQALAREKDTRLVGLIVVRKDSPIQNVRQLEGKTLALPAPESFAASVLPQAELESMGVHVNVSYVGSHDSVYLAVRQGLYSAGGGINRTWSQQPDAVRNALRILWQTPPHTPHPFATRPGLPSTQRQCLLRTLTHLQDTPEGLALLQQVQLKPLTAARDEDWDDIRRLGIHYQAPGEQ

SEQ ID NO: 6470 - protein, 339 aa, Chromobacterium substugae
MKKQLAVAIGLAVSGLLSPLAYAKTTLTVYTALEADQVKDYKEAFEKANPDIDIRWVRESTGIITAKLLSEKNHPQADAVWGLAATSLMILDQQGMLQAYAPKGVDKLSPQFVDKAKPPKWTGMDVWAATICFNTVEAAKKNLPKPESWADLTKPVYKGQIVMPHPASSGTGYLDVSAWLQMMGEKPGWDYMDKLHLNMAQYVHSGSKPKMAATGEFPIGISFEYRGAELKAQGAPIDLIYPKEGLGWDLEATAIVKGTKNLEAAKKLADFSASLPAMRLYEKNYAVLAMPGVAKQNPYIPADYAKRLSKNNFAWAAKNRDAILQEWSRRYESKAAAKN

SEQ ID NO: 6471 - protein, 366 aa, Chromobacterium substugae
MKPVDSLQGLSEHLSVHGLSRRFGGFAALDAVSLSIRKGEFVCLLGPSGCGKTTLLRLIAGLDAPDDGRILLSGRDITDAAPAKRDYGIVFQSYALFPNLTVADNIAYGLTPRRDKARHEPRVRELLDVVGLPGAERKYPSQLSGGQQQRVALARALATAPGLLLLDEPLSALDARVRERLRDELKSLQKRLGVTTLMVTHDQEEALAIADRVVVMNAGRVEQVGTPAQIYRQPASRFVAQFVGAANWLPAQRQGSREARVGACALRLETPLPEGGPLTLFLRPEDILVKDRWEPRPNTLLARVEDVSFGGAMTRVRLRPEGMPGQTLLAELCPSMLRRQPLAPGEIVPVELPAALLRAYAGEAAC

SEQ ID NO: 6472 - protein, 567 aa, Chromobacterium substugae
MLSLALRSVRLAAGRADGEKLAAAALVWTLAALLALALGLPLLFILGKAFVTVDGVFAGLANFAQVLDSPGLMRAAWHSLLLALTVSALTLPPAFAFGWCLSRSRAWGRGLFRQIALAPLLAPSLMPAISLVYLFGNQGLLKGWLGGAGIYGFWGVALGEVFYTFPYALMIIATALAAADARLYEAARTLGAGPWRQFFTITLPGARYGLVSAALVVFTLVVTDFGVPKVVGGDYNVLAVEAFKQVVGQQNFPRGAVVGLMLLLPAVLSFFIERALARRQQAALTARAVLLVPAPSLPRDAAATALLAVVSAFLLALLGVGVAASFLKYWPYDLSFTLAHYRFDHVDGGGWDAYFNSLKLGGAVALLGSALVFLGAYVCEKQQAAPLGRGLLRFFAMLPMAVPGLVLGLGYVFFFNHPANPLNALYGGMALMAVCTIAHFYTTAHLTVATALKQLDGEFEAVAASLKVPFWTTLRRVTLPVALPALLDVARFLFVSAMTTLSALVFIISPENSLAAVSIITMDDAGDTAAAAAMATLIVLTSGSVSLLSLGLEKALARRSRRWREPG

SEQ ID NO: 6473 - protein, 291 aa, Chromobacterium substugae
MTRPLSCLVRAAALALPLALAACASLDSAKFAALSEAARQMDDGAASSFAALEQSARDSAVLTAPDRKVGLQGFPLLNAQGQPYDLSGQLDKVKASLDLLACYSAALAQLAAAGNPADIDKSSQDLAASLRQLQGSGLSGAAANGLATAIDAFGQAKLASQRKDSLRAVMDRAQPGLEALAQEMGRVQQDLQLYLTDISLRYLSFVDRDGFRPAFGSWARYQGDLQVAAQLADFDRQHRALDLIGKESQAFPILHRQLRQSLDDPGARQDRLREFVDEAKRLRSLYRSLPG

SEQ ID NO: 6474 - protein, 108 aa, Chromobacterium substugae
MNNHDLAERLTGLASRFNNLMIATTGDISRQCGDLQATLAGQSMAAISRDLDAAAAQYADAVAALQDATQAADSAAQQLQQTSNSIAFVAKAIQLAGKASGLAAPLLA

SEQ ID NO: 6475 - protein, 57 aa, Chromobacterium substugae
MIWRRCWLYRLPLLGRQIFHRLSLNIGQPPRFSKGRKSLLKNLRAARGAGAGGRRTT

SEQ ID NO: 6476 - protein, 1077 aa, Chromobacterium substugae
MIDTSEAKLGLGKGKPSSSAWWALFGLFIALCGLAVSLFLNEVHTSRFQAMFFSRAARHATFQVEPGRSKDMRFPERGGPYDLRMGYSDLPRYLDRLQNRGFAIIGQARQSPDMIRLVDSGVTGPLLPLGLFPPYREKDQSGLLVYDGYGRAIYQSLYPQRVYRDFDALPRLLVSGLLYIENHSLLDDSNPQQNPAVEWSRFGKALADEGLHLLRPGYHSAGASTLATQIEKFRHSPGGRTGTPKEKLRQMLSASVRAYHGGEDTSAVRRQLVVEYLNTVPLAARAGFGEISGIGDGMWAWYGRSFDEVNRTLASDAPLSVGEQATVFKEAFSLMISQRSPSYFLNGDMKVLEALTDSYLRLMARDKVITPELRDAALRVSLRQQREKASFVSKSLVERKGANAVRVKLAGMLGMPRMYDLDHLDLTVNSTLDSQLQQEVTDKLLKLRDPDYAKSVGLGDKFLLQQGSPGGVTYSFTLIERTPVGNQVRVQADNFDQPFDINEGTKLDLGSTAKLRTLVTYLEVIADLHRQYAGLDKAELAAIRPTEHESVLRRWAIDYLKQNDDRSLSAMLAASMERKYSANPGESFFTGGGRHTFENFEKSDNSRILTLREATQHSVNLVYIRLMRDVAHYYMYPAGYDREVMGDKDDPRRLAYLQRFADREGKTFMAGFYRKYHGKSASEIDAALVEKARRSAKRLAVIFRSVHPTEGQAAMAAFIARYQTPPSKMDPKNLAKLYDELGPDRFNLADRGYLAGVHPLELWMVAYLHAHPKAGWSDMVQASAAQRQEVYQWLFNSKHKGGQDNRIRQIQEIDAFRQIHAAWKRMGYPFDSLVPSYATALGASADRPAALAELMGIISNDGVRLPTVYIDKLHFASATPYDTTLAQAPARGVRVLPPEIPQLVRQVLSEVVDKGTAHRAAGAFDRKGEHVLIGGKTGTGDNRFKTFSRGGGLTSARVVSRSGAFVFYIGDHYFGTIIAYVAGPKAADYKFTSALPVQVLKVLAPTLAPRLDLTPRGTSQGADSVAEGTPDLGLPPGTPLCLVPSLGGMCQLLKQPQMDALPQRRREADWRADGREG

SEQ ID NO: 6477 - protein, 257 aa, Chromobacterium substugae
MEKIARWRDEIRPATMDDLLAGIAPLMPVLDLIPNAAIFIKDRQARYLCANQTLAQRCGLKDLPPLLGKTSAEVFPIQLGQVYTAQDIKVLQDGQVLESQLELHLFKSREPGWCLTYKWPLYNRQEEIIGLIGISLDLQSASKTHPAYTRLAAVDEFIRRHFSQPISMAELTAIAGLSIAQLERYCKKVFHLSPRQMILKARLEHAHRLLHEDMAITEVALSCGYTDHSAFSRQFKALTGLTPRQYRQELGHGSGAE

SEQ ID NO: 6478 - protein, 312 aa, Chromobacterium substugae
MDKRIKQIEVIDSHTGGEPTRLVLSGFPALAGATMADQRDELRERHDPWRRACLLEPRGSDVLVGALYCEPVSPGATCGVIFFNNAGYLGMCGHGTIGLIASLHYLGRIAPGTHQIDTPVGPVDAVLHENGAVTLRNVPAYRYRRRASVQVPGHGTVIGDIAWGGNWFFLVAEHGLSMRLDNVEALSAFSCATMQALEEQGVTGADGARIDHVELFADDEHADSRNFVMCPGKAYDRSPCGTGTSAKLACLAADGKLAEGEEWVQAGITGSRFIGRYQRESDFIRPYITGRAHVTARATLLIDEEDPFAWGI

SEQ ID NO: 6479 - protein, 315 aa, Chromobacterium substugae
MSDNIFTGCIPALMTPCTADRQPDFDALVAKGKELVSLGMSAVVYCGSMGDWPLLSEAQRQEGVARLVAAGVPTIVGTGAVNTREAVFHAAHAAQVGAHGLMVIPRVLSRGASPAAQKAHFSAILAAAPKLPAVIYNSPYYGFATRADLFFELRRAYPNLIGFKEFGGAADMRYAAEHITSQDDEVTLMVGVDTQVVHGFVNCNATGAITGIGNALPREVLHLVALSRAAARGDAVARRRAGELESALAVLSSFDEGCDLVLYYKHLMVLNGDKEYALHFNESDALSAAQRRYAETQYALFREWYRNWSAEQNVA

SEQ ID NO: 6480 - protein, 523 aa, Chromobacterium substugae
MNLTGMMLIGGRAVAGRRETIRAIDPSTDQALEPGYPGADREQVEQACALAWEAFDAYRDTAPETRARFLETIADEMEALGDALIERAMAETGLPRARLQGERGRTCGQLRLFACTLRAGEWLDARVDPAMPQRQPLPRADLRQRQVALGPVAVFGASNFPLAFSVAGGDTASALAAGCPVIVKAHSAHPGVSELAGRAIARAAEKCGLPAGVFALLFGAGREAGQALVADPRVKAVGFTGSRGGGLALCRLAQSRPEPIPVYAEMSSTNPVFLLPAALRARGEALAQGFVASLTLGAGQFCTNPGLIIAEQGPALDGFIAAASALLRQSPAQTMLTPGIFRAYQAGVDALSGHARLAAAGLPATGPNQCQAQLWLTDAQAYLANPALRAEVFGAAALIVQCHDAREFRQLAEQLEGQLTATLQLDEGDLDLAHALLPTLERKAGRILANGWPTGVEVCDAMVHGGPYPATSDARATSVGTAAIQRFLRPVCYQDLPDALLPQALKQANPLALRRLLDGGREG

SEQ ID NO: 6481 - protein, 419 aa, Chromobacterium substugae
MAPALAPGAAVIVVGAGIVGIATALQLRLAGFEVTLLDRGEPAMETSYGNAGAFAVSDVIPLAEPGVLRKVPGWMLDPLGPLALRWRYLPTLAPWLLRFLAASRPRRVAELTQALAALLGRVNDDYAALIARAGLGHLWRRHGNLTLYRSREEFDAAAPAWDAKRRHGVRWQVLDREALEEEEGVVGEEWRYAVKVPAWSHVDDPYVFSRGLFDAFLREGGRFVRDEALATATEAGRVAGVETAGNGRLRADAVVIACGVWSDRFVKQHQYRVPLESERGYHVNLPKAGVALRHFIQCASESFVILPMANGGLRLAGTVELAHRDAPPDWRRARILLDKARRIVGDFSTEDMTVWMGNRPSLPDTLPIIGPAPQPGLWFATGHGHLGLTLAATTGALLRDMLQGRTPALDMQPYRLSRF

SEQ ID NO: 6482 - protein, 382 aa, Chromobacterium substugae
MAWNKLFADVNWVVALGGMMAPFAMAAAHADTVVKIGFASPLSGPQAHYGKDNENAAKMAVDDVNAKGLVVGGQKIQFELVSEDDQADPRIGTQAAQRLVDAGVKAVIGHFNSGVSIPASRIYSEAGIPQLSVATNPAYTQQGYKTTFRLVGSDSQIGGALGQFAVKTMKVKTIVAIDDRTAYGQGIADEFVKAVAANGGKVTRREFTTDKATDFTAILTSLKAVNPDVVFYGGADAQAAPMVKQMKRLGLKAKLMGGDMLNTPTFIQLAGADAAGHYSAVAGGVLSARPAGKAFERRYKARFHQDVVLLGPQFYDGVMLVAAAMKQAGSVEPAKYLPKLAAIRYSGVTADFAFAPNGNLLKAPVTLSTVKNNAWAVETVVR

SEQ ID NO: 6483 - protein, 158 aa, Chromobacterium substugae
MKITANTAVTLRMKVTDSQGLVYDDGKHPIAYLHGDYDNLFPKLEAALEGQEPGFQITVDLAAEDAFGERDEALATTMAKADFPPGIKVGGQIQRPGPDGQPRYYFVTKIKGPTVLLDGNHPLCGKNLRFALKVVDVREATAEEIAHQHVHGEHGHQH

SEQ ID NO: 6484 - protein, 635 aa, Chromobacterium substugae
MNKEWQLPPAYESEMQNSYTIAESLIGNFAEGRFSPPDLLITSVTEYFCIQDDAENALKRFTTHLNGSHEDFDASDDPRIQAILVIGIVAAWASSETENRYTAFRALAKNSWWVEHLWTEVALVVALKNDAFKEALLNLAEQHFADAEKKLLQKYGVDPSHPITLDEIWYGHARESRTDDSSWPWVKLLAKLDLNTLFKWMNSTQSLVLINRVLDSPEFYRNYDLWEQFTYRSPTSFQSDGSWDGALLLPSLLRHGSMQLIHIADGHGHPHSVLEPHVESLLASFVDTIAKRSDVEGLFKRWGTWLTCQYLNFPDNNSGQKRSLSSQDILWALADKLPHPCSPTISEQLNFSWEPWVYQSMLALLHSNQPDRFPAPDVRDFINEWSLTPTEWNSSKGQSIRSHVSEYHATQPNNYACRVLGYSVALNDNFTSHWLNMWNSSVALREILEFRPIYKISAEWQPSDASRLMRTLVDVGLGILDCTANSQETHNPEILNQSAALFQALWEATTEMLSIDFYGNDFWPIMQQHLVIRRLQWTVKAKNANDDHYSIWLDKTAYPTSREILALVASNPCSFISLLPLLVQNQIPKEYLKDLLNQAEIDLTSLASSAARYESGPKMKFKIHPGHVSLIEELA

SEQ ID NO: 6485 - protein, 566 aa, Chromobacterium substugae
MESNESSNPYSKLTDGFEHAVVHVAVVVPPRSTSERPPLRLLFASVWLLASGRQAPLRPAKPYLKKFKEEGAIAVDRIVMTAEEAIRWYRTASDELGTPIPLRDARKDSDGVPLSAGRLSDFPTWPVLGVPLESDDITLKSERPSIPFRNLGIIRYSRRISDSQEWPSFLDQDGQSKNCQEAFKFLEHHMHVDFREYPEYLGGMALAVPDCDVHSVRQFVDPKEDGSESLYIHLKPHPGRKLEGLSLTSMEGQEGILTSFDTVPVPEDGLVVIERPSSIHGSGLILTHTERGVLLQTPMRQFIRQMKTSIEVVEQRIKVSVPETDKKKSAVNEYVTDKKTLASSQTLGKAPNTTNAFQRLLDAKNERLLNHSATVYEQTWFTANQRKEALEHIRKKFKHAHSSIFIADPYFSANQIPQYLFAIERDEIKIQILTSSSAFKQINEATTGTEIDREATQDTHQKLLENLAIFQNSHKNNIEIKVANTENSLFHDRFIAIDSRVWMIGSSLNSIGIRPTLIMRIPHGEKILDHLLRLYNNALPLEDFKVPRKALEKPCVHCGRDVKDAK

SEQ ID NO: 6486 - protein, 226 aa, Chromobacterium substugae
MIAATRIRYGARRIYVLLRREGWRIHHKKTYRIYCEEGLNLRRKRPKRRVAAAHRHARPAVSNLNACWSMDFVADQLFNGQKIRALTVVDNFSRESLAITVDFALKAADVVATMQHVQALRGTPQRIQVDNGSEFISLALDQWAYEQGVTLDFSRPGKPTDNAFIESFHGSLRDECLNVHWFLSLDDAREKIERWRQDYNEFRPHSSLGDQTPSEFRLAHLEAGNL

SEQ ID NO: 6487 - protein, 106 aa, Chromobacterium substugae
MKPARKRELANFLIDAYRVSIRRATAVIQLRQATYFYRPHPRDDRAERQRIREIAATRIRYGARRIYVLLRREGWRIHHKKTYRIYCEEIDPVGLLVMDPPAFAPQ

SEQ ID NO: 6488 - protein, 88 aa, Chromobacterium substugae; identical to SEQ ID NO: 5797

SEQ ID NO: 6489 - protein, 156 aa, Chromobacterium substugae
MNSITFDGRLAADAELRYTPSGEPVLSFRVASDIGFGERKSTNWFSCQVWGKRGESLKNYLAKGQQVTVYGQLTLREWQDKDGNKRVSPDVRVNELSLQGGRNEMGGGASSGMGGGMDDGYGYNAPAQRQEAPAAPRRQEPKAAPRMDDMDDDIPF

SEQ ID NO: 6490 - protein, 41 aa, Chromobacterium substugae
MRPTGLVTIGKPMRRQAAAPPPCNAAFAARAKQFELIRRIE

SEQ ID NO: 6491 - protein, 219 aa, Chromobacterium substugae
MNKNAVVAAVVAVSLAGCANMSDTQKGVGGGAAIGAGVGAAIGALTAGGHGGRSAATGAAIGGLLGAGGGYLWSQHMQKQKEAMEQATKGTGIGVSQTADNRLKINIPSDASFDTGSYALKPSLKPVLDKLAATLQQNPVTSVNIIGHTDNTGSDAINNPLSVNRAKATQGYIASRGVDINRIGIDGRGSREPVADNGTVSGRAMNRRVEIFVAEPAQK

SEQ ID NO: 6492 - protein, 453 aa, Chromobacterium substugae
MNATELRASLGLAGIYALRMLGMFLILPVFALYANTLKGADNHTLIGIALGSYGLTQAILQLPLGMLSDKIGRKKVIYGGLLLFAVGSFVAAGAHDIATLTLGRVIQGAGAISAAITALLADLTREENRTKAMAMIGMSIGTTFAVSLVAGPVLAKYIGVNGIFALTGFLSLAALIGVWLVIPDPTVSRFHSDTEANAKRLPTVLKDSQLLRLNYGIFALHAAQMAMFVTIPFALIKTGHLDKSQHWQVYLPVTLIGFILMVPAIIYGEKKARLKPVFIGAIALMTAAQLGMALALDSFWQIAAWLSLYFIAFNILEATLPSLISKIAPADAKGTAIGVYNTSQSFGLFLGAAAGGWLYSHYGPAGVFGFTTLLMLSWLAWSLGMQPPKAVRSVMLHIGESWQGDAAALSRELAGVAGVHEASVLLTDRVAYLKVSQQQWDEAEVKRLIDATF

SEQ ID NO: 6493 - protein, 943 aa, Chromobacterium substugae
MDSIRIRGARTHNLKNVNLDLPRNQLIVITGLSGSGKSSLAFDTLYAEGQRRYVESLSAYARQFLQLMEKPDVDLIEGLSPAISIEQKATSHNPRSTVGTVTEIHDYLRLLFARVGDPHCPEHGVPLSSQTVSQMVDHVLALPEETRVMILAPVIVGRKGENLDLFDDLRAQGFVRVRVDGEVYELDAVPKLDKNKKHTVEVVIDRLKVRADMQQRLAESFETALRHAEGRAIAVEMDGGKEHWFSAKFACPVCSYSLPELEPRLFSFNNPMGACPKCDGLGEITFFDPRRVVAHPELSLASGAIKGWDKRNQFYYQMLLALGEHYGFSVNDLAFEDLPEKVRNVVLHGSGRDSIEFSYMSEKGAKFTRAHPFEGIIPNLERRYRETDSMAVREELAKYQNNQACPHCSGSRLRLEARHVFIGTRTLHEINQLPLKETADFFEGLEFTGQKQAVAEKIVKEIRERVSFLNNVGLDYLNLSRSADTLSGGEAQRIRLASQIGSGLTGVMYVLDEPSIGLHQRDNDRLLGTLKRLRDLGNSVIVVEHDEDAIREADYLVDMGPGAGEHGGEVLVAGTPADVAASENSVTGAFLSGRRKIALPGGRRELGEERMLRLIGATGNNLKDVTLDLPLGGLVCITGVSGSGKSTLINDTLYKIAARDLNGASEEPSPYREIKGLDQLDKVINVDQSPIGRTPRSNPATYTGLFTPIRELFSGVPLARERGYGPGRFSFNVKGGRCEACQGDGVIKVEMHFLPDIYVPCDVCHGKRYNRETLEVQYKGKSIQEVLEMTVEQALEFFAVVPPVARKLKTLMDVGLGYIRLGQSATTLSGGEAQRVKLGLELSKRDTGRTLYILDEPTTGLHFHDIDLLLQVLHRLRESGNTVVVIEHNLDVIKTADWLIDLGPEGGAGGGQILVSGTPEQVAAHPASHTGRYLAPLLERDKK

SEQ ID NO: 6494 - protein, 148 aa, Chromobacterium substugae
MLSLGKIDHIHIRVKDVAAALKWYQRVLGLSQDARYKTDGEHNNAMLANASGNVRLAISEDADAAASGAQGAVAFVVSGQEFVEWIDQLAGERVTNREGQTIARDSVHDHRFFCALSFVDPFGNPFEIVSYDHTWLVGKLKLGGQLAV

SEQ ID NO: 6495 - protein, 102 aa, Chromobacterium substugae
MGHYLVDNPAPEDVAALPGLTLLEFGVDWCPHCQGAQPLLAQFLSAHPGLRHLALEDGKGKRLGRVFRVKLWPSFILLRDGVELARAARPQDAAELEALLAP

SEQ ID NO: 6496 - protein, 126 aa, Chromobacterium substugae
MFELGKSYTREEIHAVVGGNKHSYLPRKKGKVVAACLRPDLNPDAPHVILCNSCPPERTAGEQLARQGGAIPVFLKQSASSWAYQGMFRVVGNETHPQACAPHAARSAWTAGQIKQVLTLEKQVQF

SEQ ID NO: 6497 - protein, 178 aa, Chromobacterium substugae
MTDAKRILIVGCSCSGKTTFADKLSRATGIPAADLDPLYWGPGWTPRPAETFLQSVRHAADQPNWIISGNYSAARHLLWTRATDIIWLDYDFPLVFFRAIRRTLARCISRRELWNGNRESFRQSFLSRDSILRWVASSHGRLRADFGHAKAQADYPQLRWRHFRSPAEAERFLRQAAV

SEQ ID NO: 6498 - protein, 381 aa, Chromobacterium substugae
MTDIQQPGAADHPTAHWQEAGAERSARWRSEAGLPPPKRIVIADDSLSADAAYKLACEGGTLLWRGDYQNARQLLQALARRVDRKGAKPGATPLESFHLHRQAQGRRAQILSRLVLPLDADYAIPLRRAPDLRQACREAYGEGGEASLVSLRELLGLIGAHEWRKKGVEVKALAARIHPHYGVFAPIRGEYVDLAADAPLPGAELAFDIGTGSGVLAALLAKRGVARVVATDQDARALACAADNLQRLQLDGRVELRRANLFPEGRAQLAVCNPPWLPAKPSSAIEYAVYDPDSAMLRGFLDGLAAHLLPGGEGWLILSDLAEHLGLRSREQLLQWIDQAGLAVLGRLDVKPSHKKAVEQIDGLSAARQAEITSLWRLGVK

SEQ ID NO: 6499 - protein, 431 aa, Chromobacterium substugae
MTLLAGSALAAPWNAHIAYQKGQVVQWQGRDWQAKWPTRAETPGANPKGSWIAHVGATVRRMDDAAPPIPTLQQALQHEADLTNNDFFRKVKASIRTLPSDQVELVSPGRAANPVNVRRVERLLPSAKWDYYFTRRDPSYTYTRFLQAVAKFPGVCDDYSDGRDADAICRHSLATMFAHFAQETGNHDASDTVPQWRQGLAYLREMGCTDSGPGCGYNTECDDPVFNKVWTCGKNADGSWKKYFGRGAKQLSYNYNYGPFSQAMNNGDQSVLLQNPDLVASTWLNLASATFFFVYPQPPKPSMLHVIDGTWVPNAADIAAGAGNNFATTIQIINGECGGGTERQAAQNRIDYYKQFAHDLGWDYGAEQLSCANMQRFTAASSAAYNIYWEKDWKWGDDYQCQLVSYQTPYSALQAGNYQHCVEDNWGIKLK

SEQ ID NO: 6500 - protein, 61 aa, Chromobacterium substugae
MKVNELQPGDLVTEQHGQDTVAFEVVAIQQLGRRFAVTFRSALGLGSAHYAGDAWISAMRR

SEQ ID NO: 6501 - protein, 88 aa, Chromobacterium substugae
MSKEDMIELEGVVIEMLPESRFRVKLDNNVEILAYGSGKMKMHRIRVLVGDRVTVEMSPYDLTKGRINFRHPTANVGGGSRPPQHRRR

SEQ ID NO: 6502 - protein, 480 aa, Chromobacterium substugae
MQNHASTLYQQLADDLSLAISRGTLPPGSRLPSVRRTAHSRQLSLNTVVSAYRVLEDRGLVEARPQSGYYVRARLPSPARPASTRSGPATPTRDAVLDLIGTVLQAQQTEGFIDLALACPRGGDFYPGNKLARLMGQILRRQPGMVSTYALPPGSERLRTQIARRGMDLGMALQPDNIILTHGCMEALQLALRAVTRHGDAVGLESPTYFNLLPLLASLGLKAVEIPTDPQTGLSIDAVEVLLAERRIQALVAMPNVHNPLGCCMPLEAKKRLARLVNHYQVPLIEDALYAELQFADTLAPAVKAFDEDGWVIVCASYTKTLAPDFRIGWMEGGRFDAQLRKLKFASSVAEPVVLAETLGAFLESGGYDHHLRTLKRRYAAHVEKVRGLIARHFPAGTRATQPQGGFLIWLELPEGCDSVALFHAAMAEKISLIPGPLSSPGGRYRNALRLSCCYPLDERYLAALVRVGQLAGQQIAPEA

SEQ ID NO: 6503 - protein, 205 aa, Chromobacterium substugae
MPEFALLSYVALMSITPGPNNLMLASSGVNFGFRRTVPHMLGISLGCALQVFVVAMLLAQALGWLASWRLPLAAAGCVYLLWLSWKIARAGRPEAREQARPLGFVGAAMFQWLNPKAWVMVLNASILFMPAGGAKLAAALLLAVVFAAVNLPCISVWAWGGERLRRWLAAPHALLMYNLTMGALMAVTALWLLYDELAPVIARMA

SEQ ID NO: 6504 - protein, 184 aa, Chromobacterium substugae
MKKTALLVIDVQESFRHRPFWTEQDLPAYQAAQQALIAGAQARGVPVINILHQAGEDGPFSAASGLVRPLDWMTHQPAATFVKHVHNALTDSGLQTWLIKHGIQKLVISGIRTEQCCETTTRVASDLGYEVDFVTEATLTFPMTHAGSGVTYSAADIRARTELVLAGRFAAIVTVEEALRRMAD

SEQ ID NO: 6505 - protein, 70 aa, Chromobacterium substugae
MPQSASHTPPGGLPAYRLLTGPDDSAFCQRVSEALALGYRLYGSPAAAFNGERVIVAQAVLWPGSDDAAG

SEQ ID NO: 6506 - protein, 301 aa, Chromobacterium substugae
MPLADLAQALAIVLAWGVNFVVIKWGVAGVPPLLLGALRFLLVALPAVFLVRRPALPWRYLALYGLTMGVGQFGCLFSAIKLGMPAGLASVVLQSQAFFTLLLARVFLGERWQASQLAGLALALGGLALIGMGKGGDMTALGFGLTIAAATSWAASNIVVRAIGRDGFKVEPLGLVIWSSLAPPLPFLLLSWWLEGGERMAAALRGFDGQSLFAVAYLAFVATMFGYGLWSRLLARHAAAKVAPFSLLVPVVGLMASHWLLGERLTAQQLAGSGLLMAGLLATVFGGRLLAAAGAGRASRA

SEQ ID NO: 6507 - protein, 304 aa, Chromobacterium substugae
MREIYFVLPPSLLLLDLAGPADAFRVAAQLGADFRLNFVSATAGVGTSLGLPLSGLSPLPETLPDGALVVVPGSTPSEQAYATPDARRIVAWLAVRRGQAGVRWAGICSGSLLLAEAGLFDGRACTSHHTLLERLRGLAPAARVQENRVFVQDGHCYSSAGITAGIDLALHLIGELAEPAIARAAAREMVVYFRRSPQDPELSPWLAWRSHLHPALHRAQDLICADPVRDWPLPELADQVHVSARHLSRLFREHAGVTAHDYHRALRLALARQWRAAGLGKEKAALSAGFSSARQMDRAMDANA

SEQ ID NO: 6508 - protein, 212 aa, Chromobacterium substugae
MLAGLSACAASTPPKAQPMPMAAPARDSGMTPTGVGFVGSGEDGSSEETKVLIKEVNPYQPIVVRVVGTGAAPYTNSLTPSQRKLLAMRAARLDAFRSIAEQVQGMKLVGNSAVSNMIANSDSFRTYVDAYLRGVSIVSTSMKPDGTSEAVAEITLDQEFYKQFKNALDKTGSVMKASQETGAVGATTSSNSMQAMPAAAPARFSSNFYVNQ

SEQ ID NO: 6509 - protein, 424 aa, Chromobacterium substugae
MKRNGLAIAALVAAFLLSGPARAEVFSAEGVAPLDNGLVAARDMALRDALKLIAIRQGARVESAQVLENGRASESGTLTASGAVQGTVKVVSEYQQGKLYHVKVQVDAGDPAAAAPRPRDPSCAMPPGRSLRRKLVTTYFGVERPAEASDMPDLATALPTELSRRLARNSMLTVRDANTVSVLADSRIAEPAAGWDIASQLGQREDVQFVVAGRVLSTSVTGKGARPSFFESNNTSQQGSFYNGPFAGMFGMGVKYVPTQRQFDAEVWIYDGLTGSLLANERVSGLAKGQVVPPSPQPFASAAFWQGDYGRLVDKLMDRAAQRVNDIISCIPFSARIVRQEGKRVYINAGLLDGMAVGDKLLLYRRVPGQPVRDLISGRELGMPETLNGDVSLVQVQPNFSIGIAQSNSQPVSEGDYVRFVPGR

SEQ ID NO: 6510 - protein, 155 aa, Chromobacterium substugae
MSLESVRQFLSAQAPHIAIIELPVSTATVAEAAAAHGVEAGRIAKTLAFRLNDGREVILVARGDARIDNRKFKDAFGKGKMLPPEEVEAITGHPVGGVCPFGLASELPIYLDVSIQAFDEVLPAAGAVHSAVRISPQQLRDITTGQWVDVCQAFA

SEQ ID NO: 6511 - protein, 162 aa, Chromobacterium substugae
MKAISSSAKALDKMDRKILRILQKNARIAMTELAEKVGLSTTPCTERVRRMERDGIIEGYYARLNPHALGGSLLVFVEIKLEAKSGNIFDAFRREIMSIPEILECHLVSGDFDYLIKARIADMSMYRKLLGDILLQLPSAKESKSYVVMEEVKETLALPLAD

SEQ ID NO: 6512 - protein, 435 aa, Chromobacterium substugae
MKVIVLGGGVLGVSTAWYLAKAGCQVTVLERQDGVALETSFGNAGQISPGYSAPWAAPGIPLKGLKWMFQRHAPLAISPDGSLYQLQWIAKMLANCNEKAYAVNKGRMMRLAEYSRDKIKELRAETGLQYEGRQGGTLQLLRSQAQVEGMAKDIAVLRECGVDFNVLDPDGCVRVEPALAAVKHKLAGGLQLPNDETGDCNLFTSRLAELARAKGVEFRFGVTVDGIENDGKRITGVRVGDELLRADHYVVAMGSYSRDLVKELGIDIPVYPVKGYSLTVPITNAAGAPTSTILDETYKVAITRFDDRIRVGGMAELSGYNLELNPRRRETLEMVVGDLYPNGGDIKAASFWTGLRPMTPDGTPIVGGTRFANLSLNTGHGTLGWTMCAGSGKVLADLITGAKPEISVDGLSMQRYAKQGETLVVPVIRPAVQGA

SEQ ID NO: 6513 - protein, 353 aa, Chromobacterium substugae
MIATIRLDHLRHNYQLARAAHGDKTLAVLKANAYGHGAVRCAQALADIADGFAVACLEEALELRAAGIAQPILLLEGVFEAEELKAVDEHGLWMAVTSEEQLRMVEQSNPTRPLTIWLMLDSGMHREGFLPENYHQAWHRLQACGKAGGITKMTHFARADEPEVPMTFAQLEAFDAAVRGLPAGDESVANSAGILCHPRAQRNWGRVGIALYGVTPLPAGFGQGDALRPVMRFSSKVFGVRELGVGEPIGYGDNFVTDRPTRVGLVACGYADGYPRRASSGSPAVVDGQRTRLIGRVSMDMLTVDLTDLPEAGVGSEVELWGDAVSVNEVAAQAGTIGYEPLCNIKRAHFVYR

SEQ ID NO: 6514 - protein, 439 aa, Chromobacterium substugae
MWFAGNKMIHQLENATDAALRGESAPWRIHGNERWRALGEKLSRVWEARDRQISQADEERLSTTRQLQQLQEALLESEEQLALVSTRFDLVNRAASEGLWDMSVVAGDPVNPDNVFWWSQTFRSLLGFSDQRDFPDVLGSWANRLHPDDKARTLDAFAAHLGDRSAQTPYDIEYRLQCKNGEYRWFRARGATLRDERGIPLRVAGSLSDITGQRQQQSLLERAMTRFELGSAMQADGLWDMEVDAANPVSGNNAFWWSPQFRRQLGFDSEHEFPNLLESWSSRLHPEDKQRVLAAFAAHLNDRSGQTPYDLEYRLQCKNGEYHWFRARGQTRRAADGTPLRVVGALTDIDAEKRSEALNSESQQRQQLEKSLSEIAAIVSTIQSIADQTNLLALNAAIEAARAGETGRGFAVVADEVRKLAERTRDATQRVEKLVVQRG

SEQ ID NO: 6515 - protein, 558 aa, Chromobacterium substugae
MNPSRTALGLLLACALPAWADAPPIPPDLRDGADARRLLQDNSRRFDDLIQQQRLRQIQSGGSEVASPQAPVLSGRDCLPVKGLRLAGISLLSREDVNALGLPHGDCLDLAEINRFSRALTALYLRRGYIAARVLAEGPDERGVLTLRVEEGKVAAIRSDDASLRVANLFPGMAGQPLNVHDLDQGLDQANRLRSNHATVDVLPGERVGDTIIQLRNQPDSRWSGGLTLDNAGRESTGRLQAGVSLGWDNPAGWSDLLSLSAQTTGERQEVRHSRSESLFYSLPYGYWTFSVFASRSDYLNPQQLQSRVAQLSGETAQTGLRLDRVLSRDQTRVLSADLQLVQKRVRNLFQDVELGVSSPNLTVLEAGLSQMRILPSGLLQLDGSLQRGMRWLGADAPDAIHPGAPNPQFSKLKLSLAWYQTLALPGGPYQWQSALSGQASRDRLPGVEQLDIADASAVRGFRNNSLVAETGWYWRNTLSRRLQYGGVTLTPRIGLDGGRVLQRGSQDAWQDIAGLATGATLGRGGLTLDLDYSRPLYKPASWQAEGHILFARLNWQW

SEQ ID NO: 6516 - protein, 1611 aa, Chromobacterium substugae
MSRGCDFGFEGMMMKRTKFDLSVTGKVAAALTLAFVLADASLAGGITAAGGSGAQPQVSTAGNGAQVINIVAPSAAGVSHNQYQDFNVGKPGAVFNNSLQAGQSQLAGQLGANAQLGGNQASVILNEVVSRNPSLLLGKQEVFGKAADYVLANPNGIACNGCGFINIPRASLVVGGANLQDGAIASLQAANNGNALSIAGGGASGVNVLDLIAPRLDVRANVSAADAIRARAGFNTVDYASGQVTATAPAPQGVGNLDSYFLGAMQAGRINIVSTAAGAGVNVGGNLAGGDELSIRSAGALAVQAAQLKGKQLALDGASVDISGRVDSETGKDSKHDESWFIWKTGESSSASSKTDSSVKRASLQGDDVSIKAAGNAHVGAADIQGQDVKLSAGSLNLDGQLAESSASSSDHAWKNSWAYNQDKSSVTQAQSVARIKAQHDVELNATAGGASIAGASVDAGNNLKLSATGDVKLSALLETDSSSDVGNRKNDGAALETGSWNNSSSQQRLVQSQLRAGNALGVTASGDIAAQAAVLKSGGDAVLSAQGKTTLATQTSANSSSTQNGKTYWGGIGGGGNQNNSDSATVNTGSAVNAGGKLFINGDAGIAINGSQAKGTQGAYAKTQSGGVVIDSALDLAQTRTDQRTGTAFNITSSASKGSTSQETAVGSALKSDADLQLLSAGDVAVTGSLVKAAQALNIQAVGDIKVASQAAETHNQSQDSQLALRGVGAETGDKQYRGGVRLENTSTSQQLDQTSQTGSQLSGGSVKLAAGNDLSLSGSKLETAGDASLSGQNVSLNAAQSASHNDSSTTVSGGGLYLTGGLDKTGAGIEFGQNSSRTVADGSAAQVSEVKTGGKLDITAGNGMGALQNQGTQIKAGGAVTIAAGDVSNQAAVSQQSTQQTSSHWGVDVGVNVDYSGITRPIANAGGSVAKGDVAGAAGQAANLGAANLGVDIGAIGGSASSQSQSSAAQATSIAGSAINVAASGALKDQATQYQATQGQVSISADSHQMTAAANSQTQSSQASEGGASVRVYTTTGQDVNVKGSGQGSYSNSQSASSNAVTGAIQSAGGVSIQVNNDASYQGAAINGGSGQAAIQTGGKLTLSQANNTSSSQQHDVKVDVGLGISTSPIDGGSKLGGSGNLAVGNQQSQAASSQAATGSVQSAGGIALTAGNGLTVQGGSLQSGGDVKLQSDGKVSLQAATGNDSKTGSGWGFNVNAGGNNSKGKDASGQGFNVGGGVQLSSQNESSASQSGAQVSSGGALSVAAGATGNNAIQLQGSQLGGKTVGLTADNGGISLQSAQNSSQKNDWSASASLGGGGNSSVAKENGQPKADGASKTYQANGGFDVKVDQQDKLANANATVKGDQVNVKADGQLTLAGGNIAGGKVDGSVGGNVVVQSQQDRNNSTQVEVGLNVSSSNAKAPSVVDQAAAVAGPLSGAVKDKATDAVNAVADKVQGAPAAADAKPGLVDGARQQAGSTLKDKLLNPQDKGTQVSGVIDVSVKTDNSVGSVSAISGDQGVNLAVGGKAQLNGGQIASSGGKVNLGDAKVETSDIQTSSYTGAGGVKLDGTPAAIIQQAVKDVTSGQMPLIHVERGSQNQTVAGQVKSGS

SEQ ID NO: 6517 - protein, 135 aa, Chromobacterium substugae
MTCENNARILVADDHPLSRELLRQMLEHLGAEADFAADGEEAVDMAGRADYRLILMDVKMPQMNGLEAALRIRGRRERPQPCIVAMTACAFGCERDGCREAGMNAVLVKPFKLEELRRVLAACLPDGAGGDCCPL

SEQ ID NO: 6518 - protein, 272 aa, Chromobacterium substugae
MERIVNGQEVSDGAGVRLLRVLTQPLQRRLDPFLMLDEFRSDNPDDYIAGFPSHPHRGFETVTYMLAGRMRHRDNAGNEGLLGPGGLQWMTAGRGIVHSEVPEQQDGLMHGFQLWINLPAADKMTAPGYRDIQAADIPSWQDADGNQLKLLAGRFDGRHGAIERPSTEPLYLDIALPANGSLWLPLPAGHHAFAYLYQGELQAGGADIRARQLAVLDNEGEGLLLANGGAPSRLLLLAARPLGEPIAQWGPFVMNTRQEIEQAMEDYSEGRF

SEQ ID NO: 6519 - protein, 302 aa, Chromobacterium substugae
MKPFRTTLEQWQVLQAIVEEGGFAQAAARLHRSQSAVSYAVARLQQQLGVELLRPDGRRMRLTADGAALLREAGDLLQAADRLERRAQGLQAGWEPELRVALDSLLPTEVMLAACGDFAGHCRETRLQLREVVMSGADDALHQGEAALAVAGRVPQGFLGDWLLDAEFVACAAPGHALHAQGGMLDEARLRREVQVVLRDSGSRQPRDEGWLGAHQRWTVSQPETGIAMVEAGLAFGWLARHRIAAQLADGRLKPLPLKSGAVRKASLYLVLADPPAAGPACLYLAEALRRAAQAWIAALAQ

SEQ ID NO: 6520 - protein, 224 aa, Chromobacterium substugae
MTTLQPIKRQTLTSAVTESLRRRILSGEFADGQQLRQEALSNEYGVSRVPVREALRQLEAEGLIQIIDHKGALVSKLSLEDVLELLEVRAMLEGSLLKAAIPCQTQADHDAAQQTLREFEAALHNNDVRHWGEINSRFHLALYRAAKRPNTLALIEQLHNKTDRYTRMQILFTRTMERAHEEHTRLLEMCRQGKADEAAEFLRFHILSAGHALESYLKGQQANH

SEQ ID NO: 6521 - protein, 283 aa, Chromobacterium substugae
MSAQLIDGKAVAEKLVEKVREGVGERLLQGKRAPALAVVLVGDNAASAVYVGSKKRACEKAGIRSVAYDLPATTSQQQLLEIIDDLNADAGIDGILVQLPLPKQIDPQAVIERIDPKKDVDGFHPYNVGRLAIKMPLMRPCTPRGVMTLLEEYGIDPKGKKAVIVGASNIVGRPQALEMLLARATVTVCHSATQNLAEEVAGADILVAGVGIPNFVKGEWIKPGAVVIDVGINRLESGKLCGDVEFDAARERAGFITPVPGGVGPMTVATLLQNTLDAANQYA

SEQ ID NO: 6522 - protein, 287 aa, Chromobacterium substugae
MSHEKHSATLLMSAPDKKGLVAAIANFLMTYNANIMHADQHQDTSENLFLMRVQWDLDGFTLPMDSFAAAFQPIADEHNMSWTVSLSARKPRMAVFVSQYEHCLADLLHRWRIGELECDIPLVISNHETCRRLVEFNGIPFHLIQVTKDNKAEAEAEQFRLLEEAGVDFIVLARYMQILSGEFVERYPDRVINIHHSFLPAFDGAKPYHRAFARGVKLIGATSHYVTEDLDEGPIIEQEVTRISHRDAVEDLIQKGRDLEKVVLSRAVRWHLDNRVLSYNNKTVVFD

SEQ ID NO: 6523 - protein, 198 aa, Chromobacterium substugae
MRLLIDDVLDLLRLRVKPLAVYQYPWWQPALLLTLLGLIASGDTAELGGNIAGRIGFMVLFTWLETLLFTRFITFWLRLSKGELAAPLFGLVVVASGLQFVEPLTSWLPDDAAAVVDVLLSLIGLVVLVNALAVVSAVSRLRVLLGVALFMPLALVLLAATLSFAKTAGWVDLPADMVAMMQERGVAVSASEPAAKAR

SEQ ID NO: 6524 - protein, 153 aa, Chromobacterium substugae
MEERKNERLPSDLARRATAIIEMPDGVLVTASRGGRYNLPGGKANRGELRSQALIREVREETGLRINSMLYLFDHITPFNAHKVYLCIAQGQPKPQNEIERIALVSSPDTDMDLFVEGRAILRRYARLRGEETAKGQALRALLGLARYIAKVD

SEQ ID NO: 6525 - protein, 275 aa, Chromobacterium substugae
MNAIEALLFAVIQGISELFPVSSLGHGVLIPDWLHWSINRTHPDFLPFMVMLHLGTAAALLIYFRRDWIALIGGWLKARGRASNPEARLMWLVIAGTIPAGLLGLLLEKQLRQLFTSTTAVLIFLALNGLMLLWGDRLKKKTASHELSELSLAGAIKIGAGQALALLPGFSRSGATLVTGLAHGLDYASSARFSFLLATPIITAAGVLEIPKLAHSHAPAPWGLLLACGAVAGLCAYASTWFLMRYFKKTEIESLRPFGFYCLLVGIGGLAAKFV

SEQ ID NO: 6526 - protein, 208 aa, Chromobacterium substugae
MPHKPLSEQDYQRLSATLNRFTSQQCMNLEQLDGFFSALLSGPQAIPPAECLPLILGEAFDDESAFPSEKSLEQFVALLRGHWQDISNALSGGEFQPWLDADANGAVLGNDWCEGFIAGMELLNDDWGMLFESEENAPLLEPILALGFERHPDAEMRPFVEAVSAEQRAAWLAAISPSVHGIHDFFAAIRRQLEQEEQALEQQERRPH

SEQ ID NO: 6527 - protein, 396 aa, Chromobacterium substugae
MHIVQFIIGLVVVLALTQLVARDRKNIKIRSVIQLLVIEIALAFFLLNTTYGLAIVGSISSVFTKLMDFAKEGTDFAFGGIQNKGEFSFFLNVLMPIVFISVLIGILQHIRVLPVVIRAVGFVLSKISGMGKIESFNAISSMMVGQSENFIAYKNIIHTFDEKRMYTLAATAMSTVSMSIVGSYMQMIEPRFVVTALVLNLFSTFVVLSLINPYDSALGEDELISSDAHRVSFFEMLGEYILTGFKIAVIVAAMLVGFIALIACVNFIFTAIFGINFQTMLGYVFWPFAWLMGVPTHEALTASSIMATKLVTNEFVAMLELKNQAAHLSSYTRGVLSIFLVSFANFSSIGIIAGAVKGLDEDRGNMVSRFGLKLVYGSSLVSILSALIAGLVLASY

SEQ ID NO: 6528 - protein, 48 aa, Chromobacterium substugae
MHEISIAFGFPLPWQVSSNVSVPQAGRTPVFIGLRAKPRPPRRHVPGI

SEQ ID NO: 6529 - protein, 514 aa, Chromobacterium substugae
MTHPQTIALVESLDHEGRGVAHVDGKTIFIDGALPYEKVVYSSYRKKPSYENAQTSAVLKESFMRAEPRCPHFGTCGGCSMQHVEFTAQVAIKQRVLEDNLKRIGKVKAERILTPIAGPAWHYRHRARLSARMVAKKGGVLVGFHEKSSSYIAEMRECHILPKHISDLIMPLRAMIATLSISQRMPQVEVAVGDKLDILVFRNMDAITDADFAILKAFSDRHGTAERPLQVWLQPKGPDTCYPIYPLDAPKLTYSMPEYAVEMPYYPTEFTQVNPQINAVMVARALKFLDPQPGERIADMFCGIGNFTLPIARSGAIVHGMEGSQPLVKRAVENATHNGLQDKVSYEMANLFEVTEESFAALGHFDKMLVDPPRDGAVQLLKAITEETAPKRIVYVSCNPATLARDAGILVNTKGYTLKTAGIINMFPHTAHVESVAWFEKTSPCKTRKEVEEIEALEAAEREAAKAAHLAEENAEKAKKAAELAEKAAAKEARRAHYFAEKARRENEDSSPQA

SEQ ID NO: 6530 - protein, 297 aa, Chromobacterium substugae
MLKCLSVLALGGSLAFPCAAAVMPAPDIQVNPAGRHLVLNLPQARLFLYQDGKLARIFPVAVGKMLTQTPTGSFDITGIYKAPAWHVPKSIQDEMRRNGKEVQTVVPPGPNNPLGPVFVRFGESRLGLGFHGTNAPGSVPGFRSHGCVRLKNDDALELAGTVSRGDAVTVAYQTILLSQDEAGQLWLTVYRNHYKQEDPSLKYLAQTLLDWQRQHQQALYGQRVDDALKQRSGKPVCLSCKSASGAISGGLQPFAWLSRLTPAAAPETPAASQPAPDREPGPPARASQRGRTAARAG

SEQ ID NO: 6531 - protein, 425 aa, Chromobacterium substugae
MKLETLAVHAGYSPDPTTKAVAVPLYQTTSYAFDSTQHGADLFDLKVQGNIYTRIMNPTTDVLEKRVAALEGGIGALAVASGMAAIAYAIQTIAEAGDNIIATRTLYGGTYNLFAHTFPQLGIEVRFVDYQNPAAIAALVDERTKAVFCESIGNPLGNVVDFAAFAAEAHRHGLPLIVDNTVPSPYLCRPFEHGADIVVHSLTKYLGGHGNSIGGAIVDSGKFPWGEHKARFKRLNEPDVSYHGVNYVEALGAAAYIARARVVPLRNMGAALSPFNAFLILQGIETLALRLDRICDNALKVAHFLQASPAVEWVEYAGLPDNPSKPLVDRYLGGRASGILSFGIKGGEAAGGRFIDALQLVTRLVNIGDAKSLACHPASTTHRQLSPQEQLSAGVKPELVRLSIGIEHIDDILADIGQALKAAAQ

SEQ ID NO: 6532 - protein, 475 aa, Chromobacterium substugae
MSSEPLYQQLVNEWTTLIQTGTIRPGERLPSVRKACAMHKVSPSTILQTYRTLEDRGLIEARPQSGFYVKSAASLPLPRMRRQSAAHHTGEVVDQIEAVMGAQNQADFIDLSLASPRGSDFYPTTRFKHIMGRLLRQHPELTTDYPFPPGSERLRRQIAQRAVSWGCVLAADELVISNGCTEALQLALRATCKPGDTVGVESPTYFALLPMLKDLGLSVIEIPTHPTSGLALDALELLLSEKRLNAVVAMPTVHNPLGSTMPPEAKQRLAQLVNDYQVPLIEDVPHADLFYGAATPNAVKAYDRDGWVLLCASYSKTLAPGFRIGWIAPGRFLSEVRRLKFSSSLGQPALLEETLAEYLESGGYDHHLRLIRRHFNSQMEKLRGAVAQHFPAGTRATLPSGGCLLWVELPSHADTMQLFQAALAERITVVPGAMYSAKGRYRNCLRLSCCYPWNEAYQRALARVGELAADLADRD

SEQ ID NO: 6533 - protein, 207 aa, Chromobacterium substugae
MNLLALVTYLLVMSITPGPNNLVLASSGVNFGFSRTLPSLLGMALGLSLQVGILSVGLGALMSLMESLQLYLAIAGCGYLLWLSWSMARAGAAKSADAGVRPMGFWGGILFNWLNPKVWLMGFNLVMVFLPAHMNPWHAAALFALITFFTSLPCIAVWAGSGVAIRRFLDSPPRLRAFNFSMAAMLALTAFWLLAQMMPSGALPNMV

SEQ ID NO: 6534 - protein, 461 aa, Chromobacterium substugae
MIRTRFAPSPTGYLHIGGVRTALFSWAYARKNNGVFVLRIEDTDLERSTPESVKAILDGMHWVGLDYDEGPFYQTHRFDRYKEVIQQLLASGHAYHCYCSKEELEAMRAEQEARGDKPRYDRRWRPEAGKTLPAIPEGVQPVVRFKTPLAGVVAWDDAVKGRIEISNEELDDLIIARPDGSPTYNFCVVVDDWDMQITHVIRGDDHVNNTPRQINILKALNAPLPVYGHLPMILNEDGQKMSKRRDAVSVVDYADKGILPEALLNYLARLGWGHGDDEFFSMEQFVEWFTLEAVSPSASRFNQEKFMWLNAQHIKAADNGRLAELIAPRLAKAGVDTTHGPAIGDVLALVKERVQDLNALALEVDYFYKKREPVAADVEKHLAGDAVARMGRFVDRLAALEAWSAESIHELFKPFCADEGIKMGQLGMPLRVLVCGTTQTPSVDAVLALIGKDEVLRRLRG

SEQ ID NO: 6535 - protein, 473 aa, Chromobacterium substugae
MTPAIAYDDVQGTILRGYRVERARHFILRIDDKARAAALILKLVDGELGLPPITTAQRGAQKPIHFLNLSFTCAGLARLGLSDAQLQTFDASFRQGATDPGIAASIGDTGDSAPQHWIGGLDQGAQVHALLSLWVDGSAEQLESASAKLCCAFADYGVKKLSAQDAVALPDNKVHFGYRDSIAQPTIIGAPPRKRDIPDDQPPVATGEFLLGYPNESGGSYTLEPKELSLNSSFAAFRILEQDVEGFESFLQTYAPRLGVDAETLAAKVCGRWRNGNPLTLRPDAAGEVLPPSQLNDFHYVDATLDKDDTLGLKCPIGSHIRRSNPRDGAVVGAGSPLHRIVRRAMPYGPEYDPAKPDAQKRGLIGYFINASIANQFEFVTSQWVLRSDFVKSATGPGGPEQGNAVFNISGEDVFIGVNPVDQSSFTDAQAGPKGQNNKRITGFPRLIHTRGSAYCFFPSISGLRYLAKLAAG

SEQ ID NO: 6536 - protein, 150 aa, Chromobacterium substugae
MASPLTLLMPVAPDADLTALAATVKENQPLLHAALTKIGTVHYARTQLLDRAAPNLQPGIKPSKSYVLAVITEYDGSFDSYIQDFVKEVGPIFDALLRFIDGASGLIPVASHVAAFKAFIAANDASQHAPNNDMYQAYTATVQQVLASLP

SEQ ID NO: 6537 - protein, 126 aa, Chromobacterium substugae
MWKSIFAIAAGAAIGALLRWFLGLRLNSLFPSLPLGTLAANLIGGYIIGLAVALFADMPSLPPMWRLLIITGFCGGLTTFSTFSAEVVELLRQGQLVPAFTAIAAHVSGSLLMTMAGIASWQLLRR

SEQ ID NO: 6538 - protein, 141 aa, Chromobacterium substugae
MTTHYPVIDKRTISMRWGDMDAVGHLNNTYYFRYLEQVRIEWLNSLGYGIDPEGIGPVLANTACTFRKQLTYPATLDITIELEKLGNSSLKLRHHFYRQDDPGTVYASAEVLLVWVDYKAEKSVAIPDPIREAIQRALPAA

SEQ ID NO: 6539 - protein, 638 aa, Chromobacterium substugae
MYFSRDAGLDETRHVFLQHNQLAERFAALPQRGQFTIAETGFGTGLNFLCAWQCFEQHAPADARLHFVSAEKYPLTPQDLSRALALWPELAAQSNQLLRQYDMLTPGWHRLLLAGGRVSLTLMVGDVLDVLPQLDARVDAWFLDGFAPSKNPDMWQQPLFDQMARLSAPGATFATFTSAGAVRRGLTAAGFQVEKAPGHGQKRHISRGWLQTAAAMPWQAPWFARPPQRWRERSAIVVGGGVAGASTAHSLAVRGWQVTLIERMPRLASAASGNPQGVLYTKLSPHLTPLSRLVLSGYAYSLRTLRELLPEDGENWRACGVLQLAHEAKEGEKQQALAELGLPEAVMRKLDREQASELAGVALPSGGLFFPQGGWVHPPALVARLADHPNIAVRTSHTVLELEYDQNERHWLASDESGPLALASVVVLAGAAETAQFDATSHLPLKKIRGQVTSIAATPDSERLATVLCGEGYISPARGGRHCLGATFKFDSDDLAVNDAEHAENLQMLAELAPQLHDGLTSGGRGALDGRAAFRCTSPDYLPLIGPAVARRDFAQCYAELARDASLQPQQPCPWVEGLYVNTAHGSRGLITAPLSGEILAALLEDEPTPLPAHLMQAIHPSRFLLRDLIRRKLDPAA

SEQ ID NO: 6540 - protein, 676 aa, Chromobacterium substugae
MRRASSIGSRLVLTQVVLMALVAGAILYPLYVFSQRLMLERTQKVQAQLLAQSLNMVDGFNESLRLSTRQFEKVFFAEFRSGFSLNPAEKINVAGAATPALLMGGEPVNGNNRMVDHFSAVSGNVASIFVRDGDDFVRVSTTLLMENGNRALGSRLERAAPAYAKLAAGDGYIGLANLYGKDYVTSYSPIKDGDGKVIGATFVGVGATEGIASLLVRLGKVKLEDSGHIDVIDVNPASASFGRYLLHPRLNGRSVDKSLDADGKPYLRELLKGGSGNLSVRLPGDKGAAAHMLSYASFAPWNWLLVSDETESELQRENRMLIAWLAAGCGVLLAVLALALWGATRILVTRPVRQLVAEVASIQDNHDLQRRLPTGRGGEMGEMANALNGLLDSFQLALNRTSHHALDLDRAAQDLSHKAGAAAASSGEQRDSARQMSQHTELLIAGVEQIERVAGEASEVAQASSEAAQNGSASLAAAVDEVNRIAATLDNAADSLLALESNAGQISDIVNVIHDIADQTNLLALNAAIEAARAGEMGRGFAVVADEVRKLAERTSQSTRQIGEMIAAMQQAATLAAQAMRQSVSCASEGAAITARAREAMGSIVADAERSMAVVSAINQELASQRQTVENIAEQVAQVARLAETHNQEAERSAQTAGEMAQLADSLKQEVRVFRA

SEQ ID NO: 6541 - protein, 859 aa, Chromobacterium substugae
MRFDKLTTKFQQALGDAQSLAVAGDNAYIEPQHLLLAMLDDAEAGVGGLLARAGVNVPALKAGLKSAIERLPRVQGHGGEITVSRDLANLLNAADKIAMKLGDEFIASELFLSALSQDKGETGRLLKEHGGNHASIQAAIDAVRGGENVNSADAEGQREALKKYTMDLTERARQGKLDPVIGRDDEIRRAIQVLQRRTKNNPVLIGEPGVGKTAIVEGLAQRIVNGEVPESLKNKRLLVLDLAALIAGAKFRGEFEERLKAVLNDLAKDDGQTLIFIDEIHTLVGAGKAEGAMDAGNMLKPALARGELHCIGATTLDEYRKYIEKDAALERRFQKVLVGEPSVEDTIAILRGLQEKYEIHHGVDITDPAIVAAAELSQRYITDRFLPDKAIDLIDEAASKIKMELDSKPEAMDKLDRRLIQLKIEREAVKRESDEASQKRLQLIEDEISGLSREYADLEEIWKAEKAAQQGSQSIKEEIDRLKANMEDLKRKGDWQKLAELQYGKLPQLEARLKEAEAAGEQGEAKPNRLLRTQVGAEEIAEVISRATGIPVSKMLTGEREKLLHMEDVLHRRVVGQDEAVTAVADAIRRSRSGLADPNKPYGSFLFLGPTGVGKTELCKTLAGFLFDSEEHLIRIDMSEYMEKHSVARLIGAPPGYVGYEEGGYLTEQVRRKPYSVILLDEVEKAHPDVFNVLLQVLDDGRLTDGQGRTVDFKNTVIVMTSNIGSQQIQAMATDDYQVIKLAVMAEVKTQFRPEFINRIDEVVVFHGLDEKHIQSIARIQLKGLEARLAKLDLNLQISGEALALLSEAGFDPVYGARPLKRAIQAELENPLAKAILAGKYPPKSTVLVEAKNGQLVFD

SEQ ID NO: 6542 - protein, 189 aa, Chromobacterium substugae
MNETQRCAWCGDDALYVAYHDQEWGRPERDDRKLFEMLILEGAQAGLSWITILRKREGYRAAFHGFHPEKVAAMDEDDVERLMQNPGIVRNRLKIRSAIRNAKVFLQMQREHGSFADWLWGHVDGQPILRRRDDERVPASTELSDHISKELKKAGMNFVGSTVVYAYLQACGVVNDHLAGCFLHPHGDA

SEQ ID NO: 6543 - protein, 147 aa, Chromobacterium substugae
MRFDSGQLGNVEVDEQTILTFPHGIPALENCTRFKLFHDAAHKTPQVYWLQSLDDPGITFSLALPERLGVRFQVELTDDEVAQLQLRGPEDAAILLMLYRPLETERDSHPALGQLQANLCNPLVVSLSSQRGIQKTGLKIDILLHTP

SEQ ID NO: 6544 - protein, 404 aa, Chromobacterium substugae
MELKPKRFLILDDQLVLRKLISRQASFFSRFAVEIDEFSDPAEALRSIAEGGYQLVITDIGMPGMNGIDFIKNVARLGYQSALLIISGYDGKTLQTIADMSANLGISCTRFLAKPYSAEAFVAMLNGIFNEMERAEAPAQLDIEPLLADICDDRFALEFVPVVTLADRRPVSFSLRALALGERRCGIDHLLPLLAGRRMASAVALETIVERMAKLLQGISLASGQDECQMHIRIDEACLCADNVFDHCFTLVQQYGVAPRRVSFELADGLSRRSDALCFENIAKIKYLGFHLTADAFGIGSLTIGNLLKFPFDQVNVPVETLHWLKTLQGEDPHTFRLLRHFGLSQTAVCATRVDDEEGRELALAMGCVKGVGDGLAGVVAEQDLARLIVDCQGDRAASSGTIV

SEQ ID NO: 6545 - protein, 244 aa, Chromobacterium substugae
MISVDLARLRIMIVDDQTLVRTLISQALQNMGVKSDYIFQAADGTTAMRLLDIRMVDIVLCDVQMLPMNGMDLLKELRCGHTANVSNLPFVFLSGHADRSNVVLASQLHADGFVVKPPKPADVEKAIQAAMHRPRPEIDPFSYYNIATGTDYDNKVFGKLFETRAPVYQEEPAEQCLPLDKIKPGSYLTRDLRSKAGHLLLPRGATISANQLAVLKDFSERYGVAQIFVTESLDAVASSSAARH

SEQ ID NO: 6546 - protein, 1291 aa, Chromobacterium substugae
MLQPKARHSQAMAIGRSVLAIVLLLGILQAGVMVQLQVTAWSEYRQADRLVELNQDSSLLYRFSDIQHQESGQLRALLLGRQPDAATLAALDRLSRLVDERFLAMVTSLHGRDEARTSEKIARLQQLFRQYQQLRVQAKAVWQSSSGPNEALTTSLYEQTRDVQEQVQHLVDDSVVQMAASGDARINDLAWLTQDVWILDYWLRSNAQALVLRAELDHRLDRRMEEDLARRLAAGMLTLGKLQPRVDSVRDVRLAQQFIQLTRLASKLQLLAQLQLEQLDGRLKFSQAADYPLNLRQLTSALQQLQAMVSARAEALATENRQYYLHILLREGAFGLAAMALLVFLLYVMVRKVLKPLDFLQRMLDISGDAMLVVNQDGVIEIANEGAGRMFGYPLAALVGMPARQLFVMNDEMHGVMAALELQVGRTLPVEGMGSGGEHFHAMLNISRFSGESDPPLNILIVRDEHKRRLAESSLERSVALLSVISEIEAMLLARSARDAVFQRLHDTFVEFTSSEECMLVAWSAQDGGDEALQLQAGEWPEFLPLIQQLSQAEMPLAALFRSLSAQPSWVSLPVMLGGEATAGVCLLRPTLSQLGISILPLLGAYANILGFYAEEDRRKLSEAQLRAVLQEEEAVYSASPVGLLRLNEHFQITRANLTAESIFDVGDEYGLSGMHLMELLASEHGWYELAEQMSKMQHDNARIHCELECLTGTGRPIWVLFEGQLLFPDASESVIILACLDITERKMAEFELRMARDQANAANRAKSAFLATMSHEIRTPMNGVLGMLELLAMTKLDAEQSDTVLTIQDSANTLLRLIDDILDFSKIEADRLEIVPTRTAVRPFMESVRSLYHENASKKGLDLSLTLDEKLAPTLVLDPLRVRQILQNFISNAIKFTSRGRVDIRVKVMDTLANYQVLSFEVADTGIGMSQEQLGKLFQPFTQADSETTRRFGGTGLGLAICRRLAGLMGGHVEMESEQGKGSCARLLLEVEWLAELVEPVVLPEQRVPLESVAALSGGNLADEGEELFPILFAEDNPTNRKLTLKQLEKLGYPADWAEDGDRAFSKWLAGRYSLILTDCHMPGIDGYQLARLVRAHEESHPERGRIPIVACTANAAKEEVDKTREAGMDDFLTKPLSIHSLEAVLRKWMGHGGEEEIEPLARELAPPPPPEPAQDPLPVDRSVLEVYSNGELSVELEILREFQTGNLEDVAELRAALQAEDADRVGFSAHRIKGASRMVGANEMGAAAEAVEKAGKAHDLEQARRAMALFEEKLAAFEGWLAGQVEIAM

SEQ ID NO: 6547 - protein, 276 aa, Chromobacterium substugae
MNRPQSLYPALEQALLCPDVEEKLALAEAARRDWLAGALPRLDAPAPYSLPEAGRPARPELVHPAKVPRRGLSTPHGHAALLHAIAHIEFNAVNLALDAAWRFREMPDDFVGDWLQVAAEEAKHFRLLQRRLLDLGFAYGDFPAHDGLWAMSRRTDNDALARMALVPRVLEARGLDVTPGIQRRLARIGDDASVAVLDVILREEVGHVRIGNRWFCELCRQRGLEPQAAFRGLLEAYAMPHRPGQYNLAAREAAGFFADELQALAALDDSSAAIDN

SEQ ID NO: 6548 - protein, 71 aa, Chromobacterium substugae
MMNLIKRMQRNRKLALAVLILSTLLFTALSAAWRGGEAGSIWLTIACPVLLLLALAGQLSALLALLQKPRK

SEQ ID NO: 6549 - protein, 139 aa, Chromobacterium substugae
MEHQVFLRQLESHSLPASDFNHQAHLYAAWGYRREYPAPEAAARCAHALSRFAMANGAATKYNHTLTMALLAIAYSRIESSPALGGDWPAFLDCCSDLAQDARAVLEQYYSAERLMADSARKAFVKPDKQPLPVSCLLN

SEQ ID NO: 6550 - protein, 366 aa, Chromobacterium substugae
MKKKLIRKVLYSLLLLLPAAGALAEDKVLNVYNWSDYIAKSTIPGFEKQTGIKVKYDVYDSDDTLQAKMLTGRAGYDIVVPTSNFMAKQIEAGIYQKLDKSKIPNLANLDKALMAKIVDADPGNAHGVPWAYGTDGLGYNLTKVKAVLGAGAPLDSWDILFDPKYLSKLKGCGVSVLDQANDVFAVTLHHLGKDPNSKNPADYQAAFEALKKIRPYITQFNSSGYINDLANGDICLALGWSGDVNIAKHRAAEAKRSYQLAYVIPKSGAPIWFDVMVIPKDAPHPEAALEWINYIETPQVNAAITDEVFYPTVNAAARKFVKPEIANDPTIYPPESVMKALFLLKPLPPDIMRLQNRLWTQLKTGR

SEQ ID NO: 6551 - protein, 286 aa, Chromobacterium substugae
MISVPFLFLFVFFLLPFLLVVGISFSQQQLGIPPYTPLVKLENDVYTIALNLSHYRFMFTDDLYFATYVSSVKMAFFSTVLCLLIGYPMAYYIARAEGATRNTLMMMVMLPFWTSYLIRVYAWIGILKNDGFLNQFLLWLGAIDSPLHLYHTNWGVYIGMVFSYLPFMIMPLYAHLVKMDLTLLEAAYDLGAKPWRAFWQVTLPLSKNGIIAGSLLVFIPAVGEYVIPELLGGSDTLMIGRVMWDEFFNNMDWPMAATVTCCMVLLLLVPMALFQHYQVKTMEEAR

SEQ ID NO: 6552 - protein, 279 aa, Chromobacterium substugae
MIKPSKPLSFLVLGLGYGFLYLPIALLVIYSFNESKLVTLWSGFSLKWYAALLDDDELITAAWLSLKIALMTATASVVIGTWAGFVLGRFGRFRFFTLFTGMVNAPLVIPEVIQGISLLLLFVAMEQSFGWPEGRGVFTIWIGHVMLCVSYVAIVVQSRVRELNLSLEEAAMDLGARPLKVFFVITLPLISQALVSGWLLSFTLSLDDLVLTAFLSGPGSTTLPMVIFSRVRLGLNPEMNALATLFIVLVSVGVVAANIYMSVMTRKREKEMRLAFANG

SEQ ID NO: 6553 - protein, 489 aa, Chromobacterium substugae
MKRVLISALIAALPGVALADAKADEIARLKAQMQKLQAQMAELQKAVEAATAEKPAPAASAAADDANADLKERVAGMELKVDRLNTAANEGPIAGLSVTGYLDPTYIYNRGNNSAGFQFLNHQNTYAYSNSTFGDVYLDIKKTFGVGPTAPSAEISIMPNRGSGNTLLDGGSGNNIINTAVINVPLSDTWSVNAGLMNSFGGYEVQQSNQMVTLTHGLLYDFSDPGSYVGAGFAWSHDVWAWKFLLANEQYRTHANLANAGNSSVTGAPQVKSNNTPTMTARVDYTWSSALDLGGSFNAGRQTLLTGSNCQGSYGYQCTANSPYSNYFFTEADASYTLGDVQYNAELDYGQQQNAAWNGGNAQWYGVSLLGHRKWMTDTVGKMGATLRYDYLNDSKNGGGGGGIALGSSGYDGTNAFGVSPACVASGAANCKGANRQALTADLLFFPTDQLTLKLEYRHDWASESVFLRNDGSFRKNNDLLGAQAVYSF

SEQ ID NO: 6554 - protein, 344 aa, Chromobacterium substugae
MFRNFLPHWPLPRYRADSARSHHGAAGYQNLYPFKQPRFADLLRWNWQRWRMPAVAHRLQDIRRQTPDAAALAANASQPSYTWIGHASGFIQLAGLNLLLDPVWSERASPLRWAGPRRLLPPALALESLPRIDLVMVTHNHYDHLDFTTIRRLARQAGGAPQFVVPLGVAPTLLRAGVPAAHIHQLDWWESFKLGGVEVVLTPAQHWSKRMIFGDRNRALWGGFAVRGDGLQLWYPGDTGYHPELFALIAERIGSLDLALLPIGAYQPRWFLQAQHIDPAEAVEIFRIMRPRRALAVHWGTFVLTDEALHQPPLDLAAERDKHGIDAADFSVPAMGETFWLPPD

SEQ ID NO: 6555 - protein, 572 aa, Chromobacterium substugae
MTIHQLINERVQAALAAAGAPDAPAVIQPASKPEFGDYQANGVMGAAKALKTNPRALAEKVVAALDLAGIADKVEIAGPGFINIHLAPEYLARRSEAALKDDKLGLAPVKPQRVMVEYSSPNLAKEMHVGHLRSSIIGDALARVMEYVGHDVVRANHVGDWGTQFGMLVAYLVETSHAGDADLQLSDLETFYRNAKVRFDESEDFANTARDYVVKLQGGDQEVLKLWRQFVDVSLKHCEEVYQTLNVGLKREHVRGESSYNDDLPVIVQELRAAGLLTESDGAQVVFLEEFRTQEDKPMGVIVQKKDGGFIYTTTDIGAVRYRHRELKLDRVIYVVDARQSQHFAQMFTICRKAGFAPEAMKLEHVGFGVMMGDDGKPFKTRSGGTVKLIELLQEAQERAYALVAEKNPDLSEEQKREIANAVGIGAVKYADLSKNRMSDYIFNWDTMLAFEGNTAPYLQYAYTRVQSVFRKAEDYDAGAKIVIAEPAEKQLAAALAQFEDTLNAVVEGCYPHYLSQYLYQIATLFSRFYEACPILKSEGEVRASRLQLAALTARTLKTGLDLLGIKVLEAM

SEQ ID NO: 6556 - protein, 210 aa, Chromobacterium substugae
MKPDLAIRLLHQCRHATLATQSRQYPGYPYASAIQFFCDERQRPVFVVSALAEHSKNLLADPRISLSLLSPDDDAAQSAARLTMLGDAERFDASDALCARLLRYQPEAEEWLALDFMFFRLRPMRTRLIAGLGSMGWVDGRAWNELPALSLEEERLLLEEAQAALPESIRALGCDCFGADLLWRGSYRRVDWDEALPEPARIRERLAQLG

SEQ ID NO: 6557 - protein, 54 aa, Chromobacterium substugae
MSFPDIGGVCIADCVRALRLETSSPFREACRNFIRLFRNRLNAEKMPNGFNTNS

SEQ ID NO: 6558 - protein, 851 aa, Chromobacterium substugae
MNYKRKTLVVALSLIGNVGYVQLAHADDGTLDRVEITGSNIKRSIKKETAVPMTVVKTDDLVKQGLTTVEQVVNSLAANQSSQGANAAVGASTGGAAFASLRGLGQQYTLVLLDGRRIVNQPLDGTAVDLNAIPLSVIDRVEVVRDGASAIYGTDAIGGVINFITKKSITGLTIGGEFVGPQHPGGKEKSGSVTYGYGDLAKDGFNIYGSFDYHKTDPVFASQRDFASLVTSSTKLSANSFPTTYLDPTTGKMVSAGYPQCSPPYSIPKGGVCKEVFSLFPGIQPEVEQKSGIVKGTTMLGDHELSLQYMVTQTKNISSVAPAPLSGDVTSPTAPGLPSADGPFPLYGRTVPMGNRVDQSIATTQRLQVNLEGLLAGWDYRAGLGHSMSIVTHDLVSGYPGTSQLQSALNNGFDPSNPNPAAWQSIGVSGQIENAKSTLDTADFKVSKEVFQLPAGMAAVALGIEARHEEMAHNYNLGLAGNALSTGLNNTTSASGKRSSQALYGEMDIPVIKNLDANLAVRYDHYSDFGDSVNPKIALKYQPTPQVLFRTSASTGFRAPSLYNINQPSQLQLTEDNYTDPVYCPGGIKQPGAGSQSCVSTQQNLQVGGNKHLNAEKSSSLSFGVVLEPVKNFTASADFWWTMIQHTIGTLPEQTIFGNPAKYANLFVRDANNNLLYVVDNYQNLGNTSAAGVDLGLSYSFPHNAFGNFTVSLDGTYTSKYSYQHEENGVYVSSLGAYVDSAPTFRWQHNLSLNWSKGSWGALLSQEYKSGYTDQNTIIPGAAHNVNSYATWNLSGSYVWNKQLSLTAGVRNLFDKTPPWSNQQATTPQGYDPRFTDAIGRAYFLKASYKL

SEQ ID NO: 6559 - protein, 217 aa, Chromobacterium substugae
MVSASLKRNPNLRNRRSAGLIGVIAFHALLIYALVTGLAQGVVKVIQQKVEVSVISEPPPPPPPPPPKIEKVVQPTAAPKPQAYVPPVVNPPPVVQSANAIQSVTSDPKPQPAPTPAPVVEAPKGPISAKANCSHLEAPEYPSKAQEDEIQGVVRVVFGVGADGKFSGISNIGFDGSIPPRYRSSFKSAISAALQGYTCQANSQLTQEFGFKLDSGS

SEQ ID NO: 6560 - protein, 248 aa, Chromobacterium substugae
MAKFTQALLGKALAAAAALSALPAMAAETVTTDNPYGIDALWSQGDFVARGTLIILLIMSASTWYVGIVKLLEQRRLIKQGHELLGHHGVDLQKAASELADEGMYSAVAQAGIEAASEHKGELSNRVDLNTWVSMAISDAVDSASHHMQNGLSVIATVGSTAPFVGLFGTVWGIYHALVKIGTSGQASIDKVAGPVGEALIMTAIGLAVAVPAVLGYNWLVRRNKLVLDNVRVVSGRLHASLLNNPTR

SEQ ID NO: 6561 - protein, 128 aa, Chromobacterium substugae
MLSAINTTPLVDVMLVLLIIFLITVPVVTQTVKMTLPKEQNIPTQTKPENIVLGVDTHNTIYWNTLPMKSQEDLLARLVKEAKKTPQPEVHIRGDAAAKYAPIGRIVLAVQQAGIVKIAFITEPPARN

SEQ ID NO: 6562 - protein, 229 aa, Chromobacterium substugae
MAMNVGSSGEDDLMMEINTTPLIDVMLVMLIMLIITIPIQTHAVKLDMPVNTPSKPLEKPVVVQIDIAPDNSVLWNGEKLAGREQLEAKLTAAGKASPQPELHIKPNKDASYEPVAMVLAESQRLGLTKLGIVGSEQFVGSTAPFVGLFGTVWGIYHALVKIGTSGQASIDKVAGPVGEALIMTAIGLAVAVPAVLGYNWLVRRNKLVLDNVRVVSGRLHASLLNNPTR

SEQ ID NO: 6563 - protein, 128 aa, Chromobacterium substugae; identical to SEQ ID NO: 6561

SEQ ID NO: 6564 - protein, 127 aa, Chromobacterium substugae
MMEINTTPLIDVMLVMLIMLIITIPIQTHAVKLDMPVNTPSKPLEKPVVVQIDISPDNSVLWNGEKLAGREQLEAKLTAAGKASPQPELHIKPNKDASYEPVAMVLAESQRLGLTKLGIVGSEQFVK

SEQ ID NO: 6565 - protein, 356 aa, Chromobacterium substugae
MPLAACNKSDGAEKPAAGKSASAPVARSLSSADVIKAQIQPLAATIPFTGSLTALASSAVAAEVDANVREVKVREGEAVRRGQLLAVLDAEALGQSVEEQNAQLDNTKSRLKLAKVKLDKQRELLGKGFISQVAYDELESDYRVKEGELRAQASQVARAKRLLQDTQVKAPIDGVVFERKINPGEVASRNMKLFSIANLSVLEIAATVPSRLVSQVRVGMDASFSVDGRSELQHGEVVRINPVAIPGTRSFTLFIRVQNPAGQLKVGQFAKGGVVLRAVKDQVVVPLSSVRDIDSQPWLMVAEKGKLVKKPVTVQLRAENERQAAVAGIAPGASVIVGELLGSKIGDAVGLPGGQG

SEQ ID NO: 6566 - protein, 568 aa, Chromobacterium substugae
MAAPHQLHVRRQLHALQQLVDVGHRRADVAPFHIGHDADLAHHIGALDLARADPLPGFDQRGQRHHLRGAVLVAVARHLELVQQLLAPRVLGDAQAHVVVVAIGRFPGGHHVAGQQHRQQIAHPVEVHAQAERGVALQGQAQRRVALGEVGFNVSHALDLGDLAHDLARHRVQLAQIAAAQADEYRLALLFVVGHRLDQHAGHRLHPLAGIGDHFVQAALALMLVADVQSQRAVVLAGAEIAGADIQRHRADLLDARQRLGQLPSLGGGVFQRGAGRGLVHHVQLAAVALGNEFAAYHRHQHEAARRDAQRQRQHRLAMAQHPMDHLGVALGQAVQRGFEPIQHPSQRAAVLVAVVVRVVPDRRQHRVEREADEHRNQHRHRHGEAELVEEAADDAAHEAYRQEHRHHGQRGGQHRQADFIGAVQRRLVMALAERGVADDVLAHHDGVVYQQADGQRQRQQGQDVEREAHQLHGEQGAHQRHRQRQAGDHRAAPAAQKQEHDQDGEAGAFQQHRLHAVQRFLHILGRIIGVAQHGAGRHPRLEFFQQLLHPGRHRHLVGAARRLDVDA

SEQ ID NO: 6567 - protein, 159 aa, Chromobacterium substugae
MPVTIMVSLPLAFGGVFFALFLWGSTLNMFSIIGIIMLMGLVAKNGILLVDFINRCRQEGMERNAAIAEAGRVRLRPIMMTSLAMIFGMLPLALGTGDGSETNRPMAHAIIGGLATSTLLTLLVVPVVYTYLDSLRGRIRRLLGGKRKDALVLKAENGK

SEQ ID NO: 6568 - protein, 122 aa, Chromobacterium substugae
MKTPLTVLLLAACLLSAGCATQQGYAQKVLVWQGRDANELLAAWGTPTSQMTMPNGKLLYTYRNAYSQDMPIQSSGFYHPWGISGGGSVYYSCTTNFVVDPHDHVVQSVSFDGNDCVAQPRK

SEQ ID NO: 6569 - protein, 595 aa, Chromobacterium substugae
MCLRKPIAAALMVWGSMLPMHASAEKVLHGVFNAQETGFDPAKVSDVYSAAVIEHIYDPLLTFDYLSRPVRVIPNVVTAMPTVSADGLTYTFHLKKGIYFAPDPAFKGKKRELTAADYAYTIKRLSDPTVASPLSDTFTGKLVGLDALVKKAGKGKLDYDAPLAGIQTPDRYTLQLKFKQPFPSLPYVLAGSWVEAQAREVIEAYGDNTNAHPVGTGPYMLKDWKPGNSMTLVRNPNFRSETFHYQAGADARDQRIAAQMNGKRYPQIDRIEISVIQEEQPTWLAFKSGELDVLSGNPSIPQPLIRQVLRLDPHNPARAELKAEYRERGIQLNRSLEEGITFYAFNMKDPAVGGFGKDKIALRRAIAMAFDNSETISNIRRNQAVPVQYIVPPNVAGHNPDFRAAYPFNPALANALLDQVGYKIGAGGYRNQPDGKPFTVDFVTGPTAIDKQWNEYWQKAFDRIKVRVNFRVVQWNEQAKALQECKFGIAGAAWGADYPDGDDFMQLLYGPNTGGSNYSCYRSARFDSLYEQSRVLPDGPARNRLYDQMNKIVAGDTPWVYGDIRYVNGVAQPWVRGFKVHPNFNAIWRFLDVQK

SEQ ID NO: 6570 - protein, 312 aa, Chromobacterium substugae
MSAFIIRRLLQMIPTLLGVMLLVFTLFSVVGGDPTLVLAGKHLTPEVLAQIRSQLGLDKSLPEQFWLFVHQVLTLNFGTSWSTQQPVADIIGSRVGPSLTLAGAMLVVDLLIAIPLAALVAYFRGGLTDHLITIICTVAMSISALIYIIAGQYFLAFKLGWFPVRGWGDSFWTNLFLYVPLPLLMGLMVSLGPDIRFYRSFFVEELGQDYVRTARAKGLSERRIMLKHVLRNALIPVVTSVMMSLPYLLIGALVLENFFGIPGMGNEVIQAVNKSDFPVIKAITIYIAIATMAFNLLGDLVYKWIDPRVQLK

SEQ ID NO: 6571 - protein, 353 aa, Chromobacterium substugae
MTTLQNAAGHPPAMPSRSLWALGWQRLKRNKVGFISLWIVLAYLLVAIGGWCNLIGSSWTDEVGVPYAPPSWIKPSADDVLPPERAAAKAAAAPIVAMSPAEDPISEELAAAQKHVGDYAGKAQTRRDTLPFGGDLQGRDVIQKTLKGTSTSIFVGVFGAVCSLMIGCALGAASGYFGGKTDDFLNWFYSVFTSVPDMLLLLSFAAVSGRGIGTIISVMALTSWTGTYRLVRAEYLKLKGREYVQAANAIGAGDMRKMFIHILPNISHLLLVQFSLLTVALIKYEAILSFLGFGVDVRQVSWGSMLEEAPTELIQGYWWQMLAVTVAMSVLVTAFSLLVDALRDALDPRAVAK

SEQ ID NO: 6572 - protein, 186 aa, Chromobacterium substugae
MNQQNTLLSVRNLKVGFRQEDGGRFEALKGVSFDIPAHRTVALVGESGSGKSVTSMAIMQLLPPQSSEIDPASELLFQGRNLLRLSRGELRSLRSSPRDSRSRLRPWNSSSDAGSISLDCGGSSCMMAIDVTDLPEPDSPTSATVRWAGMSKLTPLSASKRPPSSWRKPTFRLRTDSPDWQEHFLC

SEQ ID NO: 6573 - protein, 439 aa, Chromobacterium substugae
MLIGLAIAVALIGMGLAYLGVRQVGEWRASRGQLLGGALADLGKGVQSYVVQHHDQLVLAVLNQTVIPPLNGVANPLSPTPAEIASVVGLPSLGTKPPLAGASYQIVISGDDPTQGNRQCVASSPGTCNINALTYVDKPLRLPYPSASDDVDYVAVASAVQQIGPDGGAAMPPDFSKLTFRTAANSNSIPIANPMTNVAGIVAVRGGYNRSDLNVFLRLDGSKKMLGNLDMGAKSIVNAKDINGAGALVMNGDITSNFGNMNVNSGSVTAALDVTAKRNLIANGNLSVGQNGNINGSLGVNGNATVGGSVNAGGRIQTGEYLLAGQVSEGDTQGCNTPGLIARDANGLILSCQSGRWATSTKNNPGVVIDGNNACGHGAVSAATCPNGKLIYSGGYVMTAWWSEGQNSPDSSLPLSDTQWQVNLGGGANFCAKARIICR

SEQ ID NO: 6574 - protein, 315 aa, Chromobacterium substugae
MAQQIITDVQLHVRDWKSSVLFPGQIKPGEEYKNFLMKLTEVVLTEQQEVGRRTGFTITIGGLRWRVQRMQQYRYACRLVMNKAPRLNDLRLLDFHTTMMQSDELKKSGGLVLFSGLTGSGKTTTMNAMVVSRLEKFGGFAQTVEDPVEIVIEGWHGDGYCTQIDVADSPSGQEFNFDRRYAEAITTALRSFPARDRSMLMIGEVRDAHSAAELLRIAVDGHLVLSTIHSRDIPSALRRLASLARAGGEAQADEFIADSLRMVFHQRLDNGIPQVTSLDLRDRKDLSQFINKGEYARLEGEIDIQRRKNIQGRGA

SEQ ID NO: 6575 - protein, 189 aa, Chromobacterium substugae
MNASKWRSASGRSGSLKRQAGIDLIQLSVAVGIIAFILSIGFLVVPSIMTNIKSNSETSDLQQEVSQAQRVFGSGVPAAGLTNQLAISLKLMAADRVSGTTILNRFGGTVTWSAIDYYASKDAVQLVSTGYSSEACLRLVPNIQSLFVQIQVGTTTVKDLKAGVALNAAALATACNASTSNTLTYAFSL

SEQ ID NO: 6576 - protein, 368 aa, Chromobacterium substugae
MLNLIKRFFGIAPAHEQKYAGLAKAKRKFMKLRTKFYGDLADSIEDGANPYELFSHKYMLARERGNVMAPLFAYWRDRAASMNLRGAWEGTIPADDLMVIGSGERGDLPEALRFLAKVVKIREGNAEAIKMAIALPVFLLLLMTGVQLGVALGMMPIMEQIMPADHFPLVGKVLYYLSQAIRNYWYLIYGLPGLLAVAYFWSLPRWASPLRNRLDRHLPYSVYRDLKASEFLVSLAALSQANTAVYDAVLLLEQGATPWMRWHLARIRLALTSNRSILKAMDTGLFSEEIFDRISEYSERSNFENGIRKIGLTTIEEISEVISARSAVMRNVLIVVVGLFILLTIAGMMMTALEAGNQIQQMTGGGSM

SEQ ID NO: 6577 - protein, 639 aa, Chromobacterium substugae
MANGDDAFKSLLGRFGYGKGPAGRAMDAAPAEHGAEDDEAEEVLPLAVEPDLLLDAPLQHFPDSGFGISLDSVREAVSAAGQPEAPAIAPAEAAEERAPFAPLRMEELLAPLEPVPSSPPPARRAASLSEERLALLHRVAQEARGEGVHSSEEFDMGYLEPLVDAVRQPVALAQEHEVSEALPVPSWARIAAERGLLGHEAGQVFDSLDALGLVNDDRYAEQAAAYWPVEAQPQAFADLAAIALTARSELPAATRNGDGLGRHGYFYLKGAAYGVPALIVADGSSREARGRVAEICGELDQAGKRWRVVLLTSYSYRWALRRFLWPEIVAAGDVGYAMAVADAARVYAAPAADGRRLLLLETAQGMEAVAMMDAGEAAQWLGALGAEPDPADAGIWCAAGKVGGERGKAAALAAFGLDDKMVVNRLVKELSRPGAIVFVAGEMAEAMAAALMAEAWSQGVAGAAAGSAAASGLPSVWLNPDAQKLRAHHGPALAVFPGRNSTAESALMLLLGEQPGWAKGRVSMGVNTVRLPGLCPICALSVDADLAARELTEVVSNFRSADFGNVKTRNLREPCCGSGYAGEVWLSEVWDGKLCQRDFGVSMLADLVDKGLRPDQRISSLLFQAIQAGRVDYRSAGSL

SEQ ID NO: 6578 - protein, 579 aa, Chromobacterium substugae
MCSWFSEVMGRGDAKSAASPESRQDGRSRQPASQGLAVRRIGGLKSESIRHLGWRQEGDLVLPGYENSALLLGSAKSKQYILLLEDVAYLQLRGGDLLQRFDAGVRSRTKWSCLGIYVGSMEEILLVHSQLQQHSVESSHRDGDAKTGGYRNFDLVIEKAIDLRATDIHFEFRDGNQVLVRYRVHGKLRDSDPKDRLLRDFNAMMDAISTAYNSRADSSSRSHNHFDENKHQSCSINMAVQGRSYQLRFQSVKENRGVDVILRVLLNEAVEKDILTLSQLGYSDDQVEALEDAVYRSPGLTIIAGETGSGKTTTLRTLMTYERESGKKFFSIEDPVEYIQPHVTQIPIQRKAEDGKKEGGETPFGAAAKVLLRGDPDKVMGGEIRDAETGSFAKAMTQTGHQVLSTVHASSGFGIIPRLTDDEIGIPVQALAAPDFLTALVYQKLVPVLCPECSLLAAEVLDDEYLMVIASLGIDVGMVRVMGPGCPACRNLGTKGQTVVAEVCEVTEDMLPLIREGRFWEAEKDWRAKSNGKLYDPRMLGKTAMEHALYKMSLGLLDPRDVESAFRKLKKYRPLSLAN

SEQ ID NO: 6579 - protein, 131 aa, Chromobacterium substugae
MLLLLPALACAETIDSFAKNALAPAPAAIPGGLPPLPSQAPPPPVVNSGTALPGKNGSSQVFDVVFIQGNGKVRKAYLVVDGRYGKMVREGDVVQSWKVVAVGDDYVDVAHAGKRKRLLMDAGAASGPEQR

SEQ ID NO: 6580 - protein, 427 aa, Chromobacterium substugae
MARVLFGNLAVEVQWEPLLGLSKESEEVRELASRRGAKQCLVLQNALGVRVAGLANLPAKGRKSELFALAGLLREVSDDPNILFLHQDPEDPSRLVLVAIHDGKPMQDRVIAREAALDAARQFIQEVGTGVTILGDIDDDMLQVTRHVNLEDIVTSLTDEEKAAYRLQPLPGTRLLGVALLFVALGVAAGGGWWWMQQQEKDRLAALDAAASQQPDPMTTYRNQMQSALKQAPLNHGAAYARTVLAVVQQLPFEVGGWRVGNISCKEKGCTINWKRQDGGNFQTLLEQRKTVQFLDMGSATEVVPLPEAQAALQSAPVDVSKFYMTAGVRMQALDDMGKTGKNEDKLMAVVLGKVDPLVPLPQELKGRVGKLPALAKGSWSMQGHLAFLDSVPGLMERAGNMTLDAVEVTLNDKKPEFTAKGTFYVQ

SEQ ID NO: 6581 - protein, 569 aa, Chromobacterium substugae
MKKIVAAFCGTTLLAGCGTPGMLQKTDDRVTETQQVMRSAESNLTYPSLPLVERDAGAWFAQRSVVMDDIDSLPPRFDQRASFSSGRQLPLSLMTEQIGREQGVTIRLARDIFGITPSKNNANGGSPQAGMPTPPAGMPPLPGGMGMGGSGVMGGMGGMGAATYPGAQTQDAEPRAQLNYSGTLRGLLDAVANKTGTNWSYRNGVVEFSRLVTRTFQIKTMPGVSTYSAKVGKSSQTTSGGSGGSSSGSGSGGGGGSSINFGSDSSVSMTSELRYWDKLSDTVNSMLSPMGKAMPSEMTSSITVTDSADVVERVRQYIDGENAVLGRQVSLSVQVFTVSLSEKSAAGIDWKLVYQSANSGWGSTFSSAFGKPMEGAGQFGVTMNSGQFNGSKILLQALSQQGRVSTVVNTNVVTLNNQPAPVAVTNNQGYLASITSTPGSNGSAPSVGLTPGVVTTGFVMNLLPTLLDNRSVMLQVQIDLSELIEIKEASSGGDSSNSSSIQTPITSAVQTMQRASLKSGQTLILSGFRRAKNNTTRKGAFNYEGGTKTAEQGDDETIIVITPQLTEGV

SEQ ID NO: 6582 - protein, 137 aa, Chromobacterium substugae
MKQKTLIAASLLMCALHAEAGFLYLDNDSAKDGGASETAGPAADGRAIEFGQGRGVLKLVPGKGRISAALRDYARANGWELAWEMERDFPIDYPATFSGTFLEVMEQVAKSLQNSDTPIRIKVYEANKVIRVIHATR

SEQ ID NO: 6583 - protein, 304 aa, Chromobacterium substugae
MAARNGGGGGGGDDKVFVIIAALALAGLAIYFAPHLWLKWMQSTYSRYLFLAKIPVLGAPFAHGAEWLREQPTLARAIALDYALGWLIALPIAPLLLKHIRKEHAVRRVWSGRPANRQTFNKVIRARGLDPKERQLYQVAEWMRLNGLDHEAADFDEKFLAALEKQVGEPSNPNDPLLVGFARKLGVSPKLVKLACDKHAYRSTAMVRLLHHHREKNGVVRCDWARPILFRHDHPELWAALASVGRKTVFMEGVGVMAHYYMELAERKPLRDVRLYGCLVIMRRYLNLTIQQILQQRGMPVPGG

SEQ ID NO: 6584 - protein, 85 aa, Chromobacterium substugae
MEGQLWVFAAQSPRFTPWLDSKAFYILPVLILKFNWFTVLTMLAIFGALILFEYKGVPIEQAFRYVKAKFSGRLYRARPAYRSPD

SEQ ID NO: 6585 - protein, 83 aa, Chromobacterium substugae
MMTQHKTSTKFAELAKAAFDRLPYEALLAAVGILIFLAGVTVGASWGGGSGTSAAAPADASIRYKGKDEQGRPHYVVTKDSLW

SEQ ID NO: 6586 - protein, 372 aa, Chromobacterium substugae
MSGHDDDFDNSSKVSRADLESLLNRFSDASDVFLKQDTYPVAKVFGRNRLVMQRRLQQNEMRQLLTAAYKDNVNGYDMVMGKARSLDFVYEGVDGQRYRVAVARDMQSETSGPSATFRRIKPEPWTLKEADTPEDLIYVSRTQRSGLILVTGPTGSGKSATLSSLLRDHVERPDSSCILRTIEDPVEFVYGKVAAPTAVIDQMQVGTSVESFSDGIRAHLRMAPTHMLVGEVRDAETAQAAIWAAQSGHLVYATMHPNTIPELFDYWSKFFPQAMRAVMIYNLATTLKYVVCQHLVPTTDGKRVPVRECLDFTKLGSAGTVAQEIAANSERVFQLMREKVNLYGQPMRQSALDLIEQGRVRQEDVITYLMSG

SEQ ID NO: 6587 - protein, 266 aa, Chromobacterium substugae
MLSIGLAGGAWAADSIPQEDGGALQSALNWQPKSYLSQEAALKVRAVYNAGLSYGAQLGQARECERLNAMLQSQDATLSQVFDFSRLLLPDSLLPPVLSSSKNTVRLESPTSMVSVEASYRVREDARFVTTAPSWWDYMQQPVPEVREPDAALKPATPEEKAAWDDGVRQGWASGVAAAKGAYESKLAQLKETFNGMLLYKMLWLKQMVDAPKVVRQEQKVVDADGGIDVRVSRKVVSQPVVFVKDLPRWKAINDLGAGEFFEGGR

SEQ ID NO: 6588 - protein, 244 aa, Chromobacterium substugae
MRAATPFLIAGLACALAGCAAPAARQAAASPELAMLAKAAEDAARSQQLLARMTVVNSGDKAMQDLKASLASTPSNDLNRLYSTEYVGVPHGIVQDIAQSIGWRFEERGSADVDSIVRIKSASQPVIAVLRSIGDQFPFVLAVDEKSRTIVLDYTRSINDTREPKTAFQASASKPLIQKYSMDGGIFADRKLAARVADGYKNQGFAAQVRPAGRKFQIAVGPYVDDGAGERKVRETLGLHQRVE

SEQ ID NO: 6589 - protein, 125 aa, Chromobacterium substugae
MLAYWFADEEGDVSVPEDWAREHGGRIGRDAPAVGFQDGVWYRLHGFLPSHLLLARLIDMPHESLLSLCEWAGAHPRTMLFRKLERVPEQIGRWKSDFDYRRGELEQVLGDADLAAQVLPPATLQ

SEQ ID NO: 6590 - protein, 982 aa, Chromobacterium substugae
MTTIFDAFDNFMKRIPKIRGAALWDKCAWTTGSGNVISLRGGSLMTIYKLDGALQSFDGEAYQERLGKLSAMLASLPRRSGIVVDIIFQRDKETSRKEVRKQANSIRSATARIGMDVNFILDEREEILSRTVTSEIALIVVTTSPSILPKEMRKVAANWSGGEMAQSESFVPAMRNRHLGVCKEYVEGLVSIFSLKAQPLTLEQAIVLDADLWDGSGEGLSPITPDSVKKTGVLPARAKSTIAGQRDDIIPPLPGLQIFRRQLENIPEEGVARVGNRFYSSGYFEFPISQPEVFNNLLRILPTARIHGEIPFRVAFQLLSGSASGRFSAKKSVAQFLKFSTFGGQNSKIVDAINEVKELERIGATTFVGVKISVVTWGGSKQEATDRFTELAAALNGWGGGQVIQEFGNPCEVAMGTLPGFRNLAPELIMPSQMLAAILPIERPASPWGYGNMMMLTEDGKLFVYQVGSQLQQAWVDVMFATMGSGKSVLLQALNLGSILQPGKDDIPRMAILDVGYSSKGLIDTVKASLPVDKQYLAQHYRLSIDKRNAMNPFDTMLGCRAAVPDEKAFLVDFVTLLLTPVGQQQPVPEIAELVDTLVTAAYRYFSIEKPKKYQPRRNPEVDEALQRNNLHPEEEASWWSVVDMLFDRNEIRAATVAQRYAVPIIPDLSQVMQATPSIKDNYTDAVIPGGSSMLDFCNRMLGSISSRFPLLAYETALDFSNAKIVAVDLADVTGGQGAASQKQGEVMYLATSAFLARGFYMDDEVVPTMDCPGQYMEYHRRELRKNRNEVKRIVYDELHNISSPMVLGLIETLVRVGRKYKVHIALASQEHTDFPKSIMNLATNIWVLRADSKEVRDDLKKTMDLSEYADEALANRIQGLTPLGAPMLLYSRIKGAVVERVLYFKPGGVELWAYATTPANVEIRSQVARFVGYREALSRLARRFPGGDAVSELDKRIDAWGGAKREADIIKEIVAEIAGGH

SEQ ID NO: 6591 - protein, 200 aa, Chromobacterium substugae
MLSVQIYRNRNYPGVDDGVYAVSGRPAAGFLASLFEYRRHACQFCGYRSREFLEGEPLDDDYGNESPDNWLVLCHYCRATQHVGAALRAGAFWGVEKGRSQEAINRICRAMPRLARGGLGHNLELHLEQSVKLVESYMGGRGTVDNLATFFKVLMKNREDSYEETVKLLTRNGLRLIFPLSYRPDGVEALRRHDAAQSEG

SEQ ID NO: 6592 - protein, 119 aa, Chromobacterium substugae
MLKFKKGNLILMVAVLALLATETSLADTVATTAGSSGKSLMDTAKQTKDLISSFKEVMGMGLQLVGVMCMGFSGWNIYVSGKPGREDRGHMKTALFAGLGGVIAYFAPDWIGMGGHTLM

SEQ ID NO: 6593 - protein, 86 aa, Chromobacterium substugae
MFDQTLLAGDALAAGNAIRQVVYALSQLLGLAAMGRAGWAMYKSGDARFAQAGDGWKIFILFLSGIFLYYMEDAWALVRNTFPNLS

SEQ ID NO: 6594 - protein, 386 aa, Chromobacterium substugae
MVDFNNQPKGAGKDPSKMKLILFGGVAIAFFAAMLVYKKVSAPKTEGQDQTAMASTPGKMADTGAADAGNLAQADDHSQPALYGTADALLNGQRDDRQKAAIASGGAYVAEVGALNDRGDPGAAPSGGGGMPPVPQMPSMQPLLDAAGMQKQSAWLQKFQNNRSRGDAPQQERKLVNWYGGAAAAAGRFDGGASDGARPQRGWKVASIGERVAAVTLNETSSYQTGTTVMVRIVEDGGKRDAQLFGSYTEGYDALVVKLNKMRLADGRVVPVDAVLVDKETNSQAVASAVKGHYIDRFGMIAAGAFLGNYATAMTSGGETSVVNGAAVTTVPKIDQPAKYAVGKTVEAVAQVATAAAARFNKSEVILSRSELVGVLFLDDAFAGGQ

SEQ ID NO: 6595 - protein, 352 aa, Chromobacterium substugae
MRLMAACLLSQAAAAAQPGDAAGGQFYTGSANDPRLAMQASAAAAPQAARPQARDPLQRAMEADPVFGSVMKEAVPFDPGQIRMYRRQVEKVEKLKDSPPVAGEQRTIPVRPGRTVDLTVAVGYPVTVRLTDVAGQPLKISGSVPGMAFLAIHPIPGDAQASVATQAASLAGAAAGLPPAPAGSGGEAKDAIVIDSSGSGSTSLTVFAAGSFRPVVIKVRSLYPRGGERVDFAADLRLTWMGGDALNRGDEYQSPLSGALMAVLKETVGEEMQTVPHNGGDAVKIWKRQSDNRVFVKVRPGVTLLSPRNFRTSTRDDDGGSAYEFDYRPSSMVAGMGGTSRAIVIRWGSYEQ

SEQ ID NO: 6596 - protein, 219 aa, Chromobacterium substugae
MSMMNLNDQEVDRALRDTMGESGNLRHDSRRKTLIILALGAACLLEAVALAALARKEAPLPQFTAVTPDGRQYQLLTSNTPVLNEGQAGQWIAYALPQVLNYNWTELEPHFADASRKYFTEDSWLTFKSQLEAAGTFKSVLDNELISNMKFTSSPILVGKGQQAGVEAWEFEANGTLSYLNRTKRTDNSMKFRVVVGLVTVGGTKDYRILALYMAKDRG

SEQ ID NO: 6597 - protein, 1140 aa, Chromobacterium substugae
MKILTLRLKNLNSLKGEWKLDFTRAPFKDNGLFAITGPTGAGKSTLLDAICLALYHKTPRLDAISASSNEIMTRHTADCLAEVEFEVKGRAYRAFWSQRRARDKADGALQAPKVELADGDGAILASQSHEKLRRVEEITGLDFARFTKSMMLAQGGFAAFLNASANERAELLEELTGTDIYGQISQRVFERARDVRQELAQLKARADGVELLGDEQAARMRDEQAALAAQASALLAELETLRRQRQWRHELRQAEHEEAAAAQAAQAAMEAIRLAEPELEALRAGEPAAAIAPVYQARLRADELLGGARQALNEAGERLDACRAEQAAEHWRAQATAAALAAEEARRGRELSERKRQLDDWSGQHGRYARLGERLAGWRSQFAQLAQLRRQRQEEERGWAALMSGLAQRDGEIERQRTALDEAEQALRQARQAQEAGGRERDALLAGNSLDRLRGDWQRSQREALAWRQLDGQAAGLRQAAAAARDLEAELAEAARRLERQGGLVEALRRDYRQLKERVDDKRRLLAQEQRIRSLETHRAALRPGEACPLCGALEHPAVAAYQALDVSAGEAALQALEAELETLAENGQRAAAELAALQAGRERLRQSAAQSAAAMEEARQAWRAGLAECGAGEADWADPEAPRRRRADAEQAEARLRQALQAAEAAEASHAQASAAVSRQDLQKQAADSALALLLQAREGARREAEQAQARDKALQSQCAGLAASLHADIAAAGFDGEEADAGWLERRQADWQSWQDAQQSLRQLAESLSRQQAVREQAEVQAADWRARWQALGAAEPAGAEAALADADALARCGARAEEWDRELASLQGGKAQLEADLARQGELRQRVDAEWQAALAASPFADSAAFLAALLPEGERERLQARRSRLEGESAQAAAVRQAAAGRLASLREQDLGGADLEALESGWQALDGQRQALTQKQGALEALLRDDAQRRQGQRALLERIAEQAAEADLWQRLDGLIGSAKGDKYRKFAQGLTLDHLMGLANRHLARLHGRYLLRRRPGGELELEIVDAWQGDAARDTRTLSGGESFLVSLALALALSDLVSHRTSIDSLFLDEGFGTLDGETLEVALDALDALNAGGKMIGVISHVEGLKERIATQVRVGGRAGLGVSGLEVAV

SEQ ID NO: 6598 - protein, 406 aa, Chromobacterium substugae
MRILHTSDWHLGQHFIGKTRQAEHQAFIAWLVEQIGRHQADALIVAGDIFDTGAPPSYARELYNQLVVALHDAGVQLLLLGGNHDSAATLGESRPLLSYLSATVVPAVEDDPADQVRLLRRRDGQPGAIVCAVPFIRPRDVLQSQAGQSAEEKQLSLRQAIHDHYQRLYRLACARREELGLALPIVATGHLTTVGASASESVREIYVGALEAFPTSAFPPADYIALGHIHRPQKVGGLEHIRYCGSPIALSFDEAGQQKEVLLVELDDAGLRSVTPLPVPIFQPLLSLKGDLARLAEAIPAAARQADAGLPLWLEVVVRGDDYVADLPARIQQMTEGLPLEVLRIRRERGDAAAALQAQASETLDELTPFEVFARRLALEDIDDELQRGLETRYRSVVESLREGEA

SEQ ID NO: 6599 - protein, 37 aa, Chromobacterium substugae
MAGTGFGMACRVFFAKRGGRDEPLLARYFLMALKPQR

SEQ ID NO: 6600 - protein, 365 aa, Chromobacterium substugae
MNITSDAGRPLPVLMIPLRRCGSHALRLRLNFSREFYSPYPLHIVDFMPLLPLYGDLADDRAYFQLIVDVVGLQAASMVKWPGMAFDPVEIFEAIGDRPRSVHQVVWELLLRAGEHNQARVVMDKSLDSVRYADELLALFPNMRFLNVVRDPRAQVASVNRAIIHDFDTALNVRTWLAAYQAADRLLANHPDKVLTIRYEDFLADQQTILRQVCDFFGIAFLPQMLDIRSSAEAAQISQLSALWSSNHFPPIVAHADKFRQQLSLREIEIIETACRDYMERYGYPMLTPAQLPITDELAAAAETHSRRAREQAWEDLKRDNYRDYILRQGRADYLANLKQRLLRTAAVSVTGLAEPPAARTADTH

SEQ ID NO: 6601 - protein, 219 aa, Chromobacterium substugae
MDTAPTQTGLPANIFKTGGRIRLVDRQQLFGHRALTIWLTGLSGAGKSTIAYELEARLVRGGYSAVVLDGDNLRHGLNRNLGFSAEDRQENIRRVAEVARLMNDAGLIVVCACISPLLRDRETARGIIGEGKFAEVYVSTSLAVCEQRDCKGLYAKARAGEIHHFTGISAPYEAPPRPALALDTGALRLDESVDMLFRMVLHCCSPLAAEERHDHEYHI

SEQ ID NO: 6602 - protein, 580 aa, Chromobacterium substugae
MSTLPSGLGEGSRFDWGAASLEVKGAMSAGSVYRTGNPDPAYVSHANMMDTLNDGDLNYRRGGLVSESWQGYLQGDLRYRDAGLFVSAKAWYDYGLSHGAVPHGHSPNGYAPGAPLDDSRFTALGRFSGVVLDDAYVYGRYPLGQSTLSVRLGQQVIPWITPTTFLGGIQQVNALDFNALGRAGTIPEMANVPAPALYAKLEATPRLTLDGYYQFKFEPNAYPACGTFYSGSDYAQPGCDKLTLNGSLLSILSHSNIATSDQQSAANPLDYIQRAPDDKPYGGEFGASLNYLFEGVGLLGLFYSNQTSPMSFNQMLRTGPGVLLPAAANQGRAAPVGIAGQFRRSYPDNIHMFGVNFKTRLPGGTGIYGELSYRPNQPVAWNGADFLYGVQTGAGPLGYLAHTPTGYLARGYDTFRSSQLSLGVQQPLGRWLGGEARLSGEAGVKYLAGLPDPYTMRYGRVGFGPAPSAASPFCGGGGPSCALDGFVTSVAWGLRAKLAERYAGVAPGLDLTPSLVLGYDPKGYSQDGQFMEGRRSALWRLQGEYRKRYVFELLYLATGGGSYNVLSDRSLAMLSAGVRF

SEQ ID NO: 6603 - protein, 392 aa, Chromobacterium substugae
MSKLPGVIPAIVQHEEQFIAIRRSIHAHPELGFEEEATSKLVAESLKAWGYRVTAGLGGTGVVGQLRCGSGARSLGIRADMDALPIHEETGLPYASKLPGKMHACGHDGHTAMLLAAARHLAESRGFDGTLNLIFQPAEEGQGGAARMMAEGLFERFPCDAVFAMHNGPTLPVGSFIVQPGVLAASADIVSITLTGKGGHGGMPHTCVDPIVAMASIILSLQTIVSRNLAPDQPAVVTVGSAHAGSASNVIPDCAQLELTVRAYSSAIQRQIEGRLRELVTLQAQSYGVEARIEWKPVTRVLVNTPEETRIAREVAEGMVGPQGIVPLPAGAMGGDDFSWMLEKVPGCYVVLGNGVGSKGGCMIHNPGYDFNDDILSLGASYWVKLAEAYLK

SEQ ID NO: 6604 - protein, 79 aa, Chromobacterium substugae
MLHDGGNDPRQFGHVFSPFPSGGKGGAGRRRCRPRAAPLRHQSMNGASMRKGGKWPFSGLISPACRTAELDGGRRLKSA

SEQ ID NO: 6605 - protein, 350 aa, Chromobacterium substugae
MNTCIDLLCLPNCLSGTLFSAIDALQAANKLWHLRHPRQKSPRFQWRLLDASGDPLPPPPWLNAPTPAAPASGQSALLVPGLDMDSVPHLKQQLEQCGPALRLIARRHAAGDVIAANYNGAAMLARAGILDERNATITWLIAGWFSGQHPRVRLLMDRPVSVDGNILCSGAPASATDLALALVRHFAGDELAQSCGNGLLYQAARFEQSGQTLPLLNTPTRDSAVFKARRWLEQHVTEPYRLDQVAEAAAVSSRTLLRHFREVADMTPLQYLQQLRVERAKLLLEVTTVDLSGIVEQCGYEDAASFRRLFRRQTGLTPTAYRRAHSLRASRRWWRAGDDIPAAAPGPLTA

SEQ ID NO: 6606 - protein, 170 aa, Chromobacterium substugae
MNTMNKLAMAGACALAWMMSSAAGAATITPPGAGGAAIPFSAVGPATVSKGEVDVDCSAVFSGTVDGAGNILITSAAFKGIPVCRMIKASATASAPWVGRVTAQNQLAIDGVMVNVNTPILGGQCGPSRIAGTITDSGSDTTIGLAAAPLTGGCAISATLTTTPYMRVTP

SEQ ID NO: 6607 - protein, 480 aa, Chromobacterium substugae
MQDAFTAADELLLKPYGLDESAIEQTLAHMRRHDIDYADLYFQYTRNEGWHLEEGIVKSGSFSIDQGVGVRAVSGEKTAFAYSDAISQDALTRAAEAVRAIGRTGGDGSAGAVEKRKPQSLYPSIDPCHSMEAAGKVALLEKVERLAKAMDPRVIQVMAGLATEYDVVYVARHDGVRAADVRPLVRVSVMVIAEQNGRREQGSSGGGGRFDLNYFDDAVVERYVREAVKQALVNLESRPAPAGQMTVVLGPGWPGVLLHEAIGHGLEGDFNRKGTSAFSGMVGQRVAASGVTVVDDGVMGGRRGALAIDDEGNPTQRTVLIEDGILKGYMQDALNSRLMGEASTGNGRRESYASIPMPRMTNTYMLAGERDPQEIISSVKDGLYAVNFGGGQVDITSGKFVFSASEAWRIENGKLTYPVKGATLIGSGPEVLNYVSMIGNDLALDQGVGVCGKEGQSVPVGVGQPTLRIDGGLTVGGTGV

SEQ ID NO: 6608 - protein, 269 aa, Chromobacterium substugae
MKQKFVAAAVQMVSGCNPSANLARAAELVAEAAGKGARLVVLPEYFCLMGAHETDKVALREAYGEGPIQQALSDMARANGVWLLGGTVPLAADNPEKVLNTSLLYNPQGEVVSRYDKIHLFGFTGQGESYRESNTISAGCVPVKAETPLADIALSICYDLRFPELYRLLAPFDLLIMSAAFTATTGEAHWEPLLRARAIENQCYLLASAQGGVHENGRKTHGHSMIIDPWGRILAELPQGEGVIVAEIDPDLIQSVRSSLPALEHRVIR

SEQ ID NO: 6609 - protein, 1267 aa, Chromobacterium substugae
MRVLKRSLLVLALLLSTVCVLLTAAFCAFTFWLLPNLDQYRPRLEQSLSGALGHDVRIAKLSGHWEGVAPLFELSGVAIANPVSGQALTLSLVTVQPSWTSMLAWEPRLSVLVNGPAVELRRTAAGVIYLNGFDLSSGPSSDNALGNWLLRQLSLDIRNARLSWQDDRLGLPRLDLKQGQLLLERTLLGHRLHLAGLPAATLGKGFELDASWRGDDINSWLQWSGSLRVALNGARADVWSRYMREMGVLRSGEGDGTLEMSFADGSIGSLRADVNVRNAAYTPPSARELVLPQLQGKLQLDRQGDGSYKILASDLTLASATGLAFDKSSIKGQWRPGAQGGGELTLDNVDVGHLNPFIRALGVDANPLFARFSPRGALHGLTLGWQGPAEAPRSFQLKTRFEALGWQPFADLPGVAGVTGSIDFNEQGGRLQLDTGKSEVIYPALYAQSLPFDSLAADISWRQRGAALDIDFDKLAFANADLAGRLQGSYHHGGGGAGHIDLTASVDEVKATRIPAYLPHQVGEHTSAWLRKALLDGMAKNVRLTLKGDLDQFPFPAGKGGEFLVEADVEKAKLLYQPGWPAIDDIDAKLTFHNEAMRVESTRASTVGVPLRQVRVGIDQLGATAPWLKIEGEIDDKLDRMLAFTTKSPVDGWLGGFTGKIRAAGPAALKLQLAVPLAGEDSTKVRGDIDFKHNRLLFTQLPLPELTAVQGRLTFTERGIDSKGVAMEAFGGAFRLSAHTGADKRMRFEVGGEADGKRVLQQYLAPLAPLAEGRSRFDSQFVVRDGLESLQLSSSLQGLALDAPPPLGKAAAAAQALQLQLHPAPARFGQAMRLEFALGTALNGKLRLDEHGNLQAGALGLERDAGEWPATGLALRAQQARVDLDDWWQRLSRLGGADGLSNGNMILSFDLDAPELSAQGFTLHQVNAHVFNRPGTELWSVKLRSREATGLVSYQPGGGGALEANLDRLALNWPLRPDAAPTPGAAAKPQLPAMKIHIAELSLQGREIGKLDMTARRDGAVWIMDPLKLTTPEGSLSGSAEVNEQGAGSVDSRFALETANAGKLLARFGQGDVFRNGQGKLSGQLNWPGGLSDLDAAHLSGQLSLDFKNGRFAKVDPGVARLLGVLSLQSLPRRIRLDFTDVFSEGFAFDTLQGAAGVRNGLFTSSKVEMRSPAAEVTISGEVDLGKETQALKVHVVPHVAESVALAAGAALLNPVVGIATLAAQKVLQDPVGKILSLDYAVSGSLKDPQVVRVNVGDPVNIKGKKP

SEQ ID NO: 6610 - protein, 894 aa, Chromobacterium substugae
MPANTAAAIARSCEFSHYLTRLLAARPEEGERLERQLSQPFTVEDMQDFADWPALQAPEQLAPALRRLRQAVMARLICRDLNDLAPLDEVVATISQLAEFAVRQALRCACASLPQYGKPIGEDSGEEQQLIVIGMGKLGGGELNVSSDIDLIFIYPESGETDGARKISNHEYFTQVGKRLIALIHDLSADGQVFRVDMRLRPYGDSGPLVMSFAALENYLLSQGREWERYAWIKAKAITGDAEGLNQMVRPFVYRKYLDYNAYGAMRELHAQIRREVARRDMADNIKLGPGGIREAEFIAQVFQLIRGGRDKTLQLRGTRATLSRLADLRLLEPSAVEELQDAYAFLRKLEHRLQYLDDQQTQTLPAAPETRQKIAASMGYADWDAFQPALAEVRRKVSRHFEQVFILPSEDSPDHPLSELWLDVADQDPSLRLAELGYADPAAVARQLKGLAQSQRYLQMPLSGRKKLDALMPALIEVASRFPNADDTLSRIIGLMEAISRRASYLALLTEYPQTLQRLASLYSSSAWVSAYLSRHPILLDELLDVRVLYAAPDWPLLASQLEAQLTQADGDVEAKMDALRHFQHAQTFRLVAQDLAGMWTVEALSDQLSLLADHVLDAAVRHAWLDISSRHQQTPSFAVIGYGKLGGKELGYASDLDIIFLYDDPHPDAAELYSRLARKLSTWLTSATAAGVLYDIDLRLRPNGASGLLVSSISAFRQYQENQAWAWEHQALTRARFVAGDEAIGEQFEAERHEILTLAREPAKLRQEVLDMRQRMLDSHPARPDDVKNARGGIIDIEFIVQYLILAHASRLPAFTGNTGNIALLAVAADAGLIDRDLADGARAAYRLYRRLQHAARLNERQKVEVDNTLLAAYRKGCLLWQQVFEQALDFS

SEQ ID NO: 6611 - protein, 307 aa, Chromobacterium substugae
MSMADRDGYIWFDGKLVDWRDATTHVLTHTLHYGMGVFEGVRAYETPKGPAIFRLQDHTERLFRSAKILGMALPFSPEQINQAHLDVVKANGLKSCYFRPMAFYGSGKLGVAPLKNDVQVIVAAWPWGAYLGEEGLEKGIRVKTSSFTRHHVNITMCKAKANGNYMNSILANNEATADGYDEALLLDVDGFVAEGSGENIFIVRKGKLYTPDLTSALEGITRDTVVQISQEMGLQLVEKRITRDEVYSADEAFFTGTAAEVTPIRELDRRPIGNGARGAITAEIQKRYFNIVKGHDAEHEHWLTYVK

SEQ ID NO: 6612 - protein, 66 aa, Chromobacterium substugae
MAELKENTARYIEVTQHDLPLHCPMPDMKAWNSHPRVYLPVHKTGEALCPYCGTQYKLVGPVGHHH

SEQ ID NO: 6613 - protein, 345 aa, Chromobacterium substugae
MKKKILVIGPSWVGDSVMAQPLYRRLHQRHPELELHVFAPAWTLPLLARMPEVAQSHLNPFGHGALRLMERWKVARQLAKEGFDQVIVLPNSLKSALIPLFAGIPLRTGFLGESRYGLLNDARELDEQELPMMVERFCALAEDKKRPLARPIPNPLLSADAASQQQAAQRLGLDTGRPVVAFCPGAEYGPAKRWPARHFAELARRFDAAGYAVWLFGSGKDKDIGDEIAGLSQGSAVNLCGATGLEEAIDLIGLCQLAVCNDSGLMHVAAALDKPLVALYGSSSPDFTPPLSDKAAIVSLNLDCSPCFERSCPYGHTDCLKNMQPDMVWQAAQTLLAPPSNQTRD

SEQ ID NO: 6614 - protein, 205 aa, Chromobacterium substugae
MSAAETPKQPEENTRRMELVRAAAVLFRDQGYERTTVRDLGNAVGLQSGSLFYHFRTKEEILVAVMALGISSTTEQLAAAISQADSPRQRLAALFQVHLNSLLGDNQAALEVMLYEWRSVSPAAKPALVVLRDRYEALWQQVLDEAAQAGLVKQDTRLLRRTLLGSLHWTVQWYRRDGELSVDALAQHMLQLVLLEADAKTSTER

SEQ ID NO: 6615 - protein, 223 aa, Chromobacterium substugae
MANIASVGNPATQPLYAGQTPRQVQSSLDNAQPAVQQASSPPQTQVAVRQNPDTARVEQQLQQQLSNSRSQQALQNAQAQNAAANAAPAAPQANPAQINNSAAVLATNPQPAAAAAVAPAVNGNTAPAAAPPQQAGNNNAAAQATPTQTAQAPSQAAPAQQAATPPQPATPAQSATAPSTLATQAVNRAQQLTSSGRQELSQYQATQSLLEPSVSSTSISTTA

SEQ ID NO: 6616 - protein, 648 aa, Chromobacterium substugae
MTDLHEALPPEILLDDYLAAHNATIVTTEGSHAVSVHGELALNGHAIPYHLVPDEGFLGKSAKWRKLDAEARLALVRERWNDAARQKLEEQLLACAREVFAVDGIEPLRALSAFMAKYERAKVRCTLALDRVAAARSRQSADKAAAKTRDAVNLSRYPESFATAYAMQRHFIAVLGPTNSGKTHAAMEHLQKAKSGVYLAPLRLLALENYTRLQQAGVAVSLITGEQRKLHPEATHVASTVEMLNPERQVEVAVIDEIQLLDDPDRGAAWTAAVCGVPAQTIYLVGAPESREAIESLVARVGGTLEVRTLERKTALQMDKAPLLSLKNLRPGDVLIAFSRREVLNWRDKVIEQGLSVSAIYGNLSPEVRQSQAERFVSGETQVVVATDAIGMGLNTPARRIIFTTASKWDGYAEGVVAAPLAKQIAGRAGRFGKHETGYVAGFDGQTHKTIAALLRQKPEPLPESGFFVAPGLKYLEAISEATGEGKLKALLGLFARHINVHDEFFLPANLSEQMAKAEWLDALPLSLADRFTFSLCPVSTKIAMLETALHDWAQHRARGKAAPLLRMLGGGGRHELQYLEDSCKLYAAYAWLSYRMPDTFPDGEMAQLLMQSTSERIDALLQVQNSQKRKGRGGGEPMRRKPGGKRR

SEQ ID NO: 6617 - protein, 394 aa, Chromobacterium substugae
MQQQEIVIVGMARTAMGGFQGALSGLTAGQLGAAAIRAAVERAGVAAGEVDEVIMGCVLPAGQGQAPARQAALGGGLPQATPCTTINKMCGSGMKAVMMAHDQLLAGNGQVVVAGGMESMSNAPYLMPKARGGLRLGHGEIKDHMFLDGLEDAYQKGTLMGVFAEQCAEKYGFSRQDQDEFAIASLTRAQQAIKGGQFKDEIAAVTVPGRGGDTVVDTDEQPLKANLDKIPTLKPAFKKDGTVTPANSSSISDGGAALVLMTAAEAAKRSLQPIARIVGHSSYAHEPGWFTTAPVHAIEKLLAKTGWKAGEVDLYEINEAFAVVTMAAMHDLKLPHDKVNVHGGACALGHPIGASGARIVISLLSALKQRGGKRGVASLCIGGGEATALAVELI

SEQ ID NO: 6618 - protein, 132 aa, Chromobacterium substugae
MAEQVFNITELAQEFDITTRAIRFYEDQGLLVPERAGQRRIYNRRDRVRLMLILRGKRIGLSLQEIRELFALYDAARDDAPQLQEFIRILARKEQQLLAQMEDIKVVLTEIGQLRGQCEKSLGKRANGHNQA

SEQ ID NO: 6619 - protein, 282 aa, Chromobacterium substugae
MSKKIGVVGAGTMGNGIAQVFAMKGFEVLLADVSDAALVKGMANINISLQRMAKKELIAEANIPGIVAHIRATTQLADLAGCDVVIEAATENAAIKEQIFRDLDAAVGEKCVLASNTSSISLTRIASWVSHPERVVGMHFMNPVPLMQLVEIIRALQTGDEAYNTVFHLSQALDKTPVTVKDGAGFVSNRVLMPMINEAAFALYENLATAEDIDTVMKLGMNHPIGPLALADLIGLDTCLSIMDILHREFRDSKYRACPLLAQLVQAGHLGRKSGKGFYSYN

SEQ ID NO: 6620 - protein, 500 aa, Chromobacterium substugae
MSQSVPSVKLLIGGEFVESRTTEWRDIVNPATQEVLARVPLATADEVNAAVAAAKEAFKTWKKTPIGARARVFLKYQQLIREHMKELAAILTAEQGKTLADAEGDIFRGLEVVEHAANIGTLQMGEYAENVAGGVDTYSVLQPLGVCAGITPFNFPAMIPLWMFPMAIATGNTFVLKPSEQDPMVTMRLAELALEAGIPKGVLNVVHGAASVVDAICDHPDIKAVSFVGSTKVGTHVYQRATLSGKRAQCMMGAKNHAIVLPDANKEQALNQLVGAAFGAAGQRCMALTVAVLVGEAQSWIPELAAKARGLKVGAGKDNLDLGPLISRAARDRVEGLIAKGVEQGAKLELDGRGVQVAGFERGNFVGPTIFSGVKPGMAIYDQEVFGPVLCLAAADTLDEAIAIINANPNGNGTAIFTQSGAAARKFQEDIDVGQVGINVPIPVPVPLFSFTGSRASKLGDLGPYGKQVVAFYTQTKTVTSRWFDDEASMGKVHTTISLR

SEQ ID NO: 6621 - protein, 386 aa, Chromobacterium substugae
MNFELNEDQIAFQQSARDFAERELAPHAAEWDAESHFPLDVIRQSGDMGFLGLYTPETYGGLGLPRLDSAIIFEELAAGCTSTAAYLTIHNMVSWMIASFGGKQLAEQWVPKMVTGEVLGSYCLTEPGAGSDAASLKTRAEKKGEVYVLNGGKMFISGAGSTQVLVVMARTGGPGPKGISAFVVPADAPGISYGKKEKKMGWNSQPTRAITFDNVEIPVENRLGEEGQGFAFAMKGLDGGRINIATCAVGTAQAALNAAQRYVQERQQFGQPLAELQTVQFRLADMLTELVAARQMVRLAAWKLDSGSADATAYCAMAKRLATDLSFNIANNALQLFGGYGYLQDFPLERHVRDLRVHQILEGTNEVMRMIVGRKLLQDGALETLR

SEQ ID NO: 6622 - protein, 260 aa, Chromobacterium substugae
MQNYAHLNVEKRGHTAVVTIDNPPANTWNRASLTALKQLIADLNADRDIYALVITGQGEKFFSAGADLNMFADGDKKIATEMTMLFGEAFEALSAFRGVSIAAVNGYAMGGGLECALACDIRIAEEQAQMALPEAGVGLLPCAGGTQNLAWLVGEGWAKRMILCGERVNAATAERIGLVEQVVAKGEALETALKLAEGVAKQSPSSVGVCKQLVQAARLQPPAWNLIKEREAFIKLFDTHDQGEGTRAFLEKRAPNWKNA

SEQ ID NO: 6623 - protein, 372 aa, Chromobacterium substugae
MQDVVLFDELTTGDGHRIAIATLNAEKSLNALTLDMIRLLDARLTIWERDAGIVAVVLRGAGERAFCAGGDVRSLRDKLISEPHYPNPHAVAFFTEEYTLDYRIHRYRKPLIVWGGGIVMGGGLGLMAGAGHRVVTPATRIAMPEITIGLYPDVGGSWFLQRMPAHLGLFLALTGAPLNAHDALIANLADHVLAADAYPALLEALQAANWGDDAHARPALVSALLNQLEGQLGDALPASNVERNLLAVHRLMNKGDLAAVSAALSETAFEDPWLADAAKNFRHGCPTSAAVSWEILNRSKHMSLAEALRMELALSVNFCARSDFPEGVRALLVDKDRNPHWSRQLADIDQAWVDGHFDSPWREADHPLAGLK

SEQ ID NO: 6624 - protein, 297 aa, Chromobacterium substugae
MENIAFIGLGNMGGPMAVNLLNKGFKVSAFDLSADALARVAAAGGRAASSAADAAEGASVVISMLPAGKHVAGLYQSDDGLFAKLPKGALVIDCSTIDAGTARKVAEEAAARGLSMLDAPVSGGTAGAAAGTLTFIVGGAADDLERARPMLEAMGKNIFHAGGPGAGQTAKICNNMLLGILMAGTAEALALGVKNGLDPKVLSEIISKSSGRNWATELYNPWPGVMENAPASRNYTGGFMSELMLKDLGLAEETALQSHSANPLGALARNLYEEHVHLGNGKLDFSSIVKHFHRLDG

SEQ ID NO: 6625 - protein, 839 aa, Chromobacterium substugae
MNMPQLHALKSIAAATLLACALPAAAGYQQPPANILKAMRAPSLPGPSLSPAKDKMLLVAWQEYPSIERVAAPYLKLAGTRVETANRSKHDTPGGYGIAPCAESFKLVTIPGGKETAIALPAGACPDAPIWSADGKRFAFANATRDAVEVWVGDAASGKIRKIPGIRLNPMLNDELQWMPDQKTLLVKAVPAKLGAAPAKQAAPDGPNVQEADGETGQSSTYETRDTLSSPHDEALFDYYGASQLTLVDAASGKTALLGKPAIYDAVDPAPDGKHVLISRIAKPYSYVTTYERFPHEVEVWDITSPARIATHHIASQPLADRVPVHGEPLGPRDFFWRATDPATLLWAEALDGGDWQNTAPARDKVMQLKAPFTAKPAEVLRTTQRFAGIGWTERADTALVSEVDLNKHWRQTRVVNLDDPKQPAKLLWDMAYDNRYADPGSPVHRTLANGERVIQLDGDAIYLAGAGASPQGNRPFLDKLNLKTGVSQRLFRSDKSAFERFIALSGKDAGSFLTWRQTPTEAPNAFLRKLGAPVSADKGEAAFASSETAVTHIVDPTPELRQIKKRLVKYKRADGLDLSFTLYTPPGYKEGTRLPAILNAYPLDYADAASAGQVSGSQQTFTRLYQYKYLLLAGYAIIDQASFPVVGDPKAAYDTYLDQLKMDAEAAVGEAVKLGVVDPDRVAVTGHSHGALMTANLLAHTDLFRAGAATSGSYNKTLTPFGFQSERRSVWEAPEVYRKVSTFFYADKLKTPILIVHGSDDANPGTTPLQASKFYEAIRGNGGTARLVMLPHEPHWYAARESNEQLVYEMLSWFDKYVKNAPPRAAKTAQSQPAPAQP

SEQ ID NO: 6626 - protein, 275 aa, Chromobacterium substugae
MDAYLLSRGGGGLGGWRLSVREFWFFGLKEMRACLFAGLFFAAIFLTPRGGWLGVPRYDLLLLIALAIQGWMLWTGLESLDELKAITLFHLLGFALEAFKTSSGIQSWSYPDLAYSKLFGVPLFSGFMYAAVGSYIIQAWRLLKLRVEHHPPYWMAAMVAALIYANFFSHHYIGDYRWYIAACALGLYARATVIFQPLDRERRMPLLLAFVLIGFFIWLAENIGTFYGVWRYPHQLGAWSIVHVGKWSAWSLLVIMSFTIIAHLQHVRRRINVPA

SEQ ID NO: 6627 - protein, 341 aa, Chromobacterium substugae
MLNFDFPRLAAIGLTPALLQQALAMAGDDDWQLVRVCRVQRDCAWVHDGEEERQAHALPGVHAELAVGDWTLCQPREHEPWRLLERLEPFNQLVRVNDEGARQAYASNVDTALLVMGLDGDYNPRRLERYLGLAAAAGVAPVVVLSKADLCPDAEARLAELEQRLRPLPPILLLNGTDPACRDALRPWLGMGQTLVLLGSSGAGKSTLSNTLLGEETQAVGGVRADDSRGRHTTTARTLLKCPDGACIIDTPGVRTLQAPPDAGALAGSFADIEELAGRCQFRDCTHREEPGCAVREGVAGDRLRNYHKLRRELERHEQTALQRQQQRREWKVRNKAARRG

SEQ ID NO: 6628 - protein, 280 aa, Chromobacterium substugae
MARLALVLWMAWLGGPAAACTLWGAAGAASADGTLLAKNRDWRPDHVQSLRLHHPAHGHAYLGLYADTGSEPGIKAGVNEKGLAVVGAEASSLPRALRQDSSRHGVLTRLLRDYGSLDEVAAAADQLFSQVRPVFLLLADAGGLMQVEIGQHGRYRVTRQQNGTLAHTNHYFDTSLLDGEQKIGPSSQARLARVRLLLDQNPAHTLAEFEQLSRDRHDGPDNSLWRAGREHTLAGWQLALPAAGAPRLHLVLANPGEPERERDYALDAAFWSQPARTLLP

SEQ ID NO: 6629 - protein, 114 aa, Chromobacterium substugae
MNEFLPAGRINRTGFLWRHAIVLPPALWLARQADSLACSAGTLASALLLLFLISAWTRRLHDLDRSGWRLLLAALPLFGPIILIATCLRPGRAIANRYGSAPGLREDYTTVQAS

SEQ ID NO: 6630 - protein, 752 aa, Chromobacterium substugae
MSHHHIVNDVTRLNPVRVMAIIAPESVADVQQALRRTNGPVSIGGGRYSMGGQSASPGSLHFDMRSLNRILSFSPHEQTIRVQAGVRWCDIQRFIDPHDLAVKTMQTYANFTVGGSVSVNCHGRYVGLGPLVLSVLSLLIVLRDGETVRASRDENAELFFGAIGSYGALGVIVEIELSLTANKRVKRQHKVMPLADYWTYFKNAVRDNPQAVFHNADLYAPRYGTVRATSWMETDEPATTPDRLSPLKKSYPLHQYVLWAISETPFGKERREKLLDPLLYWRKKVHWRNFEAGYDVAELEPPSRQHRTYVLQEYFVPVAQLEAFVARMGEILRRHRVNALNISIRHAMPDPDTLLGWAPVETFAFVLYYKQRTRENARSRVAVWTRELIDAVTAVGGKYYLPYQPHATHAQFHRAYPRAEQLFELKKRLDPDFRFTNALWDKYYQAWLARGQAAPLPAPASEFHQVFDDVGLSDAFYRFLQTVFRIAPEDRLHQLIREACRHCGDEESVYRYLQQRFAGIRPALADLRYAVPSLLRQKREMTRQTLALLNGRRRFDGYAEIGSKGRYYRGLAAALDIRGPRFFIDEHAQTFSPADILERGQFKRLPRHLPLNDYAPICPNAIPDASLDLLVCYVGLHHMTPDTLTAFLASAARALRPDGLFIVRDHDVCDDSMRALVSLAHTVFNASLGESWETNQRELRYFAPVAHWSRCLRTAGFEDSGQRLLQANDPTANTLLCFVRLPAADAAARSAS

SEQ ID NO: 6631 - protein, 203 aa, Chromobacterium substugae
MRPPRRWLARAALTLVLALPTAGSAAAPAEYRRPPEQTYLTFPEWYLVHSPAEYAGYLQSGAPPSGFPLFAHIGQFWQGYAAMTRETERYPFNGGYHLMVMVIGASTTIEYGIKGLYEQTVGRLAEASRGTGPMLPEERFAARYARDYVDFIRVDPWYQFDFFSRLRQLWQGSLPLDGNHPLRRWERRYLLSSELLAKGITAS

SEQ ID NO: 6632 - protein, 141 aa, Chromobacterium substugae
MIKLATRTVYDEAKPQTAVVLRHAPPASADRRNYIPQAAQDGLTPALLPRYQAFQDYSLWLARNGADFQEIAGNRGEILISLLAPDAWRAPGDGRLLLEQPILTQPGRKRALVAVPVGQLAGLLRLSAAQAGVDLEHVYDY

SEQ ID NO: 6633 - protein, 169 aa, Chromobacterium substugae
MAGSDPSIHRSFKEKKYMSPILYRAARPDDVPACVVIRGQTRENAISEARLNELGITRASWAQSVRVGELPSVVAEAGGRIIGYCFGDAASGEVVVLALLPDYEGMGAGRTLLSQVMASLREAGHQRLFLGCSSDPAVRSHGFYRRLGWTATGRVDKYGDEMLEYAFPS

SEQ ID NO: 6634 - protein, 255 aa, Chromobacterium substugae
MQVGALIIGDELLSGKRQDKHMQALIRILAARGIKLAWAEYLGDDPARIEAALRRAFASGDLVFSFGGIGATPDDHTRVCAARALGLPLEPHPEAKALIEARFGADAYPHRIQMGHFPQGAAIIPNPVNQIAGFSHGSVHFVPGFPSMAWPMAEWVLDTHCRHLFNDQPDIEKSCIAIQAREGDLIGLMQEFSARYPALKLSSLPSFGNEAIPEMHIEFGFAGQPALVEIAIGEWVKAIQARGYEVRAKDPGAES

SEQ ID NO: 6635 - protein, 159 aa, Chromobacterium substugae
MLPASLDELDAIRDECRALVNGRAALSAGASALPAPGMDVAADVAILLRLIPAINQRFGVAPAQIAGYDAARKQLLYQLIRRAGSALLGLEVSRALLTAMVRRISGRWAGKQALKLVPVLGWAANAAIGFAAMKYIGNSHIDDCYAVCRRMLEEGGVKP

SEQ ID NO: 6636 - protein, 362 aa, Chromobacterium substugae
MTQTTLNLPRGPVMVDVAGFALTEQERARLSHPLVGGLILFRRNFQNIEQLRALTTEIRALRSPHLLIAVDHEGGRVQRFLDGFTRLPPMNVLGEAWDEDREQALKQAETVGYVLAAELSACGIDLSFTPVLDLNWERCAVIGNRSFHRDPQAVAALAEALQQGLGRGGMMSCGKHYPGHGYVEGDSHHLMPRDERSLAEIERDDLVPFARLADAGMGAVMPAHVLYPAVDGQPAGFSKVWLSDILRDKIGFDGVIFSDALDMAGAAGAGTYVQRADAALAAGCDMVLVCNQPEEADTMLAALVPPPQPKLAERLERMAAKSGAEDWRRVIATTDFAAAQAVVKQLAMPKDALAGPQVGEAH

SEQ ID NO: 6637 - protein, 125 aa, Chromobacterium substugae
MIYGIGTDLVEIARMEAWCQRWGAKAGRRLLTAAEQVEFAAHAEPARFLSKRFAAKEAFAKALGTGVVAPALLTAIGVGHDALGKPLLILSDELAAFAASRGVARMHLSISDERGHALAFVVLES

SEQ ID NO: 6638 - protein, 187 aa, Chromobacterium substugae
MPTVFTHALAGATLAGLASRKPVSTPGMLPWLALCGAAAMLPDLDVVTFKLGIPYESPWGHRGFSHSLAAAALIAGVLTWLCRPLWRRMGLSAAAAATLLFLAAASHAALDMICDASFGPALFMPWSGHRYLSDWRLIEGSPLGLKRWFSAKGWRVVYTEFAYVWLPCLALWTARWLWLRRGSEARA

SEQ ID NO: 6639 - protein, 240 aa, Chromobacterium substugae
MILLGVNIDHVATLRQARGTRYPSPVEAALVAESSGADLITLHLREDRRHIQDADVKAMRPVLKTRMNLEMAMTAEMLAHALEVAPEDVCLVPEKREEVTTEGGLDVRGHFDDVKHYTGKLAEAGIRVSIFIDPDRAQIQKAHDAGARVIELHTGAYADAPHAKEREAELARIREAAAFGASLGMVVNAGHGLNYHNVKPIAAIPQIAELNIGHAIVAHALFVGFPQAVREMKALMDSAR

SEQ ID NO: 6640 - protein, 245 aa, Chromobacterium substugae
MSQPGRVDKQPAYILHTQPYRETSLLLEVLTRDHGRFSLVARGARRPRSDLRGVLLPFQPLTLSWFGKGELRTLHGADWDGGVRPLSGLPLVCGFYLNELMMKLTARDDPEPRAFSVYDAAVRDLAARPSLSPVLRRYELRLSQVLGYAPSLKRDSRGDEIDAERHYLCRNAAMPELDEQPHLELAGKAARLSGAALLAIDADDYSEHATRRQARQLSRVWLDALLGDEPLAARELLQAIQSLSD

SEQ ID NO: 6641 - protein, 91 aa, Chromobacterium substugae
MTTRPPQACWAVSLAAEAARSDPARCVLRLAAAQPGYLGGEGRVTYWDSVEAIAAWRARAEQLARQGRGADDAAPELSFLVSRIDPRESSA

SEQ ID NO: 6642 - protein, 296 aa, Chromobacterium substugae
MTDTPFHCGFVAIVGRPNVGKSTLMNHLIGQKISITSKKSQTTRHRVTGIHTEDAAQFVFVDTPGFQTYHKGALNEALNKSVKDSLGSVDCVLFLLEAMRFTAADKEVMALLPKKTPVILVVNKLDKAKDKLTLQAFINEVTAEFEFAGVEVVSAKHGQRLAELLDQVRPHLPESMPLYPEDMVTDKNERFLAAEIVREKLFRYLGEELPYEMNVEVEMFEMDGALRRIHIAVLVDKEHQKPIVIGKAGEKLKKISTEARLDMEKLFDGKVFLQVWVKVKSGWADDVRFLREFGLN

SEQ ID NO: 6643 - protein, 236 aa, Chromobacterium substugae
MTQIDNRFRRLSQALDYAFQKPELLRQALTHRSYSSANNERFEFVGDSILNYTVARMLFDQFPQLTEGELSRLRANLVNQNTLAEIAHELKLGDYLYLGEGELKSGGFNRPSILADALEATFAAVSFDADFGAAEQVVRRLYDQRVSTIDTTRQAKDAKTRLQEALQARKLQLPKYRILSQSGEAHEQWFKVECDLGELALISTGDGGSRRAAEQQAAEAALTLLEQKFAASKKKS

SEQ ID NO: 6644 - protein, 119 aa, Chromobacterium substugae
MRQQKGLSVIAVLLVLALVGFALLLVFKVVPVYSEYGDVKSSLSALSTETNVGEHTLRQEFDAKASVAGIVSIKGDNLIVVAGGNGNYLRAQYHREVPLFGNVSLLFNFDTQAGQPPAQ

SEQ ID NO: 6645 - protein, 316 aa, Chromobacterium substugae
MAAAVVGAILVALGGKKQDGDKDWPQSVQWGYLALVIGGFGLLSSYMSFTAVMLVFVLITGVVWALDKWLLAKKRAASGAQPGHFVDYSRGFFPVILVVFVLRSFLVEPFQIPSSSMRPGLVVGDFILVNKFTYGIRVPVLNNVLIPVNKVEHGDVVVFNYPPEPKINYIKRVIGLPGDTVEYRNKRLTINGKPLQDVPDGSYDYLEKDLGLQTITANQYRESQAGKTYHVLNNVGTPVVALSQVRDFDYRDNCRYDEDGFVCKVPQGHYFMMGDNRDNSSDGRYWGFVDDKLMVGKAFMIWMNFGNLSRIGTQVK

SEQ ID NO: 6646 - protein, 597 aa, Chromobacterium substugae
MKNIRNFSIIAHIDHGKSTLADRFIQFCGGLELREMSAQVLDSMDIEKERGITIKAQTAALTYKARDGQIYNLNLIDTPGHVDFSYEVSRSLSACEGALLVVDASQGVEAQTVANCYTAIELGVEVVPVLNKIDLPAADPERISQEIEDIIGIEAVDAVRASAKSGIGIEDILEEVVSKIPPPQGNPDGPLKALIVDSWFDNYVGVVMLVRVIDGSLKPKDKIKFMATGAEHLCEQVGVFTPKSVQKPSLSAGEVGFVIAGIKELKSAKVGDTITLVNNQAAEALPGFKDVQSQVFAGLYPVESHDYEALRDALEKLQLNDASLKYEPEVSQALGFGFRCGFLGLLHLEIVQERLEREFDMDLITTAPTVNYEVVMKDGTVEVVSNPSRMPDSGKYEDLREPIITSTILVPQDYVGAVMTLCNQKRGSQRNMQYMGRQVMLTYDLPMNEVVMDFFDKLKSTSRGYASLDYEFKEFQSADLVKLDVLVNGEKVDALSLIVHRASSVYRGRELVSKMRELIPRQMFDIAVQAAIGGHIIARETVKALRKNVLAKCYGGDITRKKKLLEKQKAGKKRMKQVGNVEIPQEAFLAILQVGDK

SEQ ID NO: 6647 - protein, 79 aa, Chromobacterium substugae
MKLTLYFREYCSLCHQMLAELAPWRQRYGFELEVLDVDADPALEARFNELVPVLMDGEAEICHWHLDAARLAAHLGEIG

SEQ ID NO: 6648 - protein, 311 aa, Chromobacterium substugae
MFGAACAAHAEDDMQLLRNVGNAGRQQALDGTYLHQMNGMLETFRIVRQGQGDGVREKRVSLDGPSREVVRNGGELTCFAPDKRALMACKISAMRLFPALLPDDLEDITRSYVLKRTGSDRVAKRDCQWLDLQPRDPQRYSMRMCIEPSTYLPLKVITLSPRGDSVEQFTFTEVELAGAKDKKAYKPRLAQKFLLRPAKAPVGADPSVSQNEVSGLPQGFRLLRSVQRVLPGQGGKPVRHLVLSDGLVMLSVFVEPPPPENARLERVGNLHGAINMATSYQGDMQLTAVGDMPQTAMMALLKGLHINGKND

SEQ ID NO: 6649 - protein, 158 aa, Chromobacterium substugae
MKETISALMDGELDGTEADKALSAIAADKDLDAAWDQYHLIGDAMRSNRMAGLNVRAKVAERMVDEPTVLAPRRWMRPRRARAASAVALAASVSFAAVVGWQQLAHRSAPASAIADRGVPVQIAQPAMEQDDPYVLAHQEVTADQSVMRVSYGNGARH

SEQ ID NO: 6650 - protein, 199 aa, Chromobacterium substugae
MSDRDIDQQLVERAQRGEKRAFDLLVAKYQRRLARLLSRFIRDGSDIEDVTQEAFIKAYRALPSFRGESAFYTWLYRIGINTAKNFLSASGRRPVVNSEIEDEDGESFDMASQIPDMNTPETELMNKEILATVNAAVEALPEELRTAISLREMEGLSYDEIARVMDCPIGTVRSRIFRAREAIAAELRPLLDTAKNRRW

SEQ ID NO: 6651 - protein, 292 aa, Chromobacterium substugae
MNTPGQRFRQAVAAEKPLQVVGAINAYSARLAEHSGFKALYLSGGGVAAASCGIPDLGITTLEDVLIDVRRITDASDLPLLVDIDTGWGGAFNIARAVRSLEKAGAAAVHIEDQVQQKRCGHRPNKAIVSQDEMVDRIKAATDARRDDSFVIMARTDALAVEGLDAAIERAVACVEAGADMIFPEAMTDLAMYQQFAEAVKVPVLANITEFGSTPLYTTAELGANGVGLVLYPLSAFRAMSQAALAVYGAIRRDGTQRAVLDTMQTRMDLYDHLGYHDYEQKLDALFAAGKQ

SEQ ID NO: 6652 - protein, 382 aa, Chromobacterium substugae
MTEVVLSGKPKKSVALSGVAAGNTALCTVGRSGNDLHYRGYDILDLADKAEFEEVAYLLVHGKLPNQAELAGYKKKLKSLRGLPASVKAVLEALPASAHPMDVMRSGASALGCALPEKDDHNLAGARDIADRLMASFGSILLYWHHYSHNGKRIDVETDDDSIGGHFLHLLHGVKPPQEWVRAMHTSLNLYAEHEFNASTFAARVIAGTGSDMHSAITGAIGALRGPKHGGANEVAFEIQQRYESPDEAEADIRARVERKEVVIGFGHPVYTVSDPRNVVIKEVARELSRQNQDMKMFDIAERLESVMWDVKKMFPNLDWFSAVSYYAMGVPTAMFTPLFVIARTSGWSAHVIEQRQDGKIIRPSANYIGPEDQAYIPLEQR

SEQ ID NO: 6653 - protein, 188 aa, Chromobacterium substugae
MKQSLFWQRLDCPGLEQVQLETGSGLSLSASGSLLHADSGASLRYRMQLDHHGRLSHAHIDVSAPEPRQLTLQHTESGRWLLNGQAQPAWDGCQELDLQACGLTNAFPIRRLKLGVGDSVELSMLFVRLPSLEPTRCPQRYTRLPDRDGLACYRYQSPGFAADIIVDEQGFTIHYSDFLQRLPDSGRD

SEQ ID NO: 6654 - protein, 867 aa, Chromobacterium substugae
MNRQYRTALPGTGLDYFDARAAVEAIQPGAWDKLPYTGRIHAENLVRRCEPAALTECLEQIVYRKRERDFPWFPARVVCHDILGQTALVDLAGLRDAIADQGGDPAQVNPVVPVQLIVDHSLAVECGGFDPRAFEKNRAIEDRRNEDRFHFIDWTKSAFDNVDVIPAGNGIMHQINLEKMSPVIHSDKGVAYPDTCVGTDSHTPHVDALGVIAVGVGGLEAENVMLGRASWMRLPDIVGVELAGKPAAGITATDMVLALTEFLRQQKVVGAYLEFYGEGAAALTLGDRATISNMAPEYGATAALFFIDQQTIDYLKLTGRSDEQVKLVETYAKTAGLWADSLKTAEYERLLTFDLSSVVRNLAGPSNPHKRLPVSALAERGIAVNLAQAREQEAQGLLPDGAVIIAAITSCTNTSNPRNVIAAGLLARNANKLGLVRKPWVKSSLAPGSKAVELYLKEAGLLSELEQLGFGIVAFACTTCNGMSGALDPKIQQEILDRDLYATAVLSGNRNFDGRIHPYAKQAFLASPPLVIAYAIAGTMRFDIEKDVLGIADGKEIRLRDIWPSDAEIDAVLKQSVKPEQFRQVYEPMFAIHRDSAAKASPLYAWRPQSTYIRRPPYWEGALAGERTLKGMRPLALLPDNITTDHLSPSNAILASSAAGEYLAKMGLPEEDFNSYATHRGDHLTAQRATFANPQLVNEMAVVDGEVQKGSLARVEPEGKVMRMWEAIETYMDRKQPLIIVAGADYGQGSSRDWAAKGVRLAGVEAIAAEGFERIHRTNLIGMGVLPLEFKPGVNRKTLQLDGTETYDVIGQRQPRADLALVIHRRSGETVQVAVTCRLDTAEEVSIYEAGGVLQRFAQDFLAAAQA

SEQ ID NO: 6655 - protein, 396 aa, Chromobacterium substugae
MTHPAQIRIPATYMRGGTSKGVFFRLQDLPEAARQPGAARDKLLLRVIGSPDPYGKQIDGMGGATSSTSKTVIVSQSTRPNHDVDYLFGQVAIDKAFVDWTGNCGNLSAAVGPFAIANRLIDPARVPEHGICTVRIWQANIGKTIIAHVPVSDGQVQETGDFELDGVTFPAAEVQLEFLDPADEGDGDGGAMFPTGKLVDTLEVPGVGAFPATLINAGIPTIFVNAADIGYTGTELQDAINSDPAALARFETIRAHGALRMGLIKSLDEIAGRQHTPKIAFVAPPADYTASSGKPVKTSDIDVLARAMSMGKLHHAMMGTAAVAIGTAAAIPGTLVNLAAGGGKRQAVRFGHPSGTLRVGAQAREERGEWVVTKAIMSRSARVLMEGWVRVPGDAF

SEQ ID NO: 6656 - protein, 146 aa, Chromobacterium substugae
MTASRRDKDMNSICMAIRAGPTESQPEPAAMSTPAPILTASTDWHWSPTPYPGVDFTWLRRNPDGGGSALLKLAKGAKLPLHRHPGAEQVFVTAGRLKIGAHVLGKGDHLFIDAHVPHSVEALQSAVYLTVSENDGVELLPPDQAG

SEQ ID NO: 6657 - protein, 358 aa, Chromobacterium substugae
MNSMKATVFVAPGRIELREKPIPAVGPGDALVRVTTTTICGTDVHILKGEYPVASGLTIGHEPVGVIEKLGADVKGYREGQRVIAGAICPSFTSYGCQDGHPAQDGGCECHGYKPMGGWRFGNTIDGTQAEYVLVPDAQANLAPIPDGLSDEQVLMCPDIMSTGFAGAEAANIKIGDVVAVFAQGPIGLCAVAGARLRGASCIIAVDGIDDRLAISRRLGADITLNFRQVDVISEILKLTGGRGVDSAIEALGTQGTFESALRILKPGGTLSSLGVYSTDLRIPLDAFHAGLGDKRIVSSLCPGGKERMRRLMNVLGSDRLDLSPLVTHRYKLDQIVEAYDLFSHQRDGVLKVAIKPF

SEQ ID NO: 6658 - protein, 285 aa, Chromobacterium substugae
MNKPMRYALAAIAMWASVATLSSLTHALPPFFVAGVGLILGSLLTARRAAEWKVPLKSFANGVYGIFGFYFFLFNAYRLAPVMDATVLSYIWPLLMVLLSPLLLPGTRLGANHILGSLIGFAGAALIVTGGKLSLSLSALPGYLMALGAAVVWATYSLFTRRLPATSDNAVGGYCLASGLLALALHFATEPAAHPSAIQWLMIAVVGLLPMGAAFLCWNRAMQLGDPRQIGALGNATPLLSTLMLVASGQAALNGSAALAIAMIVGGAALGTLPARRLLPRWLQA

SEQ ID NO: 6659 - protein, 311 aa, Chromobacterium substugae
MTLDHSKQVQDLFVQHLNGSANGIAVLDAEDRFLFYNQSFITMFAFEGISMIGKPYDDLMARAFNLRLIAECGKTTLEAWLEVVHARHRTQEVWNYEMEWTDKRWLLLTKQVYQQGMMVMVCADITRHKQTELALRAAHAELERLAMTDELTGISNRRHFLAQMEREYERAKRYQHPASLVMFDLDHFKRVNDSYGHPAGDLVLKHFADSLAAHARDQDALGRLGGEEFALLLPETSAAGAMSLLERVRTELANASLEFVAPGFSYTFSAGVAELSIPPGFDRRHWIQAADQALYQAKAYGRNRSVIYRDG

SEQ ID NO: 6660 - protein, 463 aa, Chromobacterium substugae
MDLFDAIHLARLQFAFTVSVHIIFPAISIGMASFLAVLEWRWIATGDRAYKDMYLFWSKIFAIGFGMGVVSGVVMAYEFGTNWSGFSRVAGNITGPLLTYEVLTAFFLEAGFLGIMLFGWERVGPRAHFFATLMVAIGTLISTFWILASNSFMQTPQGFAIENGRIVPVDWLKVIFNPSFPYRLAHMTIAAFIVAGFIVAACGAWHLLRGRDDAPIKRSFSMGLWILLLLTPIQILVGDAHGLNTRQYQPAKIAAIEGLWETEKGGTALNLIGLPDMQAETTRYAIQAPHLGSLILTHSWTGEIRGLKEFPPRDRPYSPILFWTFRIMAGLGMLMLLTALLGLLLRRGGRLYHARWFQRLVLCMGPSGLVALLAGWITTEVGRQPWTVYGVLRTEDSVSPITAQQAGVSLLIFVIVYFLVFGVGVYYMLKLMKHGPAAHAAHGEPMAHPGLHNRALDMLEEEE

SEQ ID NO: 6661 - protein, 335 aa, Chromobacterium substugae
MQIDLPVVWAAIIGLGVFIYVVLDGFDLGIGLLFPFFELKNERQVMLNTIAPFWDGNETFLVLGGAGLYGAFPVVYSTLLPANYLPLIMMVIGLIFRGAAFELRAKAKRTQHLWDLAFICGSALAAFCQGIVLGSLLQGIKIADGQFVGGPFDWLSPFSIFCGIGVLITYATLGCAWLILKTDGELQRKMFSLMRPMAGTLLGVIAIISLWTVLGLPAVAYRWFGSGHLGWFLPVPILVLASVWGVYRAIRRQNDSLPFLLTLALCFLGYSGLVISIWPNIIPPSLTIWQASSSHSSQLFALVGTVIILPIIFVYNIMQYRVFRGKVREGDAGYH

SEQ ID NO: 6662 - protein, 48 aa, Chromobacterium substugae
MIIRPMPNWFRMLFVWNGSAPQSMIPQLIFAASPTRKSGAAQPAQVRM

SEQ ID NO: 6663 - protein, 296 aa, Chromobacterium substugae
MIVRSESSWLKLLFVWEGSVIRRIIPQLLFMAGISGVALLTDGHVFGDKIPLNTVPFTLVGVALTIFLAFRNNASYDRYWEARKLWGHFLIAIRSLASMVISIRSAQPAMAAEGEAIIRKLLLLPSLLKSQLRGDALENASCAGKAYKPTVLCHETRRALYALNRQGLVTDMQLLACDGQMGEIFNVIGGCERIKSTPIPFVYSVLLHRTVYIYCLFLPFGLVDIISYATPFITVFLSYTLFALESIASELAEPFSCSPNGLPLDAMTRTIERTVLELNDEALPSDWRVGSHYILT

SEQ ID NO: 6664 - protein, 355 aa, Chromobacterium substugae
MSEQSAQDKSGMAVLDALRRPLLDLRLSVIDKCNFRCPYCMPKDVFGKDYAFLKHAQLLSFDEMRKMAGAFVALGVEKIRITGGEPLLRKDIERLIESLARLSTPAGKSVSVSMTTNGVLLGAKAQSLKDAGLERVTVSLDSLDDGIFRQMNDVGIGVGRVLDGIAAACRVGLAPVKINTVVQNGLNDGQILPIADYFRHSGVTVRFIEFMDVGGAANWSGASVLRSEQVRERIERRHALIAAPVERASDTARYFQYADGGGEVGFISSMSAPFCGDCSRARVSADGQLFTCLFANRSLDLRPYLGEQVSPAALQTVIASAWRARDDRYSEWRGEQYREHGRKKYPTVRMSLVGG

SEQ ID NO: 6665 - protein, 86 aa, Chromobacterium substugae
MDEPNDQVLLAVLAQLWQAALKDRERPWSLARLSKQSGVPMSSLRRWLSYLRASALVEVAMREDGCVGTAWLTEEGLCACRELFAA

SEQ ID NO: 6666 - protein, 328 aa, Chromobacterium substugae
MTPTSTQELLSHAWFGIIGLMLLLYVVTDGFDLGVGILSLFQRKQHERDLMIQSIGHVWDANETWLVALGGALFGAFPAAYAMLMTQLYVPVMALIASFMMRGASIEFRHLARGSKAFWDRVFGLGSLLAALAQGLILGRVISGLAPGIQADAFVAVTAIGVASGYSLLGATWLVKKTTGQLQNRARRGAVASVCATVLAAIVVSLGTLYFSPVGLGRWQDGGTLHVLMGLGLLAALAFVYVLYAVYTGGEHSPFVGACLLFTASFAGLAISLFPWLVPGKLTIAAAASNSASLAFMLLGIGTVLPIMIGYNLYQYHLFRGKVALAPH

SEQ ID NO: 6667 - protein, 468 aa, Chromobacterium substugae
MVIDMSVESLDLARGQFALTAIFHILWPILTISLSGFLVIVETLWVRTSNLVWYHHARFWSKLLLLNFAVGVATGIPMEFQFGTNWGPFSEYTGQFFGNILGFEGAMAFMLEAGFVGIMMFGWDKVSRQMHLFATAMVAFGSSLSAFWIMVANSWLQTPAGVIVVGGKLVVTDYLAAIFNPDMVWGVSHMWFAAMETGLVVVAGISAWYLLKRRHPAFFARSFRLALLLLAIAAPLQIWLGDSSGVDVFETQPAKGAAIEGHWETNTPGSGANWSLIAWPNAERQRNDWSLEVPGMLSLLATHTLHGQIKGLRDIPKADQPPMLPLLYYAFRVMAGIGFLFMALAFWSMYAIRKARGRLDSLLAQRKLLWAWVLAIPLPYIAVECGWIVREVGRQPWTVYGMLRTEHAASAIPAATLSGSTMMFGVFFVVMLASFFVFARRWLQKGPDLALRPAAMPERLDQARGFEH

SEQ ID NO: 6668 - protein, 775 aa, Chromobacterium substugae
MDKSNPPGKIEPYHHPAAGWGALKYVAINLIKERVSGGNYRMLFKQNQPDGFDCPGCAWPDRQHASTFEFCENGVKAVAAEATTKRVTPAFFAENTVESLMQQTDYELEQHGRLTEPMSYDAASDTYVPISWPQAFECIAGHLNRLPSANQAAFYTSGRASNEAAFLYQLFVRMLGTNNFPDCSNMCHEATSRGLPGTVGVGKGTVTLDDFEKADTIIIFGQNPATNHPRMLGELREAARRGAIIVSVNPLRERGLERFASPQHPIEMITMGSTPIASTFIQPRLGGDFALIKGVAKYVLARDDEARAKGEPGILDRDFIQRHTLGFDAFADDLRREDWALLEAESGVARADIENLGRIYAAGERVIATWGMGITQHKHSLQTVQLLSNLLMMRGHIGREGAGICPVRGHSNVQGNRTVGIEEKPSMAFLDRLGEVFGFEPPREHGLDVVETIEHMLHGKVKVFVGLGGNFAMATPDTLRTFEGLRACDLTVHITTKLNRSHLVHGKAALILPTLGRTEIDDRSGVAQGITVEDSMSMVHISYGMNTPASPDLLSETAIIAHIADATLGDAKAPWLEYARDYGKIRDAIERVIPGFEDYNARIQQPGGFHLRVASRERAWETASGKANFIAHPVQRDTPISRARKLHGERLMTLMTTRSHDQYNTTIYALDDRYRGVFGQRRVIFIHPADIAMLGFQDGDWVNISTVWEDGIDRHANYFRLVSYDIPRGCIAGYYPETNPLVPLDSVGDVCNTPTSKSIPVLLHLSAAPPVMPAF

SEQ ID NO: 6669 - protein, 476 aa, Chromobacterium substugae
MKMYETLARELEQHVMSGMLKAGDKVPSVRQLSQQRDISITTVLKAYSLLESRGVIESRPQSGYFVRKATLAGHAAAMPAPMPPTLRPHPVASNVEISQLVLRTLKTISRHDAVPLGSPYPDPTPFPLVRLSHLANNIAKKSSGWGVLNDLPPGNIDLIRQIAGRYFLNGLLVDPAEVIITVGATEALNLCLQAAARPGDTIAVESPTYYAILHAIERMGMRAIEIPTSGTSGMDVDYLESILESDNIAACMVMPNFHNPLGIVMPEANKKKLVEIMTRAKKPIIENAVYNELYYSDTPPSSLKQYDTEGYVLHCSSFSKTLSSAFRIGWAMPGRYREKVENLKFVNTLSTSAIPQMAIAEYLSQGGYDQHLRKIRKFYQQQAKIITHVVRRFFPEACIISEPAGGYLLWVQLPPHIDAMRLYNEALERKITIGPGTIFSNTGKFRNCIRLNYSYSWSKEIESAIVTLGKIISHYK

SEQ ID NO: 6670 - protein, 300 aa, Chromobacterium substugae
MAKHWGKVLTAMVTPFDADGRLNLDAARALARRLADNGSDGLVVAATTGEAPTLSDAERFDLIRAVSEAVTIPVLAGTGSNDTRHALALTARAEELGAAGAFLVSPYYNRPPQAGIEAHFRALAAATRLPVMLYDVPGRTGRRIARDVLLRLLGEVDNIVAFKDATGDPAAAASLVAEAGDRFELYSGDDALTLPLLAIGAVGVVGTSTHWTGPEFAAMIAAFEQGDVRRARAINAALQPSFAFSNTDDSVYSMSVKAMLRGQGLAVGECRLPLPAAPENVGRQAAEVWRRLEAWRAGQR

SEQ ID NO: 6671 - protein, 166 aa, Chromobacterium substugae
MPSFDVVSEVNKVEVRNALDQANKEVGNRYDFKGSDARIEFNDKEVTLFGDTEFQLDQVNEVMVGKLAKRGVDVRSLDYGKLEKVSGNKVKKVLKIKEGLDSDLAKKIVKLLKDSKMKVQASIQGEAVRVSGAKRDVLQEAIALLRKDIGDDLENGSPLQFNNFRD

SEQ ID NO: 6672 - protein, 211 aa, Chromobacterium substugae
MLVTLPQLAAFLAAAVLITLSPGPDNLMVLSQGISRGRRHGMAFGLGCALGCLNHTALAALGISALIAASPAAFAALKIAGGGYLVYLGWGAIRSPGVGFDAGGDGAGPQGSLAATFRRGLIANAINPKVVLFFLAFLPQFVNPAQGPAGLQTAILGTLFSAQGALIFGALGYFSGHVGQWLARSRKTGQWLDRTAGAIFIALGLRLILAR

SEQ ID NO: 6673 - protein, 59 aa, Chromobacterium substugae
MLIALSPAAYAYIDPSSTLFAWQGALALLGGLLVFVKAPVSSLKRLLRRVFKRKDDDHA

SEQ ID NO: 6674 - protein, 215 aa, Chromobacterium substugae
MRDPLGHLELKERTAVRSLYAPLEPSHYLHSPLSQQLVGQGMLLDFDFLGSSGIVSERLPFVSYPHEWSAPQLRDAARLTLDISRNLLESGWELKDTSAWNVLFKGCAPIFCDHLSFQPIASRHWWAFGQYLQHFVFPLCVARYRDFPVSDSFLLSRDGLDAARFRALMGTRIFATRFWPLALGRGSGPATTAICTACWTGFWRLPRARAAVAPG

SEQ ID NO: 6675 - protein, 126 aa, Chromobacterium substugae
MANLDDLDGGRGWGGAEFNGLPARLAAVTELALMLALTHHLAISLSIPYRKIAEFAAASTRKWLIVELIEENDPLVERLCRERKRHPAEFPLSLQRAAFLERFRLLGEQQLPGIGRHLLALEKRQA

SEQ ID NO: 6676 - protein, 142 aa, Chromobacterium substugae
MSRRADSWVLALAIALGATVCWLPAWQAAARYHGGYSVAETAAYLLLPALAAVLLAGMAAALGARGRQLLCALLLLTALYLLHKFVRGLLPAAPALPPGRSFSCFAPPVGWRRRGWPTRSGGSWATSSSPPPSCSRSLRMRC

SEQ ID NO: 6677 - protein, 298 aa, Chromobacterium substugae
MSDQAGAYPVFSLASPYALASPSRNTLAILLDETGPEFTAPLLKAAQERQLRWASVVVPAAGANTVNAIPAMLTGKRFDNVAPCGPSWLCSPTRSLDFGQLYAGRPDLDIVGFWHPYCAIRGLRYCRRIAGVFYPPPARSFLCSPPYLPALLNCRPAAGSRDAAVDRLLAAAYAAPFWREGGMLYLHLPLPHPSMETRENLRSHYLANLADASQVLGQLLDKMRGRFGDDFSVIVTSDHPLRTEGWCRPEREYHAADCSLGLPANRKQVPFIVISPRLAEQPRMPADNLGVFHGAARS

SEQ ID NO: 6678 - protein, 174 aa, Chromobacterium substugae
MSLTMHQAAIPALTRGLNSLSAILAKAAAHAEARNIDPQVFLQARLAPDMFPLLRQAQIACDLAKGCAARLAGQEVPSYADDEIGFDDLQARIAKTLALVAGVTPAQLEGSEDRAVTLKVRGEEITFSGLGYLRNFALPNFYFHLTTAYAILRHNGLELGKPDYLGGAPASLAE

SEQ ID NO: 6679 - protein, 67 aa, Chromobacterium substugae
MSEEQFTNISLVVCLTGLIIFMGFIIWDLGKKSKAGKTGMFVLFLVLGFGVSGFVFKNILAEFLLRK

SEQ ID NO: 6680 - protein, 303 aa, Chromobacterium substugae
MRASSWIPWVFVALWSTGFTGAKLGLPYCGPFTFLAIRMALTLLCFAGLIAALRPAWPTLAQMRSQWVSGGMLHGGYLGCLFAAIKLGVPAGLAALIMGLQPLLTALLSMGLGGQRFRAGQWLGMALGLAGTALVILGSKGVSFGGGAGAAFAAGGLLLITGGTLYQKHRGGGAHPIAGAFHQYLSAFAVTGLLALLFERGQSVAWSGQFVFALAWSVLMLSVLAILLLMRMLRDGDVGKVAAYLYLVPGLTAIQAWLLFDERLSPLAMGGIVLAAAGVALVLRGGRFRPAARPAGQMKADKG

SEQ ID NO: 6681 - protein, 408 aa, Chromobacterium substugae
MSDIKKVVLAYSGGLDTSVILKWLQDVYQCEVVTFTADIGQGEEVEPARQKAVSLGIKPENIFIEDLREEFVRDYVFPMFRANTVYEGEYLLGTSIARPLIAKRQIAIANQVGADAVSHGATGKGNDQVRFELGYYALKPDVKVIAPWREWDLLSREKLLAYAEAHGIDISKKKNGGSPYSMDANLLHISYEGTSLEDPAREPDEDMWLWSVSPENAPDQAEYVELEYKHGDIVAINGQALSPAAVLTELNRLGNKHGIGRLDIVENRYVGMKSRGCYETPGGTIMLKAHRAIESITLDREVAHLKDELMPKYAQLIYTGYWWSPERAMLQQMIDASQATVNGWVRLKLYKGNVIVVGRESKTDSLFDPTIATFDEDGGAYNHADAAGFIRLNALRMRIAANARNKRG

SEQ ID NO: 6682 - protein, 307 aa, Chromobacterium substugae
MKSVRHYLQFSDLTPDEYHHLFERTKVLKRRQGAGELHRPLVGKVMSMVFEKHSTRTRASFEAGMAQLGGHAMFLDTKSSQMGRGEPVEDTARVLSRMSDIIMIRTFEQRQVERLAAHSRVPVINGLTNEYHPCQILADIFTYVERHGSIKGKTVAWIGDGNNVCRTWLQAARVLGFKLKVASPLGYELKALDGHHYGSELLELTQDPARAASGADIVTTDVFTSMGYEAEQAARREAFAGYQVTAELMKHAKPDALFMHCLPAHRGEEVAAEVIDGPQSVVWDEAENRMHAQKALIEFLLLGHRED

SEQ ID NO: 6683 - protein, 652 aa, Chromobacterium substugae
MKPVSRVLVVSDDVTWQAEVLAGLGAAAVRLENPFGLTFVAAATSAETMDLIARDGETQVVLVDRQLKGAGANQAAAQLANRISAFRPEVSLYVFLQDDDERALVEELASHAVDGYFYRDEADFNGWFRILAAELAEKSATPFYDKLKQYVRMAKDSWHTPGHSGGDSLKGSPWVGDFHDFVGEHLLRADLSVSVPMLDSLLHPTGVIAESQMLAAKAFGAKKTYFATNGTSTSNKVIFQTLLAPGDKLLLDRNCHKSVHHGVILSGALPVYLDSSINRQYGIFGPVPKTTIFEAIDANPDARVLILTSCTYDGLRYDLKPIIEAAHEKGIKVIVDEAWYGFARFHPAFRPTALESGADYVTQSTHKILSAFSQASMIHVNDPGFDAHLFRENFNMHASTSPQYNLIASLDVARKQAVMEGYRLLDRTLKLAQELREKINSTGVFRVLELADLLPEEVREDGIQLDPTKLTVDFTRSGFTADELQQALFERYNVQVEKSTFSTITLLLTIGTTRSKLSRLYDAMLRLAKENRPARALGRMPEIPHFSRLACLPRDAFYEAGERLPLLDDDGRPNAELCGRVCCDQIVPYPPGIPVLVPGQLIDDTILSYLARLQKTQKTIEMHGLAEDGGEFYVRVLRPAELAELPGRGLFN

SEQ ID NO: 6684 - protein, 707 aa, Chromobacterium substugae
MLTDAEKDAIRDHYRTLSDNLPGFRPRASQRRMLAEIANTLSRAQEKVDDEWPQREGESIAVIEGPTGVGKSLAYLLAGGVMARARGKKLVVTSATVALQEQLVNRDLPFVVENSGLPLSFALAKGRGRYLCPYRLYGLTAQHAQQSLLQPDPMMALWDHKPEQAELDALSAMADAFHYRKWDGDRDNWDTVIEDGLWSRVTNDRHGCLKTACPNRAECPFYLARDTLENVDVVVANHDLMLADVSMGGGVILPAPEESFYCIDEAHHLAKKAINQFAAEHSLAQALGWLDKVAAVVVHAEAHTGKAELASQAIDSAAACVETLTEWLWLLEGEDALAASSDNLEPSWLIEDGILPERLKTPAANMAVSARSLSKQLDDMGNALSETRKDKNGDGDLDKTATELGFLIGRAEQLMAVWDLFDTETAENAPPIAKWITRRAEGKGDYLFSASPVSAAASLAATLWRRACGAVLTSATLRSLGDFELLLSQTGLKWLPKVSCLALDSPFNFDEQGELYLPPLQASPKDPGGHTREIIEWLPKLIDPAQAVGTLVLFSSRKQMQEVAAGLPAELRDRLLVQGEIPKRTLLDTHHKRLEEQQSSVIFGLDSFSEGLDLPGESCVHVIIAKLPFAMPDDPVGKTLSRWIEKRGGNPFIELTVPEASIKLVQAVGRLIRTERDYGRVTILDNRLTRQSYGKKLLASLPPFKRI

SEQ ID NO: 6685 - protein, 104 aa, Chromobacterium substugae
MICNPYEIVIQGLTSEGRTFRPSDWAERLAGILASFDTNQRLSYHAYVRPMLLEGVRCVAVDKKLEKVHPQIYQFLMDFAKDNDLRVVDCRTLIDEVYPNKFSA

SEQ ID NO: 6686 - protein, 394 aa, Chromobacterium substugae
MQKKNLAALVASLFILPVAAHADVTIYGFISAGIESAKATGNGNSAKDYTSRTRVSDQNSRIGFKGWEDLGGGTKAIWQVESSLRNFENGGTNDKGQTASFGTRNTFIGIDNADFGKVLLGQNDSAYKVFTGSSNSALGTDLMVNTTADNFGSSSVNSRGEARLANSVHWFSPKWAGFTLGGSWGVDEARVAGNDSKRISLGLGYNWGGLNLATAWDKQYDMAVKNNSNGYNTSPTNDPAVLALNAGKNVSFYSIAASYKFDFGTFIGGNYEWGNFDQIGGGQVKQDDWLIALGQDFGAASIKLSYGQLGTLKNVGAGVNGDDFKAKQWILGGTYNLSKSTQLLAYATKITNNAQSKANFANNPVYDNNLGTSSAGLTAGNSPQAFGIGMKVAF

SEQ ID NO: 6687 - protein, 260 aa, Chromobacterium substugae
MESVAKSGEVRQLAALGQALLTSSKGEHALPDAPAVEAAPLVRGGKEVGHRDFPAAKRILPRVYAGMEVDFYCGCRYQGKAVDWASCGYQPRKSESRASRIEWEHVVPAWVLGHQRQCWQKGGRKACGDTDPLFQMAEGDLNNLVPAVGEVNGDRANFSYGAWEIHPRPIYGQCQSLVDFKQKRFQPREEVRGSAARITLYMHQRYGLRISQQDKQLMCAWARKYPVDEWERQRNRRIIQWQGEGNFLVSQPGELDRVCN

SEQ ID NO: 6688 - protein, 667 aa, Chromobacterium substugae
MKLKLMVLALVMAGQAWAHELSGIDTKNFNPDVRPQDDIYLAVNGKWLDTHEIPAAESWEGAFKELRDLSEERSRSLIETASAASGAAGNAQKIGALYSSFMDEAAAEKKGLQPIEADLQAITLLSSRNELLRLLGAGQAGNARLPLAFEVGIDAKDAKSYLPELYQSGLLMPDRDYYLGKDPRFAKARAAFLVYLQQLFKQAGYAQPAKRAARVLALETQLAQLQRSRVDNRDPQKRYNKMTVAQLAKLAPKLDWHGFFAEAGAADLAVLNVNQPEYVSGLAQLLRKQPLLNWQDYLIAHTLDGYAPYLNKALVDARFDFYGKALSGTLEQRPRWKRGVQLVESSLGEALGEQYVAKYFPAEHKQKMQELVANLMQAYRQSIDGLSWMSPATKQAAQVKLSKYMLKIAYPDHWRDYSGLQLQAGDLVGNVKRANRFEYQWQLSHLGKPVDRTEWGMTPQTVNAYYNPSQNEIVFPAAILQPPFFNAQADDAANYGGIGAVIGHEISHGFDDQGSQYDADGNLRDWWTAEDKARFHELTNKLVAQYEAYEPLPGKHINGKLTLGENIADNVGLQIAYKAYQLSLGGKPAPVIDGMTGDQRFFYGFAQVWRGKVRDEALLSRLVSDPHSPEAFRAIGATSNSDAFQKAFEVKPGDKMFKPEDQRIRIW

SEQ ID NO: 6689 - protein, 127 aa, Chromobacterium substugae
MMEINTTPLIDVMLVMLIMLIITIPIQTHAVKLDMPVNTPSKPLEKPVVVQIDIAPDNSVLWNGEKLAGREQLEAKLTAAGKASPQPELHIKPNKDASYEPVAMVLAESQRLGLTKLGIVGSEQFVK

SEQ ID NO: 6690 - protein, 128 aa, Chromobacterium substugae; identical to SEQ ID NO: 6561

SEQ ID NO: 6691 - protein, 248 aa, Chromobacterium substugae; identical to SEQ ID NO: 6560

SEQ ID NO: 6692 - protein, 195 aa, Chromobacterium substugae
MIIFHAVLIYALVTGLAQGVVKVIQQKVEVSVISEPPPPPPPPPPKIEKVVQPTAAPKPQAYVPPVVNPPPVVQSANAIQSVTSDPKPQPAPTPAPVVEAPKGPISAKANCSHLEAPEYPSKAQEDEIQGVVRVVFGVGADGKFSGISNIGFDGSIPPRYRSSFKSAISAALQGYTCQANSQLTQEFGFKLDSGS

SEQ ID NO: 6693 - protein, 859 aa, Chromobacterium substugae
MKRTQLALALALIGIGSHAPLALADGNGELDRVEVTGSNIKRSIKQEKALPVTVIRTEEATKQGFTTVEQVVNSLASNQSGMVSASSVQSVSGGASYASLRGLGSQYTLVLLDGRRVASQAISGYATDLNAIPLSAIERIEVLRDGASAIYGTDAIGGVINFITKKSVTGLTVGGEILSTEHRGGNTGNFNLIGGVGNLAEDGWNVYGSLAYQKTQRITTLERSYAHNNLTADNLSGSVFPANFIYKGVGYNPAAPKCQPPYAQPLDANSCGEMSTLFMDLTPEVEQWTATAKATKQIGDHSLSLQYMGARNISTTRISPTPLAKIATLVAGDKYYPTTLPDGTPTDGSPVVLNARSVPLGPRTTKSTSDTQRIAFNAEGLLGGWDYRTGAIYSENKTTINYQSGYANETLIRNAFKNGTINPFGPSDPGAWDSVKLSGDGWIAKYTTALADFKASKEVLELPAGMLATAIGAEVRHEKLDSQIQAAARNAIGSGIANSQSTSGQRNVSALYAEADIPVLKGLDVQVATRFDHYNDFGNSFNPKVAFKYQPVSQVLFRGSASKGFRAPSLYDVFMPDSKTYSADKFNDPVRCPGGVPANGGNKPQDCNQQFMVMQGGSRTLAAEKASSLTLGLVIEPVPAVTASADFWWTMVQNSIGTLDPGAIFADPAKYADRFVRNPDGSLDYVKTPTENLGNLSVAGVDVSLAFRLPKTAIGDFSVNLDGTYTSKYVQQLEKDGVYYSPLGGWYQNILLPTLRWKHSLAFNWAKSAWSASLVQNYSSGYTDMNPNDENHSVRSYSNWNLSGSYVWKKKLTVTAGVKNLFDQQPPFSNQTKSFQYGFDPVLTDPVGRAFFIKTSYKL

SEQ ID NO: 6694 - protein, 567 aa, Chromobacterium substugae
MSNNKPLLSVRNLKVGFRQEDGGRFEALKGVSFDIPAHRTVALVGESGSGKSVTSMAIMQLLPPQSSEIDPASELLFQGRNLLRLSRGELRKLRGKDIAMIFQEPMSSLNPVFSVGEQIVETLTLHAGLSRSAAWKRAVELLREVGLPEPEKRVKAYPHELSGGQQQRVMIAIAIACEPKLLIADEPTTALDVTIQKQILQLIADLQKKHGMSVLFITHDLGVVGEFADEVIVMRHGVIREQGTVKQIFENPQDAYTKALLSCRPHLDRRPERLAVIDDFLQPGGYVEPAERTRGYAAGDEIVLDVQGLCKSFDIREGLFGKRQFHAVKDVSFQLARGKTLGIVGESGSGKTTVGLTLVRLHQATGGKALFHGQDLIGMSAKAFHAYKKRIQIIFQNPYASLNPRFTVEQILTEPMLLHGIGQDGGQRRKLALDLLDKVGLPAGALAKYPHEFSGGQRQRIAIARCLTLKPEVLICDESVSALDVSVQAQVLNLLQDLQDEYKLSYLFISHDLAVVKHISDQVLVMNKGQVVEQADADVIYREPKDSYTKKLLGAIPQGWSAALAPA

SEQ ID NO: 6695 - protein, 94 aa, Chromobacterium substugae
MFVHILPNISHLLLVQFSLLMVGLIKYEVILSFLGFGVDVRQVSWGSMLAEVPEELLQGYWWQLAMVVVFMSVLVTAFSMLTDSLRDALDPKVK

SEQ ID NO: 6696 - protein, 202 aa, Chromobacterium substugae
MQYFTPAGTDANTNAISFMGQQYQPWAIQAEGFEKTVQGSAPRPTLSIANAVMGANGPIYGIFTQLVRQFRGLAGWRVTRMVTYAKYLDGGALAGAPEFHQQEIWFVNRRTQDDGTVLQFELVSALDLEGKTVPNTMASVYCPAQTQYRSAACGYAGAAMFDVDGMPTNDPSKDACGKHFSDCQRRGNQTNYPGLLGLRRYG

SEQ ID NO: 6697 - protein, 227 aa, Chromobacterium substugae
MINEMLHLAELAHPQEACGVLLDSGRVYPCRNIAGDPRAQFELDPVDYAAAEQLGRVVGIWHSHPDDTADPSMVDRVMCERTGLPWHIVSWPNGEHTLTEPGGWQAPYEGRPFCWGMFDCFSLAQDWHRRETGIQLSRAQVAEEFWLKGDSPFPAWLASAPVDVVEGEPVRGDLIFMMCEANVVNHVAVYLGDSRILHQLYHQPSQVGIYGGWWRRCTVTVVRPRHE

SEQ ID NO: 6698 - protein, 197 aa, Chromobacterium substugae
MSEKRTVRLGGELGEKFVKQVAAYVDSVGEAVRMLDANWPGFIQHLRDSDPEKVGYRVTVADRDVVEEDELVLVSKGDILIMPVIGGASAGLRVFAGAVIAVVGAYFGQPWAVQLGVGMMIGGAVELLTPIPKQPDWQAKDGKPNYWFNGAQQTSAQGLPIPIGTGTMLIAGTVISAGVSVEDIGTGALPSNSPVLI

SEQ ID NO: 6699 - protein, 1222 aa, Chromobacterium substugae
MSDDAIFGAKGGGGSQHTPVESPDTAQSISYGRMMVLLSHGETGGPADAANPLKSIYLDDTPIQNQDGSFNFQNMQVSYRNGTQTQPAIQGFPAVETEIGVGLEVKAANPITQTVADVNATAIRVTVSLPAGLRSTDQKTGDTAGASVQYAIDLAPANGAFAQAAIVTISDKTAANYQRSTRLQLTGAGPWLVRVRRITPDSTTQYLADQTVFTSFTSIIDAQLRYPNLTVLALKFDSRQFSRMPTVSALWQQLKCQVPSNYDPVARTYTGPWDGNFKPAVTSNPVWFLWTYCTDNRFGINIPAANMDRWGMYAIAQWCDQPVPDGYGGTEPRFQFHNFQQDTQDAWKVVSDIVSSFCGQAYWSAGGIRIVADMPGKQPVKHFNATNVIEGKFTYSSTPKNGRFTAASVAWTDPGDRYRRAVEYVEHGQGLLAYGLQQTAAVAMGAVTRGQARRCGRYILETAQRSTEMVVFKAAAYGADLQPGDLFATSDFHVTGARMGGRVGSVAGTVVKLDAPVTLQSGVTYTLEVTGPDGVPVRRGVVASPGTTDTLNIVSQYPAQPVAGATWVLIATNLQPDLWTCVSIKSVDNGEFEISGLQYDPNKWAAIETGLRFDPAPTSNLPDPGVMPAVLAVQLQEQPYLAPDGSRKVKLLVDWPAVVHPYLRGYRVTYRQNGGNWIALPDQVSNHAEIMDVVPGSYDVRVSSVSVTGVVSIPVTGNQQTQGQVTPPSAPTLSAAGGAMKVDLTWMYPAGRPDIKRAELFYSTTAADPNPGKLADVSYPTTAFTFQGAQLGVTYFFWLRIYDTWGNVSSFATAQAQTMKDPTLLLQQLQGGVDYSLLAPDLAGSITSNDNVANALLQALLQVDTSWSQARGARVISGQATAAIVNEQKIRADQNASMASNISALQASVAGNAAAITSEWMARVTADSAVASQISQMQTTLIGNSATITQQAQSINGLLGQWAVQVQLDANGQNPRVAGIQLSNGQGGSSFAVLADKFQVAFPDGSNPRAAFTVGRINGQTAVGVDGSMIVDGSISGRNAIVSGSIDAGQINTRGLTICDAAGNVVVDMTGMGAAYIKGQLTVGQIDTRGMTIRDAVGNIVVSMNGIDGSFIRNLMVDTLQIKGEAVSKNDTRSITVSGWTNAFDYSFQFNCSDSGTLLAFADSPFTTPIPTLYGRGRSAPINGSAVLVLNVNAGEVVTIGVSSPAINVSGMIRYGCVLFRR

SEQ ID NO: 6700 - protein, 118 aa, Chromobacterium substugae
MPIDIIEYDDAGRILQVGTSRPENIQLDVAAGKRILVGAADPLTQYVRDGAVAPRPLAGAVLDGMTLRQLPAPCQLILDGTPYPCPDEVCELSFAHPGRHQIVVDAFPMQTAVFEVTT

SEQ ID NO: 6701 - protein, 72 aa, Chromobacterium substugae
MMKIHHAGDHAAARRQQYPDIGDQLDALWRMVADAPPDQLPPQTKAMLAEIQAVKQTYPKPRDDSGASPLEV

SEQ ID NO: 6702 - protein, 277 aa, Chromobacterium substugae
MDQFNAWLTSAGMVTLTDAAGGTHTVPSAANVLRADGSNASGTWPISVSGNAGSVSSVTAAQVAAGLGYQPVRQDSIPDTKGAMSYVQLGTFTCGQNGAKLALSVVFGNGYNAANSQLGMATLIFSTSNGGAQQPGSAGPFFGAATAMVFGNSGCTFLIAQNSPTSYTVFVQLQAWAGAGGCSAFGDASNGGWVASVVNTGSKLPAGNLLTVQPQGILTVSSFNTTPTPAPAYTRATAPAAAAYAGALVYITDATGGAALAWSNGNAWISVRTGNPV

SEQ ID NO: 6703 - protein, 47 aa, Chromobacterium substugae
MADGQSGLKLADVLGQVATVALSQNQALQLQLADVQNRLAALPEGAK

SEQ ID NO: 6704 - protein, 94 aa, Chromobacterium substugae
MIWIALFILLQLADIASTNYALVRLNGRELNPFVRRLMARVGILPALVASKAFLFFACYLLAPPPLAYQLLCAFYVFILFRNLRAVKQGRDSRP

SEQ ID NO: 6705 - protein, 96 aa, Chromobacterium substugae
MLKKLHDYRIYLLILPAALALFWIDSVVAQTWLQLGLALPVLVGVALLLRKALFHADMSEAADIALHAPTGAALVVLADRLFMAAVVIGGVLWLRG

SEQ ID NO: 6706 - protein, 205 aa, Chromobacterium substugae
MAAGLSAGALALLPLLNTAVTQHWPDMPSRSVLAAQVEQESGWRVNAKLQTSRELGAGLGQFTKAYKADGSVRFDAIREMVVAHPELRGWSWANAYDPRYQLPAIVLKNRGNYQLIRWAASDADRLAMMDAAYNSGLGGVIQRRRKCANTSGCQPGVWFGNLERSSAQSKARHAGYGQSFADITNTHVRNVMVVRRGKYRAYFGE

SEQ ID NO: 6707 - protein, 79 aa, Chromobacterium substugae
MGDEVVLPREEFRALLEAAAKAGARQALDEAGVADAVKLAKRVDGVADAVLKALAGGIVIGLLGAIWAGIVVLAKAKGG

SEQ ID NO: 6708 - protein, 39 aa, Chromobacterium substugae
MDILAESIISSMFLLIFEMVMTANLPVTVLQLLQSHIIL

SEQ ID NO: 6709 - protein, 423 aa, Chromobacterium substugae
MSAPTLFALVDGNSMYASCERVFRPDLIGKPIVVLSNNDGCVVAASAEAKALGIKMFGPFFEIADQCRQHDVAVFSSNYALYGDMSRRMMRVLSEFAAEQEVYSIDECFLDMTGMPDLDSHGHRMREAVLRRVGIPTCVGMGPSKTLAKLANRIAKKQPKWAGVFEWDFVTPAEADQMMAQIEVGDVWGIGRRLTEQLQAMGIHSALHLKQADPRRIKRAFSVVVERTVQELNGVSCLALEDVTPSKQQIIASRSFSKKVRDLNTLIASISHHAARAAEKLRAQGSAARLVGVGIRTSPFSDVAQYRPYIVVPLVQASDDTLEITRAALAGLRAIYKKGYLYHKAGIVLMEISPRGVVQSDLFAAPPDPRRELLMRTMDAITRQFGRGTVRLASENMTQRWQMRQDVRSPRYTTRLDELLEVK

SEQ ID NO: 6710 - protein, 142 aa, Chromobacterium substugae
MATIPYLMPIPGGQPLPLVLAPVRAGFPSPADDYLDDNINLHEYLVDDPPATFIVRVRGDSMIGAGIDNGDLLVVNKGLAPAHGDIVVAVIDGEFTVKRLHSRGGSCALMPENPAYAPITLHSGQELLVWGVVTGAVKKFRQ

SEQ ID NO: 6711 - protein, 100 aa, Chromobacterium substugae
MKVQVVADEKSNRKGYSAAQFLANQGVPVRLNGNYSIFHHKFMVIDGQHLETGSFNYSAAAASKNAENVLLLRNVKPLADKYAVEWTRLWQEATPLPKAY

SEQ ID NO: 6712 - protein, 67 aa, Chromobacterium substugae
MRLYLSADRYYAIAIQLDLFDRPVIVRAWGGRGSRRGGMATEPFSTARLKDIDRRRRQHGYQLHRPN

SEQ ID NO: 6713 - protein, 180 aa, Chromobacterium substugae
MIDIDAIIDSMGWSLTDSDWVAMRRLCQATLAAAAAAESAAASRLGLEWRACVKRPVVVHVRKQREGEKHVGTREGITPLRPDDLIMRGIAGEEYPIGSELWAKTYWLEADANLPNEKAIGKESLQVQAVPDGWRLVPIKPTEEMIRKSYWSGAGEINIHEEWAKREVWGRMLAAAPSPN

SEQ ID NO: 6714 - protein, 81 aa, Chromobacterium substugae
MSKTSLKAFLDGGEAEAPTKEEKPLPDFVSIKVKVHPDDHRRLSDLAKAERPSSLQDLGVEGFNRVLAERGLPPLRRYNEG

SEQ ID NO: 6715 - protein, 84 aa, Chromobacterium substugae
MKIVTAAGKEPLFVLSACPSRVPEVADARQALADFGEVAPVEIGERIAFSRAIATGQSVTEFDPRGKAAAEIRALWQWVKEKLQ

SEQ ID NO: 6716 - protein, 47 aa, Chromobacterium substugae
MDLPEPPFCENVAMVFMFPLGMKKPAGGGFVVAGSWAVQIAQISPKF

SEQ ID NO: 6717 - protein, 155 aa, Chromobacterium substugae
MKKTILTLSLLALAGGALAADLPFLPKPAGQAVTINGKTYYKQASQAKAAAKSASGASFRASGAPALNRGDVVQSPKQALPATVSGTVLVQLASAQDEAAVARDHGLSVRFRTQSVVVYEAPAQTELLGLQQRLAADKRVKKAQLELASNDNLPQ

SEQ ID NO: 6718 - protein, 485 aa, Chromobacterium substugae
MAQSATLLVRDLPQAEYFTALVEIIKAVSKINADTDMSLKERVKTLLYVDDKAAGIHRQLCQDYLQSKSGSKGYLPTILAYWHELSSAYQICLRLSKNAASPAAEPDLQLVTIRGLHHQMRLIAWNALRYLKPEGTAWQQGFRFYTYAEEAGFSRTAMLLYPDARQEISCEHLLIQIGMLHLAQTENMLHKEIIAVDQLLMLLSQHIPLDKQAPPEGPIFVYNLSIPEPPQPMLRGMAGKWHRYWSAYEITSRLADLMFDLDSRIPSSLATLGCELEREEWADLCEKLAIRWSNDGGKSLRKSERSLHTSNAQVSIGFDRVAFQIKVQDVGSLDPERVDEWRINDISSTGMGLTFIGKTIDQLAIGRLILVKTESHPLLLGVIRRILRQNNGTKVGIEILGQTPVGVSLQDPSRQDIPPFTAIYITQPNSRKGQRWFLMPRALTSADKELVLTAQGKSYQIKLKDPQQEFEDCCHSNFDTLSKID

SEQ ID NO: 6719 - protein, 701 aa, Chromobacterium substugae
MLGGGGARGFAHLGVLKELERLRIPIACISGTSAGALIGGIYANGLPLDEIEREFNAADWDQMLSGKPARADIPYDRKRNDYKNYLDVSFGLKDGALRVPRSAINSQGIELYIHKLTRDRDIDDFDKLPIPFRAIAADLSTGDAVVFKQGSLTRALRASMAVPGVFDLVEDEGRLLVDGAIARNVPVEDVKGRCAKQAIVVDVGTPLMKPDEIQTLFDVVAQSSNLAVLRNVQEQMKLLDKKDIVIRPDLTGYAATSFGDHQAIVRRGEEAARKMAKQLSAYSVSEEAYAAWKRKLQRPRYPVLDEVKVEGTDGTFTKLSTLRESLAFPGPVPVGTARNRLAEIFTGGEYDKLGYRVDNVSGRSVMTVMPVERSIGQNYLHFGLNLRSDTPGDNSFTLRAAHEWTALNDAGASWRNDLAIGYDKSITTELYQPLWNGSPFFVAGSLGYEQKPFRVFNDNHTVLATLKNDVLSGQVNVGLALGKYGEWRVGLYRQDNDYSLEQGDPSEFNGNDRFRNTGVQSSLVVDQFDNPRWPRAGYYFSGKVGAGLPGLGSEVNQKFYDLIGETAHTYGDVTARFTAKARGYVDIRNGDIPQTLGGFLNLTGYQNGELLADQVALARLMVYWRAASLPAVLGSGVYAGVSLEAGRLWGQNYSDLQTARGWIPAGSLFLGADTILGPFFVGVGTARGGQLTGYIYLGVDY

SEQ ID NO: 6720 - protein, 682 aa, Chromobacterium substugae
MKNTPHRQRKALSQATILALACLGSTAALAAGAPDLQDNSTTLPAVTVTGEKINRSLQDTTTAVTVLRDADKGEVKSVYDAAAATPNASLNGAGIVNIRGVEGTGPGTGYNTLVSGSRPRVSTTVDGMAESWTGQRYVDASPWDVEQIEVLRGPQSTTQGRNTMAGSIVVNTKDPASDWEGALRAGYEDKGGRATLAGMVSGPITDELAFRVTAEGLNGHSYIDYPGQMPWDGSDINHSSYRGKLLWKPSALPGFSAKLTVSHRKDKGDYLNYVDGNYFDYQYHRLSTQARYQDSSNNTISTDLQYQFNDAWSAHLLVGHADNVSAFKDTDTPPLNMRLDEKSDTVEARLAYAPQNGWLSGMMGVYHYDRDQSLRTFQFPNLLAKDRLKTEALYGEATLALSDKWSLNLGGRVEREMQRRHTLFNPDTAAQNQASYNVGETLFLPKAGLSYRYSPDTTLGLTARKGYNAGGSGLDNNYVYYTYNKEEVTAYELSSRSAFLDNRVSLNANAFFNQYTGYQAILASRFTNIPEGQSYGLELETKARVTPTLTVNAGLGLLNTKVTGTDAANPGIMGNQFNYAPHMTVNLGFKQRLPRNFYVGGSLNRVGSYYSEITNDPSLKAGDYTVVNLNTGYEDARWGVRAYVNNLTNRGVLYAQIASRGNNLGVVGAPRTVGVTVDYRFF

SEQ ID NO: 6721 - protein, 459 aa, Chromobacterium substugae
MARREKCAIRLPEWIEIMGGNVKWNQMAAESAAWLQHPDAGLPSWWERLAVIGAPLRERLPDGRVCVTFLWRDPAGGPAASATVRVYADVNSVTDHHSPQPQSLSRLGDTDVWWWQAVLPADWRGSYAYIPVAAGQTPPVPSDDVRESRLRHREWWLSIMSQAIADPLNPAAGYRSSWGASLSPLHLPDAPDQSAWTAWDKTGQGADPHRLTEIRWDSAMLGKARRVWIYHTGAVSVGEWAGRPLAILLDGQHWAQRLPVFAALDEDTRRGRLPPAVYLLIDSIDGKHREEDLPCNAAFWLALQAELLPQAALIAPFSDRADRTVVAGQSYGGLAAMFAGLNWPDRFGCVLSQSGSFWWPHVELHEKARAASGRLPGSKGWLAEQLEAGETPPGRLRVFQEVGRREEVMVDVNDSHRAALERAGHDVHYQVFEGGHDWLCWRGGLLQGLGCLWRPWVAP

SEQ ID NO: 6722 - protein, 70 aa, Chromobacterium substugae
MSAEQTNPFDDESLSFLVLVNPQDQHSLWPSQLASPAGWRAVFGPAGRGACVSYLDANWTDIRPRSLRSG

SEQ ID NO: 6723 - protein, 2827 aa, Chromobacterium substugae
MTIETKPSAVERELPLFGSQLGIWLADQIAEQKNTYTVAHCVALDGAIDAERLRQSIRLGLAEADTVVAQYLETPEGPAQRLRQGLSAKDLPLPEIHDLSAEADPESLAREWMRADLAAELAADGERPLHLHRLFKLAGGAGERWFWYQRYHHVCVDGYSFAALTRRIADLYQALGRGEAPSPSPFVSFVDVAAERDSYLASPRCEEDRAFWRDYAAALPAPSTLSARDALAGDGAANVDVLRRRFEIAGGTAAPQAMAAVFAYLARMSGKSRVAMGMPFMRRMGSAALRAVGPVVNVLPVALDIDNGDDLATLARRLADELKQVRRHERYDAEQIQRDSGMVGSRRALYGATLNLKIYDQSLRLGEVAGVTLPLAVGPIDDIEFGLWQQGESLVVELSANPARYGAAELEWHAWRLRGFIAALASGAAVGDAPLHSAAEKAALDEWSRGPRVAAPAGVRTALDVFLVSALQYQNETALACGDERLSYGQLSARVAQLARELLARGIGDGSVVGVAVPRSVDTVVAILGTLAAGAAFLPLDLDYPPERLAMMCEDAAPALLLTRSDVRGRLPSLPALCLDDEAVRARLAARAAQPLDDGERLRPLNGDRLAYMIYTSGSTGKPKGVMIAHASFLNLLLSQQTGLFGDFVRSRGRRVRTMQTASLSFDGALEQLFWLFMGQEVHLCDEELRRDAQQLVELVRRERIDEMDVPPSLLRQMLDCGLMDDGHWQPGMVMVGGEAVPPALWKEMRGYSQLHFHNFYGPTEYTISALGAPGSVAEEPVVGRPVANTRALVLDAALRPVAIGVAGELYLAGAGLGLGYLNRPSLTAARFVASPFGDGELMYRTGDLVRWNAHGQMDFIGRVDHQIKVRGFRIEMGEVEHALASLPGVNAAVVLAEAVGGSHRLIAYCTMADAGRHEEAGLSAALLAQVAETLPDYMVPSALAVLPEWPVNINGKIDRKALPAIRPQNAAAGREPANDAERLLCAAVARVLNLEQASPDDDFFQLGGDSISAMSLGTELRRAGFLLRPRDVFAKRTPAGMAAALQPLSAANPAADDKAGPLGKLPIVSWFAEQYGMASRFVQGVWLKAPAALGTEHLAAGLLALQRAHPALRSRAADGQLHLDAAPTALDARVLIEAAPEATPDQLFETACARLDPENGLMLQAALRDGADGKHLLLAVHHLAVDGVSWRALLPELQAACEAAMAGEAVQLPREDFGLREWAKTLAAQVPARRGELAMWRGMLAGKADALSAKALDPARDRHDAARHRRALLGEAASAALLQKLPNACRATVEEILLAALLLACRGEFDAPRLRVGLESHGRHAGDDGIDLGRTVGWLTAEYPALFDLSVQTAGDAAALAALRAVKRVMRAIPDHGLGYGVLRYLDDEHGPALGALEAQNRPALLFNYLGRFQASDGEWMPLAAGGRFADAFAVDIDPALPLQYGLEANVFVDESGAAPRVAVNWTWADALYGADAIERLGQRMDSAIAALAQLAERDPLAAADTLVAAETLGAGGAPLSDAELAALCARHGSLAAALPVLPLQQGLLFHAQLGEAAGKYNSITRVTFAGPLGSDRLRAALAAVLRRHPQLAAGFDSEAQAEPLQLLPLALPEWPWRELELAASADEAEALQALEREELDRDFTVGGPGDGPLLQATLARHGQLSTLFLTAHHLVVDGWSTPIMLRDLLAAYGDGPDTLPSIRVDYPSVVRALAARDLTPARQLWLQTLDGVKPTLLFGQQTAAPEVREFELVLPQALEDALTERCRERGLTLNTAMQGMWGALLSVLTGRNDVVFGSPVSGRFSPVDGVDEHIGLFSNTIPVRVALRPDAPLWEQLADLQARQIRLLEHDGLGLAEIQRLAGATTLFDTLLVVENYPDQDMQSRDYHCARIASLRNRGHTHYPLTVLALPGDRLRLLIEYRNLVKEPQQLAERMLALLAHLAYRPELPWSAFDPLTGAERELIDKVNATAAAIPEATLPDLLAEQAARTPDAPALLDETHALGYAETRAQVGHLAGRLKDAGVKPGDIVAVALPRSVHLSLALMAAQEAGAAYLPLDTGYPDERLAYMVADAKPALIITCAELAPRFAGVGELLLQDALAAEPQAFDAPALTPDHAAYLLYTSGSTGRPKGVLVSHRAIVNRLLWMQHEYGLGADDVVLQKTPCSFDVSVWEFFWPLIVGARLFMAPPDAHRDPEALLELIAGRGVTTLHFVPSMLAALLAHMQGDAAARSAQAAGLRRVFCSGEALSRELADGYAGLIDAPLHNLYGPTEAAVDVSYQPVAKPAPESASVPIGLPVWNTALRILDAALRPVPVGAPGELYLCGVQLAHGYLGRPDLTAARFVADPYADGERMYRTGDIARWLPDGTVEYLGRSDDQLKIRGQRIELGEIEAALLSQPGVARAVVHACALGGQAAHAAGADNRQLVGYVIASDPDHPPEADALRAALAKALPAHMVPVAVMRLADFPLSANGKLDRKALPEPSAAASTEGREPRPGLESRIAALFAEVLECDAVFADDDFFALGGHSLLAMRLAAALRRELKLPVSVGQIMSSPTVAKLAAVLSDAGLASDPALAGFGEVLPLRAGKGRPLFCIHPASGFAWQYSGLSRHLRPGLALVGLQSPRPDGAIARSVDMDEACERHLANLRRIQPQGPYHLIGYSLGGTVAQAMAARLRQQGEEVAFLGLLDTYPPEGQDWNGPTEEEAKAEVAREQEQFMSATEDAADAFMLREKTEMFGHIVANYQDAVRLLSQARTPRYDGEATLFVARRTLPEGMDVRETWRPHLAGLTVHELDCAHEDIVSPQSLETLGPLLDGMLKEVDSLG

SEQ ID NO: 6724 - protein, 168 aa, Chromobacterium substugae
MDVAFFYDSIAGLMEALMKARNERTCLIVIGHGFQIIGGGAVQLLNGKGANSIEDKDINAIRPDVYIGLHCYPGAILNKLSNSCIACGLTGLNVGQNGHIKNFCESDKLDRLFEDVCQLFFIVDIEGMDKPTINEHEKAVIQALKGFKDHSTPEFAVTETASLALSKS

SEQ ID NO: 6725 - protein, 279 aa, Chromobacterium substugae
MTTLSFKLNPAAALDATLPASGRPRLSGDGLRLGYRQRTICERLNLRIPDGSFTVVIGPNGCGKSTLLRSLSRLLKPLDGQVRLDGRDIHSQPAKAVARQLGLLPQSAVAPDSITVADLVARGRYPHQGLLRQWSRDDETAVQQALEATGTAELAGRLVDELSGGQRQRVWVAMALAQQTPLLLLDEPTTYLDIAHQIELLELFRTLNRDGGRTLVAVLHDINHACRYATHLIAMKDGRIVAEGAPSRIVSAELIEQVFGLPCLIIEDPVSHTPMVIPR

SEQ ID NO: 6726 - protein, 347 aa, Chromobacterium substugae
MKTAHLRLGHPDGRFNLRLRPSRLWPALLLMAACAALALISLRAGALHLSVEQVWAALQGQGSRLNVAVVQQWRLPRVAMALIIGAALGMSGAIFQSLLRNPLGSPDVVGFNTGAYTGALLVITTIGGSHFQIAGGALAGGLASAALVYLLAWRRGAHGLRLIIVGIAVSAMLSALNSWLLINASLESAMSAAIWGAGTLNGMTWSKGLPSALLCLLAMLAALTLKPRMQLLEMGDDSANALGVPAERTRLWLMGLGVALIASATAAAGPIAFIALAAPQIAQRLQRARATSPMTAAWTGALLLLAADYAAQHLFYPRQLPVGVVTICIGGLYLLWLLLRQTGGAKS

SEQ ID NO: 6727 - protein, 371 aa, Chromobacterium substugae
MRAAGMMTSRAMGLSLHVTGMVTSAVVIRNHFHLIMQTSPARGRRATLLLACLALLAVVSVLSLALGAKPIPLATVWNSLLGRAAGPDSVVVLQGRLPRTLLGLLAGAALGLSGALIQALTRNPLADPGILGVNAGASFAMVLGVAFLAVDSQGGYMACAAAGALCATLLVYAVGARGRRADPLRIVLAGVAVGAVLMGLSAAITLLDPIAFNRLRYWSAGTLDVRDMAAVGLAAPAILAGGVLALLLARPLNAMGLGNDLALSLGGRPLLIQGGTVAAVTLLSGASTAVAGPIGFVGLMIPHVARRLGGADLRWSLPFTVLLAPILLLASDIAGRLLTPGELRVSIVTAFIGAPALIWLARSHGGAGGKP

SEQ ID NO: 6728 - protein, 424 aa, Chromobacterium substugae
MKKSPIFVDFSLLRLNPHFRSIFIARMISVFAFGILMVAVPVQIHQLTGSTLQVGAAMALDGIGMFAGLMCGGVLADRMDRRRLILLGRTSCGLGFLALALNGFMTNPSVTALYVVSTWDGFFSGIGITSLMASIPVIVGRENLPAAGALSMLTVRFGAVLSPLLGGVIITAAGVNWNYLLAGIGTLATLIPLTRLPSLKPQNAEPSHPLRSLREGFEFLWQNKVVGAVVAVGTLQTLLSAVRVLYPSLAEDGYGGGAFEVGLMYSAVPLGAMLGAFTSGWVGGLSRPGAMMLACVTASSLAIASLGAFTHLAYGLAALVVLGYLGSIASLLQFTLVQGQTPDHLLGRVNSLWNAQDVVGDSLGALGLGALARALAPLLAVAWFGAGAAAAGLLMCVGFGSLRRLSGGKPEQAEGEPAEQAAGS

SEQ ID NO: 6729 - protein, 361 aa, Chromobacterium substugae
MASATMLMIILITCNKIAGRYRMQRKHSMPLPYATRRGALRLAAAAGLAALLGACNAPAESDKAAAASAGWPRTLDTPKGKVTLDKMPQRIVSTSVTLTGTLLAIHAPVVASGASAAHSKVTDDQGFFTQWSAVAKQRGVTPLYQGEPNAEAIIAAQPDLIVMAGTGGDSALKLYEQLSQMAPTLVVNYDDKSWQELAALLGQATGREADARAAIAGFDAEAAQLKAALKLPPQPTAALVYYEDGSGANLWTPQSAQGKLLQSLGFELATAPDSVKGNTSMGVRHDIIQLTGEKFADGLQGKSMILFNADQDQVPQVLANPFLAGNPAVKAKQVYAAGLDTFRLDYYSARNLLARLRKQFG

SEQ ID NO: 6730 - protein, 374 aa, Chromobacterium substugae
MRILTVVAMAAGLAGCGGKEPAPEAGKPPEVGVVKLEAKDVAVRAELAGRTVAYRSAEVRPQVNGIVLKRHFTEGSLVKAGDLLYQIDPAGYQAALQQAEATLASARAALGSLKGRAERYAELAKIDGVSRQEREEADADYRKGLAAAKSGEAAVAAARVELSRTRVLAPISGRIGRSAVSEGALVTSGQSATLATIQQLDPMYVDIVQSSQDLLAFKRRQADGELEPAGSAARLTLEDGVPYRHPGKLRFTELNVDRVSGAVTLRAEFPNPEGLLLPGMYVRAELEQGVRRQAVLAPQQGVARDDKGRATALVLGAGDKVEQRLLTTEGTHGAYWLVTTGLKAGDRLIVDGLQRARPGEAATPVALPALAGRS

SEQ ID NO: 6731 - protein, 1042 aa, Chromobacterium substugae
MLARFFIGRPVFAWVLAIVIMLAGLFALRALPVSQYPDIAPPTVMVSASYPGASAQVVETSVIQVLEQELKGLDNLMYFSSTSSSSGQAEIMLTFRQGANADTAQVQVQNKVSQMLARLPQQVQQNGLSVQKMQGDFLLIASFYDVSGKRSDTDIADWLASNVQDPLSRVDGVGSVRAFGAPYAMRVWLDPHKLNSYGLIPSDVSAAISKQNTEVSVGELGALPSPPGQQLNAMVTAWSRLSTPEQFREIVLKALPDGGAVRLGDVARVELGQEDYSSSSRLNGHPASGLAVMLAPGSNALATAEAVKARVAELERNFPPGIRVAYPEDTTHFVRLSIRAVMETLLEAVALVVLVMYVFLRNWRATLIPALTVPVVLLGTFGMLSAAGFGINTLTLFGIVLAIGLLVDDAIVVVENVERVMSEEGLDARAATICSMSEIGGALVGIGLVLGAVFLPMAFFGGSVGVIYRQFSITIVAAMALSVLTALTLTPALCATLLRPHAPSERGPLAAFERRFNHLQSAYAGRWLPSWLRRPMRGGMVYLALAAGLAALYPRLPTAFIPDEDQGTVMVQFTLPTGATHERADKVARAVEQHFLETEKANVESVYMLSGFSFGGSGQNAGMAFVALKDWSQRRGRESSAQAIADRATTALASARDAEVFGMVLPPIGGLGQTNGFEFWLQDASGMGREGLAKARDQLLKAAQGDDRLSAVRSGAADDKPQLRLDVDQSKAAALGLDPANVADTLGAAWGGRYINDFIDRGRVKKVMMQADAPYRSKPEDLGLWFVRGADGTMTPFSAFARARWEYGPAQLNRYNGLPALPLSGSAAAGVSSGEAMKAVEAVAGKLPGTQYEWSGLSYQDRLSSGQTPLLYAVSILFVFLCLAALYESWLVPCAAMTAIPLGVLGAVLAVMARGLANDIYFQVGLLTTIGLSAKNAILIIEFAEAAIRRGDDALSAALAAARQRLRPILMTSLAFGVGVAPLVWAGGPGAGSQNAIGAAVLGGVVSATLLTLFFVPLAHLLIRGLAGQVAQRRLKMAEARG

SEQ ID NO: 6732 - protein, 465 aa, Chromobacterium substugae
MKPIPILLVCVGLAACAAPQPDYQRPAAPVPAHWPAAGAEGAEGAEGGQADVAWRRFFVDEGLRATIAQALANNRDLRAAVANVQAARAQYRVQDAARLPTVQLQGNANRQLTRGGDPSLAADSRGVSAGVGVSAFELDLFGRVKSLSDAQWRRYLASESGAQAARVSLIAETANAYLTLAADRSQLAAARATQQSAERSLALTRERLRLGAASALDVSAMNTVAQQARADVARYQGLAERDRLALQLLVGAELGEARLPAALEDKPYTLAALPVDAPADALLRRPDVRQAENLLRAAHADVDAARAGLWPKLGLSASSGFSGVTLAGLLNAPARALSLALDASLPLLDGGAARAGADQAEAQRLAALAAYEKALQSGFREVADALSQRQALAEEKQARQATLASAETSLRLAEARYRQGLDGYLSLLEAQRMAQAARQQWIGASLAEAENMAALYQALGGGLDG

SEQ ID NO: 6733 - protein, 310 aa, Chromobacterium substugae
MKHLLSRSAFVLALLMLPFASAFASSGYTQTRYPIVLVHGLFGFGQMLGVDYFYQVPAALKADGAQVYVAEVSATDSNEARGEQLLQQVQKILAITGAQKVNLIGHSQGAPTARYVAGVRPDLVASVTTIGGVNKGSTVADIVRGAAPAGTVSEAVAAAIAGALAKVIAFFSGTSDLPQQPIAALNSLTTAGSLAFNAKFPAGVPRSACGEGDYQVNGVQYYSWTGAATTTNVLDPLTIPMGVLGLAFGSTASDGLVAVCSAHLGQVIRDDYKMNHVNEINQSFGLVSLFEVSPVSLYRQQANRLKNAGL

SEQ ID NO: 6734 - protein, 308 aa, Chromobacterium substugae
MRKARLLLGLTGVCAGLLVWQAWPQAQKTAPASAQAGKDGGFAPSLRGTRPDGAVKAAADGALQVNQELRRLFDYYLAALGERELPAIRAELRAYLQRTLSAGALKQAMALFDRYVAYRQSLAGMAVAASSDLAQRLARAQSLRLQYFFSQAEVEGLFGDEDRYDAFTAKRLAILANSALSAAEKQRQIALLEQQLPPALRAAREEPVKHLQLAEAEAELRKRGGGEQELYALRAGMVGQAAADRLASLDKEEAAWQQRVADFNRERAAILQNGQLSDQQRQQAVSQLQAQRFSQQEALRLGAFSPAR

SEQ ID NO: 6735 - protein, 265 aa, Chromobacterium substugae
MSDILNTIIATKHEEIAAAQSGRPLASVRADAESRGDRRDFVAAIRAKHALGKAAVIAEIKKASPSKGVIRPDFDPAAIAASYAKHGAACLSVLTDRQYFQGDASFLEAARAACHLPALRKDFIVDEYQIYEARAMGADCILLIAAALELPQMQAFEALADELGMAVLAEVHNEAELDAALQLKTELIGVNNRNLRSFEVSLATTLKLLPRIDNGRIAVTESGIAGVDDVRLMRSSGVHSFLVGEAFMREAEPGEALARLFSQQP

SEQ ID NO: 6736 - protein, 252 aa, Chromobacterium substugae
MSQSHFAGKVALAVGASRNMGRAFAEALAADGAAVAIHYNSAGSRAGAEEAAAQILAAGGQAFAVQADITKIAEVRRLFDAVEARFGHLDILINTAGMMVKKPVTEVSEEEFDAIFALNTKAAFFCLQEAGRRLRDNGRILSIGTSLLAATTGYYGVYAGSKAPLEDFTRALAKEVGQRGITVNVVAPGPMDTEFFYAVETPETVAYLKRASINGELGQVADLVPLVKHLVSPENRWTTAQTLFINGGFVSR

SEQ ID NO: 6737 - protein, 347 aa, Chromobacterium substugae
MFAAPLAVPHVAAGVDASQCIVWISPDKYDDFDYTIHKVDLIGAGMDRIQAMQVFATVVDAGGFTKAAQQMQLPRATVSSAVQQLEAQLGVRLLHRTTRRVQLTLDGSGFYERCQQLLADFEEIEALFSQQGANPRGKLRIDVPGPIGRQVLAPALPEFFRQYPDIQLELGVTDRPVDLIQEGVDCVIRVGQLGESRLVARRVGMLAQGNYASPAYLASFGEPRSPDDLARHQAVNYASPSSGKVFAWEWQRDGEWQERALSAKISVNQVETYLACALAGLGLIQLPRYDAAPHVAAGRLVEVLADWPPPAMPVSVLYPHRRHLSRRVQVFVEWASALLRERLGLAD

SEQ ID NO: 6738 - protein, 166 aa, Chromobacterium substugae
MEHALYRLLDAQQVHYQRFEHPPVYTCEEAARLIPDLPGAECKNLFLCDAKGRRHFLVAVPAAAGVDIKALGETLDAKGLRFASPERLKRHLGLEPGSVTLLAAVNDRDDAVQVVVDAELWAAEAILCHPLVNTATLSVPVADLERLLRHCGHPPRVLAVPRRDSR

SEQ ID NO: 6739 - protein, 187 aa, Chromobacterium substugae
MKPNPSSGIAALPARERILATAHRLFYREGLRATGIDRLIAESCVTKVTFYRHFPSKHDLIQAYLEQRHQQWMAGFRAALARHAADGAMALAQALREWFASDDFRGCAFINGVGEMPAEAELAEAARRHKSEMRDAIAALLPARPAPAGLADMLALAADGAIVRAQIDGRPEAALAALEGLIMKLAG

SEQ ID NO: 6740 - protein, 155 aa, Chromobacterium substugae
MENRPPLPPFTRETAIEKARLAEDGWNSRDPARVALAYSVDTRWRNRVDFPQGRAEAEALLARKWKRELDYRLIKELWAFDGNRIAVRFAYEWHDDAGQWYRSYGNENWAFGADGLMTDRHASINDMPIAQAERQFFWPLGRRPDDHPGLSDLGL

SEQ ID NO: 6741 - protein, 487 aa, Chromobacterium substugae
MLETIRQRFLALQPQADFCSLRYVEEDRERLHVRQGRQQPLSRSHDRGAMIVVIDGGGYGYAATADLSEAGLRAAFARAKAWARATAGCGVFDYRQVELPSPSGRYAGPGSESEAPWRRAELLGLLMEESAAAKGEDARIVDWSAGLVRQDIRQLYLTSRGGEAEQRFRMLTPSLTVTAFADGRVQTRSLGGQYGGMARQGAEEALIAEAGLAGAGRRVADEALQLLHAPNCPSGKMDLLLMPEQMMLQIHESIGHPLELDRILGDERNYAGTSFVTLDMFGHYQYGSNLLNVTFDPLRRQELASYGWDDDGKAADKTWLIRNGVLERPLGGDISSARAGLEEIALDGVANSRGCNWNRPAIDRMANLNVEPGDKTFEQLVAGVERGVLMQTNVSWSIDDSRNKFQFGCEWGQLIEDGELKGVVRNPNYRGISANFWRSLRAVGDESTLSVLGTPYCGKGEPNQVVRVGHASPACVFGEVDVFGGAA

SEQ ID NO: 6742 - protein, 438 aa, Chromobacterium substugae
MRAHFKLLANELKRQLREGEGFTLWLEAESTDFVRFNHGKVRQAGSVRQAYLDVRLLRGSRQVTQQLSLSGDDHDLALLESSLPALRAALDDVEDDPFLLLNDKPQDSERLSAAALPDGAAMAEDILAAARGHDLVGILAAGEMSFGFANHLGQFNWQQGGSWNFDWSLHAFGDKAVKRSMAGGEWDAGRLRGAIDEAAAQLEWLKLPPKTLEPGRYRAYFTPSALGSLLSMLNWGGLSEKEVRSKRSPLLKLAAGEVGLSPLVTLTEDAAAGLAPMFQSDGFIKPDQVGLIVGGAHRNSLIGPRSAGEFGLAPNAGAHEIAESLRMEAGALPQQQALEALGTGVYLSNLWYLNFSDRAACRITGMTRFACFWVEGGKIVAPLGVMRFDDSLFDLLGGQLEALTAERELLADASSYGGRATQSKLLPGALVSSLHFSL

SEQ ID NO: 6743 - protein, 56 aa, Chromobacterium substugae
MGDIGHNAFLDSVRGARSAASPGTTFAIAAKAGKMMKRRCAGRNPGPPTALANPSR

SEQ ID NO: 6744 - protein, 484 aa, Chromobacterium substugae
MTDIAQLEPKAVWEHFQTLCDIPRPSKHEEQVRDYMKGWAELRGLETVVDKVGNLIIRKPATPGYEDRAGVVLQGHLDMVCQANSGTEHDFFKDPIRPVLKDGWLIAENTTLGADNGIGVALGMAVLSGDDVAHGPVEVLLTLDEEAGMGGALGLETGLLQGQYLINIDTEEWGEFYMGCAGGVDVNVSREYAVEAVPAGFQTASLTIKGLKGGHSGADIHLGRGNANKILIRLLRELEAETELRLATLKGGTARNALSREAFAVVAYPAADAAKVAAKLDAFQALMRFELAGVDEGVAVLSEAAAAAGVLARADQAAILSALHAAPHGVKRMSQRVDGVVETSNNLGVVTVADGKVFANLMVRSLLDSGTWMLAREVESLFKLAAFKVEMEGGYPGWAPNPGSKLLALFKDVFRQEFGGEAEVQVIHAGLECGILGAKYPNLDMVSFGPNIRGAHAPGERVEVESVGKAWQLLQAVLKAIPAR

SEQ ID NO: 6745 - protein, 193 aa, Chromobacterium substugae
MASLPLPSLETRLQLHAETALSLACAALLTLLWHGAGLHALLPRQGEQWLAWAVFFWPLWRTVRHILRRPRQRQLGDLIGLYVGLVLQFAVVYYLFALLLTGGSAFHGMTALYDGQGGFLPGFYGHAALLFLDCFHLSIATAATVGYGDMYPTYWPVRLLADLQIIFTSALVIIGFGRHFSGQGPRGAGKQAD

SEQ ID NO: 6746 - protein, 616 aa, Chromobacterium substugae
MYPLLENINSPADLRQLSRNQLPQLARELREFLVETVSKTGGHFASNLGSIELTVALHYVFDTPHDRLVWDVGHQTYPHKILTGRREQMGSMRQYGGLAGFPKREESEYDTFGVGHSSTSIGAALGMAVAAKTLGVERKSVAIIGDGAMTAGQAFEALNNAGAMDTDLLVILNDNDMSISPNVGALNNYLAKLMSGRFYAAMREGSSKVLGIAPPLKEIASKVEEHVKGFFTPGTLFEEFGFNYIGPIDGHDVDVLVDTLKNIKSLKGPQFLHIVTKKGQGYKLAENDPVKYHGVTKFDPANGLAGAKSGGGKPQYTQVFGDWLCDMAKLDKRLVGITPAMREGSGMVRFEKEHPDRYYDVAIAEQHAVTFAGGMACDGLKPVVAIYSTFLQRGYDQLIHDVALQNLPVMFALDRAGLVGADGPTHAGAFDLSFLRCIPNMTVIAPSDENECRQLLYTAFQLDSPTAVRYPRGTGPGVEIQQQMAALPVGKGVVRRQGGKIAILAFGSMVRPALAAAEALDATVADMRFVKPLDMELVRTLAESHELIVTVEENVVMGGAGSACLEAMQEMWLSTPVLQLGLPDDYVEHGDPALLLSKCGLDAAGIEASIRQRLAG

SEQ ID NO: 6747 - protein, 298 aa, Chromobacterium substugae
MANETFIGWMTAIQQQMETALERLLPAADAAPQRLHQAMRYATLEGGKRVRPLLAFAAGELVDAKPENLARVGAALEMIHAYSLVHDDMPCMDDDVLRRGKPTCHVAYDEATALLVGDALQTRAFELISQPLPGIAPASQLEMARTLAHASGHAGMAGGQAIDLASVGQPLTPPELEFMHMLKTGALIRASVLMGAMAGSELSAADKEALDVFAKRVGLAFQVVDDILDCEADTATLGKTAGKDAAHDKPTYVSLLGLAEAKRMAKDLHDQAFAALQGFGPRADRLRQLADYIVARSF

SEQ ID NO: 6748 - protein, 77 aa, Chromobacterium substugae
MAKAAKAPASFESALAQLEDIIQAMDSGDLPLETALASYKQGTELIKFCQAKLADAEQQLKILENNELKALDLPNGQ

SEQ ID NO: 6749 - protein, 43 aa, Chromobacterium substugae
MPLEQPVIKMEGWMSDMKNLARWANVQPYTNRRGAGIGHMTNI

SEQ ID NO: 6750 - protein, 270 aa, Chromobacterium substugae
MITGCSSGIGYHSAKVLSQRGWRVFASCRRPEDAMRLREEGLECLQLDVDDPASIQAALAEVLERSGGRLDALFNNAGFGQPGAVEDISRQAMREQFETNLFGPWELTNAVLKVMRAQGYGRIVFNSSILGFAAMRWRGAYNASKFAMEGLCDTLRHELHGTDIHVSLVEPGPIESRFRPNALARFLKNVDIDASVHRDNYQKQLERLKKEGHAAPFTLPATAVAEAVWRAISCRRPKARYPVTFPTKLYWLLRRWLPQRWYDHACRSAT

SEQ ID NO: 6751 - protein, 597 aa, Chromobacterium substugae
MKHLKWLPMLLMGVALMPHAQAADPGKVLRVAFSAPETGFDLVKVHDVYSMAVGENIFDGLLTYDYLARPLKVVPNTASAMPEVSPDGKVFTFKVKPGIYFADDPAFKGKKRELTAADYAYTFKRFADPLNNAPSGASYMDFIAGLEEASKKAAKTGKFDYDTPISGLQVLDRYTLRIVLKKPNFGFLYTIAAKDSGAVAREVIETYSKDTLSHPVGTGPFMLKEWKPGNRIVLVANPGYRKTVFDGSPGSEPGDAEIYRSLKGKTLPQVGRVEIRIIEEDQPRWLSFMNKQLDWINVPKSAMKSALNINPADPYDTTLRPVLAKRSIRLSHTLGLDVTYAYFNLKDPVIGGYGKDKVALRRAIAMAYPLQKEVIPLLYGNQAIPLQGLVPVGMVGFDPHFQGQVPYDPATANALLDEFGYKIGPDGYRTLPNGKPLVIEQGTQSSATDKQFNEIWQKAFDSIKVRVRFKTAKWNENLKAAYAYKLQMWSLGGSASTPDGDDFVSSFSSRLIGQGNLAGYQVAAYDKAYDASQILPDGAERQALYSKMNRLVAAQQPYVLGVTRFYNELTQGYVSGFKRHPISTFGGFWRYVDVAPH

SEQ ID NO: 6752 - protein, 313 aa, Chromobacterium substugae
MIAYVIRRLWQMIPTMLGVMLLVFVLFNWVGGDPTYILEGKRLTPEMMANFRAQMGLDKSLPEQFLLFAKQVLTYDFGNSWATQHSVAHTLASRVGPSLLLAGSLLVLELFTALPIAVAVAYFRGGLTDRLVTLICTVAMSISSLVYIIVGQYQLGFALDWFPVMGWDDDSIVANLFVYLPLPLLLGLLVSLAPSVRFYRSFIVEELNHDYVRTARAKGLSEPKVLFKHVLRNALIPVVTNITMSLPFLMLGSMLLERFFGIPGMGNELLNAVDKSDFPVIKAITITIAAAAMAFNLLADILYKWIDPRVQLK

SEQ ID NO: 6753 - protein, 348 aa, Chromobacterium substugae
MTTLQNTAGAAPAAPSRSLWALGWQRLKRDRIGFASLWIVAAFMLLALASWLGLIGRGWNDEIAVSYAPPTAIYQQDKSVAVHKSKAAEPALEGLKPAEDPIWAETQRARQNRDKYVVPEVKKAESLTFGADQRGRDILDKVIKGTSTSLFVGFFGSLLAIVIGAALGASAGFFGRKVDDFLMWFYSVFTAMPDMLLLLAFAAVAGRGLGTVVLVLSLTTWTGVFRLVRAEFIKLRSREFVQAADAIGASSARRMFVHILPNISHLLLVQFSLLMVGLIKYEVILSFLGFGVDVRQVSWGSMLAEVPEELLQGYWWQLAMVVVFMSVLVTAFSMLTDSLRDALDPKVK

SEQ ID NO: 6754 - protein, 513 aa, Chromobacterium substugae
MSNNKPLLSVRNLKVGFRQEDGGRFEALKGVSFDIPAHRTVALVGESGSGKSVTSMAIMQLLPPQSSEIDPASELLFQGRNLLRLSRGELRKLRGKDIAMIFQEPMSSLNPVFSVGEQIVETLTLHAGLSRSAAWKRAVELLREVGLPEPEKRVKAYPHELSGGQQQRVMIAIAIACEPKLLIADEPTTALDVTIQKQILQLIADLQKKHGMSVLFITHDLGVVGEFADEVIVMRHGVIREQGTVKQIFENPQDAYTKALLSCRPHLDRRPERLAVIDDFLQPGGYVEPAERTRGYAAGDEIVLDVQGLCKSFDIREGLFGKRQFHAVKDVSFQLARGKTLGIVGESGSGKTTVGLTLVRLHQATGGKALFHGQDLIGMSAKAFHAYKKRIQIIFQNPYASLNPRFTVEQILTEPMLLHGIGQDGGQRRKLALDLLDKVGLPAGALAKYPHEFSGGLPLAAGELVRVLGQRARRQPHLVQQVQRQLAALPAVLPPTQSRRHLRHRKTPNPAHG

SEQ ID NO: 6755 - protein, 148 aa, Chromobacterium substugae
MNDPIPLFLDISSQLTGFSATELEATGMASLYWDTVLRQNPPADVEGFLSCSRRILQEGGGDETAIHEMIAAQLFPVSQFGGLAQNLINLWYLGQWIPANQNLGLAMQHNVSSEAYVQSLVWRAAQTHPPGARQPGFGSWAEKPLNPN

SEQ ID NO: 6756 - protein, 635 aa, Chromobacterium substugae
MRDSQYDVVIVGTGIAGAVLAKSLTQAGKRVLMLEAGLQAGLELDAESAFANYQSYVDTFHYKANPATNGPYPALQDAPTPNVLDIALGDPMDQTGYLVQMGPLAFGSDCLRTPGGTTLHWLGNVPRMLPNDFRMQTLYGRGVDWPISYDELKPYYELAELEIGVSGDAAAQVGPDMGRANYGAGYVFPMQAIPQSYQDKVWIRNAQGAKVRVDGADYDVSFISMPQGRNSTPNPDYPYSAIAWEPASQRFAPQRVGAQYQVIGSTWSPYTGERCEGNASCVPLCPVQAKYNALKTLKQADRSRLTIHTQAVASKVRIDPQSRRVTGIEYKRYQKPDAGGYTNHTAEGTLYVLAANALENAKLLLMSGAANSSDQVGRNLMDHQVMLTWGLFKHEKVYPYRGPGCTTYIPTFRDGAFRKDFSAWISPVDNWGWSWPVFSPGSDLSDGMNKGLFGKALRAYLADRVPRQALLHFECEQLPRPENRITIDERFLDRLGNPRPVIHYSLSDYELRAFAAAKEASDQIFAQAQIKDYTHYPANEGDQDVVQWQGKTYQFWGAGHIVGTHRMGSEAASSVVKPTQQTWDHDNLYLVGCGNMPTLGTSNPTLTLTALAFMAAENILKQLDSPSRQGDAHEQ

SEQ ID NO: 6757 - protein, 382 aa, Chromobacterium substugae
MSNDYLVQTAQGRRRQRLVRPLQSPLQALRFTAEPAEFQVSGTIKTLPQLREHLQTAIQLEHTTIPPYLTTLYTLDERRNRFAYQAIQGVVMEEMLHMIQVCNILNALGGSPAINTPHFIPEYPAPLPHSDNAFKVPLQKFSPDTISVFLQIEMPAPSDAPPEANHYNSIGQFYDAIRLAIEELDAENWLKHGRSLFDEFPEKAGYQILPEHYYGGGGKLLAIRSLEDARNAIEEIIGQGEGVDGTIIDTDSIEFGQDVEYAHYFRFNEIKHARRYLPDDSARLPPTGPAVEVDWNAVIDMAPNPRMADYPEDSPLRRQSWEFNRTYCQLLNLLHISCNGKPDRLGEAIPVMYQLKYQAQALLNLPNGAGQRAGPSFEYVPL

SEQ ID NO: 6758 - protein, 352 aa, Chromobacterium substugae
MRIQELHQALADIGARPCHIGRIHRAWLQGLPLDAGTSRQKSEDYFPLSVRNGLPPIAARLEALARVHSRHPAADGSLRLLVALADGQMVESVLLPRDGLCVSSQVGCAVGCTFCMTGKSGLLRQLGSAEIAAQVALARRIRPVKKVVFMGMGEPAHNLDNVLEAIDWLGTDGGIGHKNLVFSTVGDPRVFERLPQQRVKPALALSLHTTRADLRQQLLPRAPRIDPAELVAQGETYARLTGYPIQYQWTLLAGINDSQQEMDAIARLLKGKFGVLNLIPYNSLEADSFQRPAAERIEEMKRYLHGQGVLTKVRDSAGQDIDGGCGQLRARTAHVIDASRLSRREQAGIARA

SEQ ID NO: 6759 - protein, 311 aa, Chromobacterium substugae
MPARNAPPVVDLLAMQPGDIILSRSVSSDRKLIFAQRVLHPTRDLLRARREFCTHASVYLGHGLLVEAVRDGIALRALSLKADDFFHDAPAALSPDAAPPKLRVNYRPQADGYEYFRVVRLKQDAAALGRGIAQTALDLWGGDYASVKEFLKFLPLHPATGKISGGAKEQGEMFCSQLVCHAYHANGARLHAGNLAKSPMSLRPDHCRQLGWPHTTPVATQYPLPELAQTEVGFYLISRAALINALPMRKTLFSIHALLTPGGQPLTSERHTHASEIAGQIDALDQHWAALHLPLEQKLQRLTGMLATAGA

SEQ ID NO: 6760 - protein, 316 aa, Chromobacterium substugae
MYACLALHPAVRDKAAAGEPVRLLLGFDGFHQGIASAIAAGAAAEFPGDAQLLPLETAQPDDIADAIARCDAFIFLYRSSTLQAVGHLGPAFLQPIKKTMQDNWKKSILFKDYGPHFHEAFAEPRASIAARNHRLMALAKESRQVVFEQADGGRLTGSIGPEQAWTSIDGDGNVDLTPGEIATTIRDLDGEVRFSGAFLSTIPFAVKYGVVRDFVSIRIRASQVVDFSCDDARFAADFDKYLAANAGNRTVEEFGIGTNCGVKGLYGLNAGFEERHPGLHLGLGGGVLGSHHLDLIFANGRLSFDGTSFFDDGFLI

SEQ ID NO: 6761 - protein, 43 aa, Chromobacterium substugae
MIENIQTQDIELDAWFQEETFAEAVEMMQDKAVVPFGTALWPV

SEQ ID NO: 6762 - protein, 109 aa, Chromobacterium substugae
MFALKIGLMAATVYGAVKTADMAWGLGDIGVGLMAWLNIVAIILLRKPALACLKDYEAQQAQGLDPVFHPERLGIANAGYWSGGRAELNQAAERPGEQPAGEAAPVKAS

SEQ ID NO: 6763 - protein, 88 aa, Chromobacterium substugae
MRLYGDERADEWKAGAAFCTCSNSTKLVNLPPTEKMLAAKRTGPKPPNLAEAYKFFTGQDLLGAHNAMVDVAGCREVYFGILRHREAA

SEQ ID NO: 6764 - protein, 43 aa, Chromobacterium substugae; identical to SEQ ID NO: 5675

SEQ ID NO: 6765 - protein, 71 aa, Chromobacterium substugae
MTTKPATITATMDGDAAYQLAQFCKRVNFSTFYELTEAHLSRDERTRRAYLMVDGLTAIMTGLNEAGHSPR

SEQ ID NO: 6766 - protein, 122 aa, Chromobacterium substugae
MQHLHDIPDTGAAIAAVNEANAAGDLNLGEQPTSHINGVHVYEMNDCDWVVARSEQEAQAYYCDLNGEDDPPRALTAEELDRLDFFVDAEKPDGHSITFRERLQQLVDNNEQIPDLFATTEY

SEQ ID NO: 6767 - protein, 220 aa, Chromobacterium substugae
MQPLTQLADAARAVIAAFDRAGELTDELISALELALNGAELSPATEQSGEELAWLVVNIDDQDEQYVPASDKRRIEHFRASPGAWEMTPLYTRQQPAPAVLDGWQSGVEACAKMLEKKAEDYASEFGHSDMGALSFGSGFHADVKRDHHSTLLELAEELRALLAAAPQPAQQLPSVIEEIALQWDGCEYESSTGQIDIGWAIRAAGQRLLAAPQPREGAA

SEQ ID NO: 6768 - protein, 210 aa, Chromobacterium substugae
MQLIGLAGPKKSGKDTIADHLVANHGFVKIGFADKIREELRAAYPGLETGAFENQAFKDVNDISLALEHCENLGFIDWLRQRRVVEIYAELSESRSPRWLQQQWGDYRRATAGWDYFICDVRARIEASTAPVVVSGLRYAASAPIPTAEAGLIRQLGGWVWHINRPGYQASAEHTTEIALPRHSRDLTIDNDGDVKTLLDVVDLTVGALA

SEQ ID NO: 6769 - protein, 234 aa, Chromobacterium substugae
MNDGMIEFNPLDRVALRKLLSQTSHKSDYFVDPFSIEEIEAILKFASGNDVNMYQFWFETGLRQGELIALRWSKVDFIHGSVRIEENIVVKEEKGPKTAAGIRDITLTAKALEALQRQKAISFLAGDRVFTHHKTGKGWETEKQIRMSSWTPLLKRAGVRYRNPYQIRHTFASHHVSNGANLWWLARQLGHETIEMIIRHYGKWVPLERRNVGENWANTTTAGGGTRQQRKTAD

SEQ ID NO: 6770 - protein, 206 aa, Chromobacterium substugae
MSSFPLPDSAEPVIQYVASCELPTPWGEFVMHGFEEEGGREHVALTLGDVSDGQPVLARLHSECLTGDALFSLRCDCGFQLEAAMEAICKEGRGALLYLRQEGRGIGLINKIRAYKLQDGGADTVEANERLGFPADMRDFRIARHMLEHLGIGSVRVMTNNPRKLATLAAAGIDVAERVPLQVGRNPYNDRYLDTKAAKLGHMLSK

SEQ ID NO: 6771 - protein, 240 aa, Chromobacterium substugae
MIPASQLTDYLREQALNLDVTELQIAVITLQAVLSVDKPAPRRDLYRYRVPKLGEGGSCSLVNELDDTPYDLSFVLGGETPELTAALVNLNALVESVNAKVGAEWLGIYRKIGVGKDAILVKLAYQGVESRAEFPLTEAFAEYSNNSRVGLTGWAVVVDDVAQWRADGGGYYECDPKVKSEVCLPVLGGDDNVLGIIDAEAFEPGFFTPERQVWLAALAIVLAPQLAALPALEKPDSLPN

SEQ ID NO: 6772 - protein, 357 aa, Chromobacterium substugae
MTAIHIRHPALTIKAGAKARQILQRGLSAQQVGSLPGAAGGPKAVGLTGLDQAVFEWLAGAPRERELVGASIGGWRFACAMQPDPARALARLAERYTEEGYSPRVTTAQITAQTRAMLDDILGADGLARLLDHPHYRLSLLLVQSHGLANSEAKPALLSGLAVAAALNMVSRPLLRHSFSRVICHDPRSSLRFKPTDAIPTRLLALDAGNLRQALMGTVAIPGFLHGVQLPDAPPAIYRDGGLTDYHIDFPFADGEEIALYPHFTDRIVPGWFDKSLPWRKASRSNQANTVLIAPSREYLARLPSGKLPDRKDFHRYLRRDALRREHWKTASAESQRLGDAFREWLEKPGSIAVQPL

SEQ ID NO: 6773 - protein, 873 aa, Chromobacterium substugae
MASALLSACVGTGGGDQAAAKQPAPQANQPSARYSSHSPALPEKPDYPHGLPPAAPDNGAGQPPAKPQGQQGQAARRAAKAEAAAPAYADCDEAKLGQLSGQALVRYVASVDGTCMNRLFQADTFSYRVVSPANMQLVAAEARQRAAAWDGQNANGLWPLAVFLKAGYFLQYSHAKEVGDYGAAVDQPVMQVVEALAANPALWEVKAIDSRGDHDAWYRERDARQSVAETLILADSVRKADYALPLLTRFFNRYNAAAKDNWARFALHPMQTLLFNMHYQPEFAQKVEKGQLDGLAASLAGLTRAGQPAFADEQMFLNTLRETGRFMQYPRTAPQAEAAVALHLKGERFGAAWAEAVYALKKLGKVPCERYGICQAEQELRASLFPNRWSFDNGNLVFETPLSLAEVEPLYYAMKQVQTQLFRVAGTKQPVADDPNAKLRMVIYGTKTAYQRFQGLLNELSTDNGGIYIEKDGTFYTFQREVPRESYLTLEELVRHEYVHYLSGRFIQPGMWGTSEFYRDDRRMPWYDEGFAEFMAWSTPRDGIKVRGHVVDVVANGWPNSFLEPSRIMRSSYSDGWDFYSHSALWFYYLNQRQPGKIADILAALRVDDVKRFDALVNSMGGDAALVSGFRQYVDQQVQAAKSGQLGNTSTQEGTDWLAQDKWQAGDAAAVEAALRRSLPAVCQVWADGKDSALRRFECNGTLPLNAANNTQARQELDKLLDGALQSLVKTGGVNNLMATNCSATDYDFKRKTAVLRCEGPLGPAGSAKPQPPQTGELNLAKLSYGGPARCLRGQFEGVGGVERYQLVQAPQLGRAVVSDWGTFSYRRDLDQPGVADKITVRLSKGAQSRDVVVELNATPRDMPEEQCWAQAG

SEQ ID NO: 6774 - protein, 292 aa, Chromobacterium substugae
MNQHDKLQRFLFDGAPVRGALVRLDGAWQQVLSRRAYPQALKTILGEMMAASVLMAANLKFDGTLILQIHGTGALKLAVVECNNDRTVRATAKWEGELEGKPLAELLGSGGRFVLTLEPRLDKNQTWQGIVALEGESVGEMLENYMRRSEQLDTALVLASGDDAAAGMLLQRLPEGHGEAEGWQRIQVLGRTLKSEELLTLDAEDILHRLFHEEEVRVFEQESVSFNCNCSRERVGGMLTMLGGEEVGSVLLEQGSVEIVCDYCNQHYVFDEEDVTQLFDYDVVASARDARH

SEQ ID NO: 6775 - protein, 51 aa, Chromobacterium substugae
MMEKIAHAGDIRLKIWPDGGFSKPGAAPNPQIYHSRQLRRSSVDAAAPDRS

SEQ ID NO: 6776 - protein, 86 aa, Chromobacterium substugae
MLDSNFDLDEPLEAILQRPLTWFEKQQIQENESAPLEVIDAAEAATDAHPLRRHLKDLAKMQVIHIDRSRDGRPSLIDMPFNAEAF

SEQ ID NO: 6777 - protein, 323 aa, Chromobacterium substugae
MNLIATGKALPTQAVSAASLDLKLGYRSGRCLQKSGVHTRYFAADHETQSQLAARALRDALDNAALRASGIDLLIGACGIPEQALPGTASFISHAAGLSAGTAAFDVNTSCLSFLSALQVADSLLRAGSYRRIAVVSADLASRGLDWDNPEASLIFGDGAAAAILERGSPAQGLKAFKLATYPDGRHYCEIRAGGTQRNPRRGVAEHDFLFDMNGKAVFKLASKLMPDFIDQLMAATPGGLGSIDCVVPHQASHLGMQHMAKKLGIAADRIVDIYASHGNQVAASLPTALHEAVSSGRARNGQRVLMIGTAAGLNLGGLVWDL

SEQ ID NO: 6778 - protein, 335 aa, Chromobacterium substugae
MRILVTGATGGLGRNAVESLLARGCQVRATGRKMDIGRQLARQGAQFVALDLAAATPGELAELLRGVQAVWHCAALSSPWGPEADFVAANVTATRNLLQAAGQSQATRFVHISTPALYFDFRHHFDIPENYRPARYVNAYARTKAQAEEWVQAAARDYPRLRCAILRPRAIFGEHDQVLIPRLARILRERRGRLPLPRGGAATLDLTYVGNVVHAMWLATQGPDIASGEAFNITNQQPAALRDMLRRLFIDELGQDMRIVDLPYPLLNAASHLLQWLAAASGREPALTPYSLGAVQFDMTLDNRRARERLGYQPIYSLEDGVARTARWLREQAHG

SEQ ID NO: 6779 - protein, 267 aa, Chromobacterium substugae
MANIREFSVGHCTHPSCMALKGSGLASRCFPSRAYLIETRSRLYLWDTGYAEHFIDATRRGIYRLYPLVTPVFFNADDSLRGQLRRIGVNPDDIHALLLSHFHADHIAGLRDFPQARLLASGAGWRAVRGLTGLTALRQAFVPALLPADIDSRLECVEAQPRVALPPELAPFSHGWDVSGDGEILVVELPGHAVGHLGAFVRTEAGWTLLASDAAWAVEGYAQLRGPSELSFLIQHNRRDYYQTLGKLHALHRRGQVDIRLTHQEAN

SEQ ID NO: 6780 - protein, 429 aa, Chromobacterium substugae
MLRLFRILRAYRRTRGLRFADRAALARHQSRQLATFRARLQRRSPYFADLGELPFAQWPLMDKAAMLRHFNRMNAAGLTLEQVMRAAQQAERSRDFSPTIGRYTVGLSSGTTAQRGAFVVSRAEQAQWAGVMLAKALPDGLFARERVALFLRANSNLYTAVRSRWLTFEFFDLFQPFASQLSRLAGYRPTILLAPAQVLRALAQAQLAGQLQLAPKRVYSIAEVLETQDRAIIEKAFGQVHQIYQATEGFLASSCEHGVLHLNEEYIHVEPEWLDEERRRFVPIITDFSRHTQPIVRYRLNDVLLARAAPCPCGRATLALDGVEGRCDDMLLLPDRAGRQQTVFADVLSRALAQALPWDADYRLRQTGPRALTLHLELDDAGAGAVRQRLEQTLAGLGVDVAALEWRLEGALPPLDPTRKRRRIIREAA

SEQ ID NO: 6781 - protein, 206 aa, Chromobacterium substugae
MLALSWLPPRLRHMLLGWGAVGCAYTLGSVWPGAPRLLPEWPTDRWIAFDPAAIWLYLSFFLLVPAGFLLAPPDRLPWLRRSMQLCALAAGATFLLLPTTLPYPAVAGGGFHAELLRAALRFDTPHNCLPSLHGALTVLAAWALSERRRPWRAVLAWLWAAAILFAVIQLRRHLTLDLGAGVALGLLCGWLCARPAFLFSFRYRTT

SEQ ID NO: 6782 - protein, 363 aa, Chromobacterium substugae
MNVFALTFILMLAVVLLELLALRLWRREAIPWREIIFNLNSGHILMWVFRGVEVASFGWLLEHANLHLVDRLPALWQWVFAFIAWDLSFYCMHRAHHTWRIFWAVHVVHHQGEHFSLSLGIRNSWYSSLTSLLFVAPLAVLGLPLEMFVAASSFHYAVQLYNHNAFVGKSGWLDRVLVTPSNHRVHHATDPIYLNKNFGGTFLIWDKLFGSYQAERDDVPLRYGVRGESPGYNPLWASNPGLLALVRRRFPAWLARARMDVPAGYIASGGVLLFGVVIYYVQNVAEWSAPQQWTLFGYLLAGTLAIGGMSDRQRWGWRGWQALVLTLPVLCAGWLGMRDLCALALFALLLGHGLLGWRLKEAA

SEQ ID NO: 6783 - protein, 359 aa, Chromobacterium substugae
MSKLRFQSSAELPFRIELQQAAQAYLEQSRDHRFASAGIWLKAWLLAGLSLACYLLALRADALWQFAPAYVAAILLAMLLAMNSLHDAAHGAVFRRPWLNRLLSRVASLPMGIDSDIWIRRHVHLHHTYPNVDGYDLDIEPNPFLRQTPFQDWAPQFRHQHRYWPLIAALSLPYLCWYGDWLDLMGKSKLQLRDAKPVRAPGFLLAKAGHLALALGLPIWLLHDGGIGWGSVLLCYLLGQMAASCFLVAMILGTHWADVAFFQPGADGKLPHTWHEHQFLTCCDWEPRPRALAHLLGGLHLHLTHHLFPSYSHRHYPALARITRQVAQKHGLDYRCLDYPELWQAQQRFLKSMGSRPQP

SEQ ID NO: 6784 - protein, 183 aa, Chromobacterium substugae
MSLTTDFLENPQAFMRSQAILIPAQVPPGNGKYQFAAQGAHAAVLQSTAASPNIPGFYAHPVANNINLFVLPTQQPARYYMFTDGMNGCQFLAYGPDRQHITVEHNNFIGDPTRYAARLAEVVALKPAYLLHISPSGVNNIPAGQYNSQQGVNIVGEYGQANGWRFWVRDRVDQNQGTVYGPL

SEQ ID NO: 6785 - protein, 441 aa, Chromobacterium substugae
MSTLFWRYAIPSVAGMVVTGLYAIVDGVFVGHYVGSHGLAAINLAYPLVMLQVGLGAMVSMGAATRIAIRQGAGDVAGARGTLLAALALLALLGAAIPLAGLPNVGKLLEWLQADGQPEVAAQARAYLWWMLAGAALTMGQMLVTYLVRNDGRPGLATALTILGALLNIPLNFLLVGGLGLGLAGSAIGTLLAESVVVALGLGYFFTRHAAVRLRVGNMRLDKAALWPILALGAPSLLMELNLALLLYAHNHQLLRWGDDLSVAAYAVAGYTEALFTLAIHGLAVGMQPLLGHATGAGQPGRAREALLHGVRGGLALGLAALAAVQLFPAWIAGWYSDGSQDLVAAGSHALRLHLLAMPLDGLVVVGCTALQAMALTRLALGITISKTLLLLPTLGLMPLWLGVDGVWLAMPLVNLLLGLLVGGVLLAQSRRLLGAQAAAR

SEQ ID NO: 6786 - protein, 205 aa, Chromobacterium substugae
MARKTKEDSQKTRDAILDGAEQAFLAKGIANATMADIAEAAGVSRGAVYGHYDNKLLVCQAMIDRAFALDALDFPSQRESACDTLLAASLYYLAQFLEPGSPQRVFEILYLKCERSEENRSVLRRREMMDRLTLHYTRRQLRRAIAGRELPATLDVGLAADYLVYLFLGLYDLLETGPAALPRCERILRGALEALPHAASLQRQP

SEQ ID NO: 6787 - protein, 360 aa, Chromobacterium substugae
MLWLIIKELQAVAGSRQGRLLLVVPVLLQLLVFPFAATLEVKHASLAVYNQDGGAASLELIKRLSASATFDRVVPVASQAGLRAAIDRQDALLAVVFPADFSRDLAAGRAAPLQVIVDGRRSNSGQIAGAYVGQVAADYAQERAGGAAGGVVVRNLYNPNLEFQWHVLPSLVAIITTIGCLIVTALSVAREREEGTFDQLLVSPLTPAYIMAGKALPGVLVALLQGSLIAAAAAWAYRVPFGGSLPLLLASMASYGLALAGVGLFISSISHTQQQAFLGVFSFMVPAVILSGYVSPIENMPLALQWLARLNPLSYFIPILKGTFLKGYGFADAWPWLLPLWLIALATLALALWRFRRHVE

SEQ ID NO: 6788 - protein, 371 aa, Chromobacterium substugae
MRGLKLRRLLALCRKESFQIVRDPSSILIAFILPVALLFILGYAVNLDSAHIRLGLLNQDGGAAAARLAAAFYGSPSFEVHPMVSRAQLEEQLAHGEIRGAVVIPDDFSRRGAGAAIQLLADGAEPNTANFVAAYAQGVWLQWRQSEAEQRELPPPAAIDIRQRVWFNPSAESPNFLVPGTIAIVMTIVGALLSSLVVAREWERGTMEALLATPVSRAELILSKILPYYALGIAAMLLCLLVAVFVMGVPFRGPLWLLWLMSSLFLANALGMGLFLSTTLKSQFDAAQAALTAGYLPALMLSGFVFEISSMPAPLQWLTRILPARYFASTLQTLFQAGVIPSLLWFNAASLILLGAFWLGQTVRKTRRTLD

SEQ ID NO: 6789 - protein, 577 aa, Chromobacterium substugae
MSAVPAILTQGLAKRFPGAERDALADVELSIPAGCVAGLVGPDGAGKTTLLRILAGLLAPSLGAARVAGLDPQADGERLRREVGYMPQKFGLYEDLTVRENLDLYSDLRDVTGAEREKDFERLLALTDLAPFTGRHAGKLSGGMKQKLGLACSLLGRPRVLLLDEPGVGVDPISRRELWKLIRALSADGITVLLSTAYLDEAEGCDAVYLMDQGRIRAAGPPAELTRPLAGRCLKLSGIAGNRRRLLQRLLRQPQLMDGAIQGGSLRLLLRHEGEWPDLAQAEAGPDARLEPAPPRLEDAFISLLGGGPGGDSVLAEVMPAVPARGAEAVIEARALTKRFGDFRATDNVSFAVRRGEVFGLLGPNGAGKSTTFKMECGLLKPSAGQALVMGMDLKTSPSAARQQLGYMAQKFSLYAQLSVRRNLMFFSGVYGLAGQAQRAKVAQMARVFGLEPYLDGPAATLPLGFKQRLALACAVMHEPPLLFLDEPTSGVDPVTRREFWTHINGLADKGVTVLVTTHFMDEAEYCDRIALIYRGKLLALDTPDALKSGVASAARPNPTMEDAFIQLVEEADRCAD

SEQ ID NO: 6790 - protein, 326 aa, Chromobacterium substugae
MRKIGVAFAALALAASGTGYYAYQRSAGAERNATLYGNVDIRELSLAFRVSGRLAAVQVDEGDSVQPGQILARLDAEPLRNSLNAALANEAALAARNALIHKGNRGEDIAQAKARLEAAAAALTQAQSEYRRQRDLVPAGGSSQQSLEAARSQRDQALAQRDAAAQQWQALARGYRPEEIAESDAQLKQARADLAAARLALRDANLQAPSAGIILTRAVEAGSMVQAGAPAFSLSLRQPVWVRAYVGEAQLGRFPSGGKVLLSTDSHPDKTYHGVVGFVSPTAEFTPKSVETADLRTSLVYRIRIVVSDADAGLNQGMPVTVRLAP

SEQ ID NO: 6791 - protein, 165 aa, Chromobacterium substugae
MVATHVAFGAFCAVSTALLLHFPPLMALLLLAGGLAGSLLPDIDHPKSWLGRRIPFLSRPVAYLFGHRGITHSLLAVAGVFYACAACLHGWHVKLGHAMPVVLGICVGYASHLAGDWLTPAGIPLLWPIRVRFRAPLMLLRGKMAEPLMVVGLWFGAGFLMCKTL

SEQ ID NO: 6792 - protein, 269 aa, Chromobacterium substugae
MLSDWPPNFIVREGKPTIGQNDVYLRLIIERWPQVQHRFVVMSTARSILELQNKTRLCRPNLIPTPERQRFAYFTLTHMQLPLQLIIRRDLAAKAPLNAKGEVELARLIRQPGLRGIVAAGRSYTAAIDSVLAAAKTGSNIRALQNLPANEGLFKLLALGRADYTLDYEPNLEYHNRHNRDQTLAGLPIAGAALIPVGIACPRTEWGLQAIRKIDALLAQAVADPAYRAAQASWASPASLQRYKAGLDRFYQQRSHPAPAAEFAPPLRP

SEQ ID NO: 6793 - protein, 544 aa, Chromobacterium substugae
MAKTISLKRRLLLQTASTIVLVCVLGALLMNALRQQMLSDRHDQVRGQVEAAASLVAAHEEMAEKGLVPEADAKRQALLELSKLRFDGREYFFTLDRNMVWLAHGMNPKLVGRDMHGVKDAAGTSMGQLFDGVLRENGGKGFAEYYWDKPGTSAPQPKLAYFQTTARWGWVVGTGLYLDDINTVLLRQLLGVGAQVLLFMAVSLSLGWWVYRSVMRELGAEPSEAAAIVREIAAGKLDREIRLEAGDGDSLLAHIREMQAQLRQLVGEIMRDAEELGRLNADVVDGAKMVADNSQGQSEGAAAMAASVEQLTVSINHIAQHAKDARSVSQDSGQLSETGSEVIARAVEEMQGISATVDMTEAAIADLASKTATISNIMQVIKDIADQTNLLALNAAIEAARAGESGRGFAVVADEVRKLSERTAKATEQTATMITEIQVSSDLSRQNMSETVTKVRTGLELAEQGGQLIQQIHGSASQVVRVVNDISHALQEQGTASQDIARHVEQIAQVASGNAVAATQASESIQRIDEVTGSLRQSVAQFQV

SEQ ID NO: 6794 - protein, 194 aa, Chromobacterium substugae
MRFFRHDSGRHCGGRRHAHHAGDSEHLSRGRKFSSDDLQLLLLALIAERPSHGYELIKALASRSNGYYSPSPGMVYPALTYLEEIGHVTVASSGNRKCYSIAEPGRLHLAVNREHVERMLAKLEHIGRKMELARRAYAGEEIGEEGAAGWVRELIEARRALKHALLLRDKADADEQRRIADILQRATAEIIGQN

SEQ ID NO: 6795 - protein, 264 aa, Chromobacterium substugae
MRHDLTIQKLRHPLQFRLLRVSRIERLAGRLLRVTLSGADLEGFASSSFDDHVKLFFPAPGEIRPVSPSVGEGGIVFPADQAKPAMRDYTPRRYAADAGELDIDFVLHEGGVASDWAAQAQVGHYLGVGGPRGSRVVPTGFDWHWLIGDETALPAISRRLEELPADSRGAAVILVDNADARLPLGGPAGMEIIWRQRDRRQDLLQTVTEMPLPGGDGYVWAAGESGEMRAVHKHLQLRGVDKDRMRVAGYWKRGDAGAHETIGE

SEQ ID NO: 6796 - protein, 38 aa, Chromobacterium substugae
MPQYFLSDDMNKYFYWGMALESLARRAFMQVFVLDCGF

SEQ ID NO: 6797 - protein, 188 aa, Chromobacterium substugae
MLVSHAGLNQMLHAGMFFSIPGPALLSPFVGLVGIRQDYHGAPLYGGPIERLGRLKYIDGCSDSLLISPMIKGDPCLNYLYVPPHLHQTAHTHPSVRIGIIIEGEGYCLTEHERLELVAGKIFVLPADEIHSFHTEHSPLRIVIYHPDSDFGPTHEEHPMINRTLVDGVSLAGDNPYRTSKIAEYVAN

SEQ ID NO: 6798 - protein, 504 aa, Chromobacterium substugae
MPPLPAWLADPRPAAPRLPWPPRPDRRDPGLSQGEFARLLKHAGVCDLGAVPVPGACVLLPWGVALSERLAGLLRAALDDLGLDEYAYPHVVPQECFEPMADLLDAERCLLQVATGHDRERNRLRGVLTPTGEQVIASHWRQLVTQAEALPIRMFQRARYFRPVSSADRSGKGVFAALEAADVFEFHCCHAAMEEAQGDLQRLHLGLERLAESLCLPQFVGVRPPWGNREALYEWALGGDTPLPSGECVQTSALYFQGQRLSSRYDIGLGKGERRRHAWQLDGFASRRMLYAQLCLSAKADGSLTVHPQLAATQVAILARSQDEDERRFLETLREQLKACGLRPALERCADARTLTSRMRQWRHRGAPLLLLYFGRRHAQDQPRLRLYRTDADLELEAAADCAAEALAQQLADALADVEADAGADVLRRARSQIAFAGSEAEAKQALAARKSVIAPVSPTRRHAEAAAAWQMGELCSFAAADEPAPCIFSGRPTWARALLSRRI

SEQ ID NO: 6799 - protein, 358 aa, Chromobacterium substugae
MTSSHADQLEMIVGPVRLPLKIDDSVNYFQLHYFEFQGKRWACAALGDLAAQEAVPLRIESACFFGHVMHSQQCDCGFQLDEAFRRISQRQGGLVIYGIDQDARGLGIEKHFRIYDYRQNHQLDTDEVYQRFHAPLDSRSYEAVAAILRFLKVESILLMSNNRARLEFLREQGFRVERDQIEAPLTRYNMATMMLEKEDLAYQWSFQTHGDWLRPLQDQAEAHPDRRAARIVRDNQQVVAEWQGDSWDVARHLLAGLAQQPAGELVIYLSDLPRLDELAAYAATGARFVVVPFATLPGYLETEARQLGIKLQDWGRENKYAQPRPQWQLEDQTGDSHVYRRGDERRTCRRDGAADAVA

SEQ ID NO: 6800 - protein, 230 aa, Chromobacterium substugae
MPHLALSTSRQAALAAMQDDASDCLMVDSFNGAPANMRGFRCFNPFQLWPDPVIPVPGQAGRLARSVESVWQGLKLVDGRTDFEQFLAEPRKRPSDDERRRQPGYCYSDSRFIYGDRQLGLLEARFLIYLPTYLFLLDRLAPEPVLRELRRHIAADGPVLFYDWDANQDIADTSSSFSHSAILAAWFNGTLERRYRELAGRLLSPADKPAFDAALDGLLGRYRAIHREKP

SEQ ID NO: 6801 - protein, 460 aa, Chromobacterium substugae
MTLNPALARRLYWGCEKLQGRQDVAQRLRWLEETQHLSPQACRELQMRKLHALLSHAYESVPYYTRVFRERGLVPDDFNSLADLAKLPLLTRQELTANQAELISSRADRATLQTNYSSGSTGKRACFVQDADFRLWMRAHQLRTYQWCAGWKVGEPFALLWGSSIYWSLKSVSDQLKNLLSNRREFNTFRLSPELIGQFTRSLASFNPVLISTYTNAMHLIARQMEREAVKVPALRAIQGTSEPLPPIIRERLQKVFGCEVYDKYGSRETNIVAHESPCHDGMLIQVENVAEEFLRDDGAACQPGETGRVVLTTLNNFAMPLIRYETSDLAAPLSGHCASGLGLPRMSHVAGRQQDLIVTPDGAYVDAYLFSFLIMRFEEIEWFQVVQDSLDSLRIRLMAPAGISRQRCDAIVERIHHHTGYPFRIEFEPFDRMPESPTGKFRLCVSALSDIGTRHPVNP

SEQ ID NO: 6802 - protein, 355 aa, Chromobacterium substugae
MNADIAVDEMRELAAQALQRCGAPSARARQVIDDLLENEQVGYPSHGMLRLLDYAADIRSGALDPAALPAIEQTAANIAIVDGRRAFGILARQSIAEALQRMCREQPLAMVCLRHGHHLGRLAALGRELAGAARQPLAVMGFCNFQGRGQRVAAPGGRLGRLCTNPLLLAFPSADADPVVLDMSTTAVSEGYVRRRAQEGAALPSGCLVGADGEPALDPALLYAQPPQATMQPLGGALAGHKGYGLAVFIELLAGALAGAGHVARPEDAGNGGLFLAINPALAPSGLAAVKAEAAAIARHCRETGQAGRLARMPGEGYAERRRAAAARAILTLPAATLDAIRHLAGQHQENPHVE

SEQ ID NO: 6803 - protein, 267 aa, Chromobacterium substugae
MSNDAPFHPLLNAGNPIKDKLAAGRTCFGLFLVSASALIAECCATRGPDWLLVDMEASPADRRDLIQMLQALNGSHTAGMVRVARNERHLIEAALDSGAQGLMVPKVDSAADARAVANCAYYPPRGRRGVNPIRCSAYFSRLPDYFAEANQSLLTIVQIESAQAVAEADDIAAVDGIDVLFIGCGDLACDLGQAGQVTGALMDAAIEQVLEACHRHGKIAGIFAYSLELAQRYARQGFRFIAFGNDMKLLAQSLEQQMRSLEEFASP

SEQ ID NO: 6804 - protein, 159 aa, Chromobacterium substugae
MVAHNETSAGVEPRPASGREQEALALMRSYMPWAAGAGLVPVPLLDMAVIAGVQLKFLARLSALYDVPFSENQAKSIIAALLGSVVPASIATTVFSLLKGIPLLGFAASFLTLPALGAASTYALGKVFIQHFESGGTFLNLDPQKVRSYYQEQFEQAQK

SEQ ID NO: 6805 - protein, 180 aa, Chromobacterium substugae
MKPCPPRRPRRGLLTLAFCAAAASHPAARADFPYAKDQTSPVQTATQNLPTQRGSIDIAISQAHVYGLDTPGSHSYCSPSIKIINHASDTLRTLILGIEYHKNGSRESSGSSVVNLTSPLEPDNYSTTYFNPLNVASCKDLQGAVTVLSCQYAFNGDCGADVRAIGFGAIPLQRAAGKKP

SEQ ID NO: 6806 - protein, 53 aa, Chromobacterium substugae
MIIYSYLGLCLVVAYMGRHTRLGFLRTMLFSIFMTPVLMMIYLLIAYATDERR

SEQ ID NO: 6807 - protein, 542 aa, Chromobacterium substugae
MLLSKFLFQNSKLPMKRLGVMAALASASNASLLAVINHAAEHIKDVDMQFFHVLIYGLVLTLYIYSQRYVLLATCDEVEDIVHQIRCRMVKTLQSCELAMLEHSGHGRIYSAICNDTQTLSQAACTIVLGFQSIILIVFASLYIAWLSLMSLLLIIAVMAIATLIYWAKMKSVHAMLYQANEQESRLHDQIGSLLSGFKEVKLSSRRAEALIDDVETTSEITAQLRKVAQRGISINFMFAQIALFLVLGSMVFVLPVFSPAYTDTVMKTLTAVLFLVGPISGIIAAIPQIATATAAVENLQELERALASHAQAAQTAADEAAAFRSLELKNIHFRHERSDGQGFAIGPINLSIQAGEIIFITGGNGSGKSTLIKLLTALYPPSGGSLLLNGRAVAAERAQAYRNHICAVFSDFHLFDKLYGLEDWNRDEAERLLEEMEIADKAEMGEYGFNTIDLSTGQRKRLALIAAMLEHKPLCVLDEWAADQDPHFRRKFYETLVPSLRERGLTLIAVTHDDRYFHLADRRLHMEDGRLYELGEESHHA

SEQ ID NO: 6808 - protein, 313 aa, Chromobacterium substugae
MPDAAASAVPRPPLRRFEAWLRELTIPLTVAFAIFIFLLPLMIYTIRPGQLGVQWKRFQGGTQLDHIYGEGTHIILPWDHIYIYDARLQRVEREFDVLSSDGLTMKVSMAWRFRVNPSNLPYLHRYAGENYAETLIAPSVGARTRDVIAYYRPEQVYTQSRLTIQQQILSSVRYDLINNFNPDGRKGLKWVEIEDVLIKGVTLPRGVQDAIIKKNAAYQEMQTYNFLLSKEEKEAERKRIEATGIRHFQEIVSNGMSDSYLRWRGIEATVQLAKSDNAKVVVIGAGANGLPLIMNMDDKKAEASKPKARPRKP

SEQ ID NO: 6809 - protein, 138 aa, Chromobacterium substugae
MTNRLSGWLALLALACCAPAQAADAPAPKLVIESPVDGQAVGNALIVRFHAEQIRLAPRYAPAGEPVPAALRGVGHLHVYLDGAAWHWVHATPDPLVLVGLPPGPHQIHLELAAPNHQPLDARQVSFSVSAGDSRRAH

SEQ ID NO: 6810 - protein, 57 aa, Chromobacterium substugae
MRAGKANGSCGFRFFLRAREALALWVWPTIMTMAFRRAARLRAHDDGGGSPSDEEWG

SEQ ID NO: 6811 - protein, 1319 aa, Chromobacterium substugae
MSYITKLRGGVALSPFRLEKLQAAAADAGLKDLVLMAEYWHFAESDSELTLEEVGVLGQLLSYGEPPLSAEPEGELFLVTPRIGTLSPWASKATDIARHCGLPRIRRIERGTAFRIKSADKSLSKEARHILAGLLHDRMTETVLASFDEVEKLFVHIDPQPMDRVDVLAGGREALAAANAKLGLALSEDEVDYLVENFVKLGRNPSDVELMMFAQANSEHCRHKIFNAQFVIDGVEQGKSLFRMIRDTHDAHPQGTLVAYKDNASVIEGAFIERFYPQPGSHRYGYNSEPTDILMKVETHNHPTAISPFAGASTGNGGEIRDEGATGRGSRPKAGLTGFSVSNLNIPGFKQPWEQYRDGQAEYGKPGRIASALQIMLEGPIGGAAFNNEFGRPNLTGYFRTFEEEVHGEMRGYHKPIMLAGGLGNIQQQQIHKNEIPEGALLIQLGGPGLLIGLGGGAASSMDTGANSENLDFDSVQRGNPEIERRCQEVIDRCWQLGEANPIVSIHDVGAGGLSNAFPELVNDAGRGAVFHLRKVHLEEKGMTPMQIWSNEAQERYVMAVLPQDLERFSALCERERCPFAVLGTATDDGHLQVRDDHFDNNPVDMPLEVLLGKPPRMTRDVKTVEPDYQVFDASKYPLRETAYRVLRHPTVADKSFLITIGDRSVGGMTARDQMVGRWQVPVADVAVTTMGFNTYRGEAMAMGERTPAALFSAPASGRMAIGEALTNIAAAFVGHLGNVKLSANWMAPAGHPGEDVRLYRTVEAVSELSQSLGVSIPVGKDSLSMKTVWQDGGEQKAVTAPMSVVISAFSPVEDVRKTVTPVLQDVKDSDLILIDLGYGRCRLGGSIYGQVWKDMKGRSPDVESPQQLAAFFNTVQSLLRDDKLLAYHDRSDGGLFATLAEMMFASHVGISVDLQELVIERQNTQRIIDDYVQPSLEAATHGRIMRVLFNEELGAVLQVRKGDTPEVISRFMKAGIGRELFVLGRVNGYDRLVIKHKGKDLFSESRSELFCAWSETSARMQRLRDNPACADSEQLLRSHAKPRGLFAQLSFDVHGDPSAPFIAAGARPRMAVLREQGVNGQLEMAAAFDRAGFEAVDVHMSDIIAGRVSLADFKGLAACGGFSYGDVLGAGEGWAKSILFNPRAREQFEAFFGREDTFALGVCNGCQMMSNLSSIIPGAEYWPKFRRNASEQFEARFAMVEVTASPSIFLADMVGSRLPVVVSHGEGRAVFAPGSQEQALTALRYIDFDGRATETYPLNPNGSPAGITGVTTPDGRFTIMMPHPERVFRTVQNSWHPADWGENGAWFRMFASARRWVG

SEQ ID NO: 6812 - protein, 112 aa, Chromobacterium substugae
MKKVEAVIKPFKLDEVREALSEIGINGLTVSEVKGFGRQKGHTELYRGAEYVVDFLPKVKIEVILPDDLVERAIETIVATARTGKIGDGKIFVTAVEQVVRIRTGETNEQAI

SEQ ID NO: 6813 - protein, 263 aa, Chromobacterium substugae
MKRYVVAAMLVMGLAGCATTETYDETRGWTVEKLYSEAHDELNSGNYTRAVKLYETLESRFPYGRYAQQAQMDLAYTHYKDGEPEQAIAAADRFIKLHPTHPNLDYIYYLKGLVYFNDDSGLLAKWAGQDMSERDPRAAREAFAAFRELTTRFPNSTYTADASAKMIKLVDALGGNEMHVARYYMKRGAYLAAANRAQGVVKDYANTKYPEEALAIMVAAYDKLQLPQLRDDARRVLALNYPKSQYLAKPWTVEEMPWWKLWK

SEQ ID NO: 6814 - protein, 365 aa, Chromobacterium substugae
MTDPYIDPDDYSDISENEISATQHLEIPLSLGGERLDAALAKLLPDFSRSRLTQWIKDGQVKVDGQVVAPKTKMLGGEKLEVSLQPTHEEMAFQPEAMDLPIVFEDDHILVINKPAGLVVHPASGNWSGTLLNGLLHHCPSLAGVPRAGIVHRLDKDTSGLMVVAKTVPAQTDLVRQMQARSVKRVYRAIADGVVPFDGTIDANIGRDPHNRLKMAVLKFGGKPAITHLRVLERFASHSYVECKLETGRTHQIRVHMREAGHPLSGDPVYGNLRHKMDEDTAAAVKALGRQALHAYALALVHPASGELRSWKAPLPDDFRRLLDLLRGDGALPDEEAFAHADEQDDEDWDDDDDDDGDIEVIYAR

SEQ ID NO: 6815 - protein, 245 aa, Chromobacterium substugae
MPAETWLAADWPAPARVRTLATTRQGGVSQPPYASLNLGAHVGDAPDAVAANRARLRDELPAEPAWLNQVHGVAVADAAALRGAAPDADASFARAPGVVCAVMTADCLPVLLCDDAGRAVAAAHAGWRGLCDGVIEATVAAMALPPAGLMAWLGPAIGPDAFEVGAEVRQAFLARDPAAASAFIDIGEGKYLADIYALARQRLQAAGVERVYGGDFCTVIDRERFFSYRRDRVTGRMASLIWLQD

SEQ ID NO: 6816 - protein, 222 aa, Chromobacterium substugae
MTRARHANIMLFSPQPLAAMDIAIVTLDSFNELDSLIAAGILGRMSPHGWNVRICSPIPVVQSRSGTRLERQADLSYAGSADAVLIGSGWRTRDWAADDAIMSQLRLDPARQLIGSQCSGALVLHRLGLLADGVACTDGLTRPMLEQLGITVAPRAFRAVGNIATAGGCMASQYLAGWVLLRLAGEARAREVLSYVAPVGEEAGFVDRAMSAIAAASEPVPE

SEQ ID NO: 6817 - protein, 290 aa, Chromobacterium substugae
MKTIPLARLSPADLHPCFLEAFSDYLVPAQPSLESFSAMLRRRGWVPELSAGAWIDGRLAGFWLCATPPIDDGMEGYCIAAGVVPAARRQGALSAMAARVARLLARRGIHQQRLEVIDGNQHAQLAYAQLGFQPLRQLDCYLLQVPIDSRRHWPVTVHHGYTPARWPSADWLAYPPAVPNRRDSLRRATPAPRWLTVDAGGAALGSLLLSADGEALELMVDPAHRRRGIASQLLRAGQLLTPGGRLAFNNVDRRDLALLSLLLRHQAAYRLSQWEMLKPAAAEAGIRSAR

SEQ ID NO: 6818 - protein, 217 aa, Chromobacterium substugae
MTPQQQTDWQNRLITLLEQQPPDDDGAHDLSHLHRVWAVARQLLAHHPEADARVVMAGCYLHDLVNLPKNHPQRQLASHWSAERARQLLADDALSAEQLDNLAHAIEAHSYSAAIPPRTLEAKIVQDADRMDALGPVGLARMFYVSGRMGRALAHPLDPLAEQRGTDDQAWALDHIAVKLAKLPAMMQTEAGRGIAERKLQWLLAFRDEFCQDWMAR

SEQ ID NO: 6819 - protein, 239 aa, Chromobacterium substugae
MIRKLPRNTAGRDWVVGDLHGCFSQLGRLLKIIAFNPACDRLLSVGDMVDRGPESRMAVEWLTQPWFHAVRGNHEQMALDAMRNPLEDLERHLRNGGRWLTELSHSERDACLAAFAGLPLALEIDVEGGKMGVVHADCPDNDWPSLRARLEADNPRDQDYEALLWSRERVRNGGGGAVHGLDLLLVGHTPQENAILYDNVMHLDTGAVYGGKLTLFCVSDFVEVSLPASFEHMAQFQLH

SEQ ID NO: 6820 - protein, 135 aa, Chromobacterium substugae
MAEHKKKSAAPKAGQLDRRVQEQRHGQAEDACRRLVALLEALAADGRLDGNQQASQYLNSTRAYYRRIRNGKVMGAADFTAAADVCACARRALAALDPELVFAGLPQADELLQALRLGEQVETEMRRIKAAGKAG

SEQ ID NO: 6821 - protein, 132 aa, Chromobacterium substugae
MYNRIPHLRVARPVSNLAASKAMYCEGLGLQLLGSFAGHDGFDGVLLGLPDAGYHLEFIVSHRHPVSPAPGVEDLLVLYLPDKAEWEALCACMRAAGFRAVPSANPYWDARGVTFADHDGYRTVLQNAKSPV

SEQ ID NO: 6822 - protein, 249 aa, Chromobacterium substugae
MLARLLFLLPAMLCALGARADELTMCYDKYPPYALGEFDTVAGGGIKVRLLQEIGRQLGLAVTVKIMPWKRCLTEAKEGRVDGILPLYKTPEREQYMEFSAPVMRQYNCFLYKKSAFRGAVDWRDYDRLKTHRLGMEIGSVVDKDMEAAFMTAHPIERARDSVTLIKMIESGRIDLATIDSNVGKYLVNQQGVADAIGVSDVPIGELSYAAFGFSRAAGADHWAPEFNRVIEQMRASGLLEKIVSSEVK

SEQ ID NO: 6823 - protein, 595 aa, Chromobacterium substugae
MRISHSGPAPANRNDLQTIKTLLPYLWSFKGRVMLALGCMVLAKVAAVTVPLYLKDIVDQLSLPATLLAVPVLALTGYGVARLLSGVLGELRDAVFARVIQGAVRSVARNVFRHLFRLSLRFHLERHTGGMSRDIERGTKGIGFLLNFTVFNILPTLLEIGMVTAILFHRYAWEFAAVTLGTIGLYIAFTLLVTEWRTVYRRTMNDLDSKANSKAIDALLNYETVKYFNNEEYESKRYDRNLEAWEASAIKNQVSLSLLNAGQAAIIAIGVTLVMVLAARDVVAHRMTVGDVVLVATFITQLYAPLNFLGFVYREIKHSLADIERMFKLLDVNLEVADAPGAKTLDTRSAAIRFERVGFAYESKRQILHDVDFAIPAGQTLAVVGASGAGKSTLSRILFRFYDVNAGAVRINGADIRELSQDSLRAHIGIVPQDTVLFNDTIYYNIAYGKAGASREEVIEAARSAHIHDFVASLPDGYDTLVGERGLKLSGGEKQRVAIARTILKNPPILIFDEATSALDSRTEKAIQHELAEIAANRTTLIIAHRLSTVVDADRILVLDAGRVVEQGSHRELLALGGRYAEMWQLQQESEAVEG

SEQ ID NO: 6824 - protein, 126 aa, Chromobacterium substugae
MADKTYLMEVMAEPHYIDEQSNVANDIYVFGYRIRIVNTGSEPAQLVSRHWIITDANQQVQEVRGMGVVGEQPHLDPGQAFEYSSATHLKTPYGSMKGSYQLVADDGQRFEAEIPEMTLVAPRVLH

SEQ ID NO: 6825 - protein, 227 aa, Chromobacterium substugae
MRTFRIAPSILSADFARLGQEVSDVVAAGADIIHFDVMDNHYVPNLTMGPMFCEAIRPHTQAPIDVHLMVKPVDALAAAFAKAGADIITFHPEGSEHVDRTLGLIKEAGCKAGLVLNPATPLSCLDHVMDKLDMILIMSVNPGFGGQSFIPHALEKIRLARQRIDEYTAKRGGEIWLEVDGGVKVDNIAQVAAAGADTFVAGSAIYGQKDYKAVIDAMRAELARVQG

SEQ ID NO: 6826 - protein, 250 aa, Chromobacterium substugae
MHAFIVTGASRGLGYAICETLLNDGYFVVGVARHAGPALEGLAARHPERLLAVNADLADAAQASASIHSALQQLPLSECATVTLINNAGVVTPIAQAGRYPADEVVKAVAINVTAPLLASDALLSATDHLPARRRILNISSGAAAKAYPGWSVYCATKAALDHFSRSVAVEQEGKANPAQIVALYPGVVDTDMQGDIRASDEGQFPQKARFDAYKADGALSSPGDAARKIVDYLVSPAFGQAPVVDIREL

SEQ ID NO: 6827 - protein, 227 aa, Chromobacterium substugae
MNLKHIKAVAFDLDGTLIDSIPDLANAANAMRAHLGLPPLDPERIKSHVGDGIASLVHRAITDERHAEADGPLWERGYRFFIQHYREHLADQTTVYAGVRDGLSLLRALKLPLLVITNKSERLAVPLLEQLELRDHFSLVLGGDTLPEKKPSALPLQHACQVLGISAKEMAMVGDSANDVAAARAAGCAAIAVGYGYGDAASLGADLTVASIAELYDLMKNDGSISL

SEQ ID NO: 6828 - protein, 488 aa, Chromobacterium substugae
MQPQTFQQLAAEGYNRIPVTQELLADLDSPLSIYLKLANQPYSYLLESVVGGERRGRYSIIGLPADTRLRVNGQRVQVECGDKVIERHDGDPLAFIEAFQRRFRIPELPGLPRYSGGLVGYFGYDTIRYIERRLADVQKPDPVGTPDILLMLSEEIAVVDNLSGKLHLVVYADPEVPNALPKAQARLAQLRAKLREPLAIPLSLPTGPAAEAVSEYGEQAFMDAVAASQRYIHDGDIMQVVLAQRMQQPYQGSPIALYRALRNLNPSPYMFFYHFDDFHVVGASPEILVRREGETVTVRPIAGTRPRGQSREQDEALAAELLADPKEIAEHVMLMDLGRNDVGRVADIGTVKITDNMAIERYSHVMHIVSNVEGQVDRKISNIDVIKATFPAGTLSGAPKVRAMQIIDEFEPTKRGVYGGAVGYLGFNGDMDLAIAIRTAVLKNGMLYVQSGAGVVADSVPQSEWLETQNKARAVLRAAQMVADGLDA

SEQ ID NO: 6829 - protein, 559 aa, Chromobacterium substugae
MNEMLRPLLLTAMVAGLTACGGGGGGGGSPSANDGGGAVAHGAAPEAKSGAEAGELVCSGNRCRLADGANQAVGSMYRFYNDSHLERELVVSGLSPAIWHAVSTKVSGAGVAAGELSLRQEEKDAGPREPDYQAEHAELSAIYAQKAPAQRLKLGQGARREAPVAYAPGEEKTWFDSIHENDVATTLRTKRALPGGASVHVWTENGAGVSARQADFLAERFAGSVYPLEVSLLGQPWGVVGNPVFAGFTIPADTRDVHIVVTPLRAQGNAAGLMGYVWSGNALRNLCTEDAKPCQKYQRSNAALAVFLSSEVLARSAAGEEWHERSQGAGEALSTLAHEFSHLFYSYNKRYKPAVPVKVETWEDEMFAQSIAYLVLADTFGGGRGAGRDAHPDLRPRADFERALDFVPCDFSRWNGASSCYPKALALGALMVHQYGHQLFRPWLESQNPGAQAVSEGLRAAGGAGYADMLERYAGTMLSAGAANVAGRYGYPAKRVVLPGSPLLPQGREIQLPGIALSADKPLIPMDGQYDTSKQFSYIGNGIWTLRVPANSWITLTKR

SEQ ID NO: 6830 - protein, 548 aa, Chromobacterium substugae
MLLHDMRTRHKLALLLAIPLLAIAAVAGEGLVTMAELKDHVAKVYVSSAAPLFEVSKVSSLVPRTRIDVMQAMMDAMAGGAGYRTPTQRADRLYGKIGEMREAIAKLQQGHISAELKPQVDAIAALYQDMAANSLEPFVNAIRANRIEDAKAIYPKFVKQYEGLRDQVGALMPRQLAIAETAYQDANRTYQSQSRLIYGVLAVSVLLSLAIGFALAKLISEELDKLRATMLEAADHLRLSLRARVGGRDEFGEVADAFNRLMSAFESALQRIRAVGEQVSERSHAVADAARAIARGTMEQNQAAQHTTTAVEDVSASVQRVAQTASDSTALSLSVQTLSEQGGQVLTENASNANTLHGAIHKTAELTQSLAQRSQQINNIVSVIHDIAEQTNLLALNAAIEAARAGEQGRGFAVVADEVRKLAERTTSATGEIGAMLGGIQSDVASVVKDTQMCSELIEESRRSSERAMEALQQIRGGAETSARQIAEIASATVEQGAATADIVQRIEHIAAMAGENDSSVQAASAAADSLAALVSQLEAEIDRFRAR

SEQ ID NO: 6831 - protein, 218 aa, Chromobacterium substugae
MASSRRQYIHALRFSALTALYDPLVALTAREKHFKNALLDAAQLRPGHRVLDVGCGTGTLAIAASLRAPGLLVQGLDGDGRILRLATDKAERAGARLAFRQGMSFSMPYLDNAFDRVLSSLFFHHLDTEDKRRTLVEIQRVMKPRGELYVADWGVPQNRLMRALFYPVQWLDGFATTQGNVEGVLPRLMGETGFAGVRLVRQIPTLLGTLAIHAASKP

SEQ ID NO: 6832 - protein, 947 aa, Chromobacterium substugae
MTTFEGQTAAELGRAAAPQADFSLYKTIRRNGAVVPFEPVKISIAMTKAFLAVVGQQGATSASIRDKVAQLTEQVVNALMRRKPEGGAIHIEDIQDQVELSLMRFGEHDVARAYVLYREQRSQERAARGEALTQVQINVLRKDGRKLPLDVARLRGNIEAASKNLAGIDVDAILGETLKNIYDGVPEEEVGKSAILAARSMIEQDPAYDYVTARLLMGNIRLEILGEAVGQDEMAAQYPHYFASFIKKGIAAELLDEKLAEYDLKKLGAALDAERDLKFGYLGLQTLFDRYFLHIDGTRIEMPQAFYMRVAMGLALNEVNREDRAIEFYNVLSSFDFMSSTPTLFNSGTRRSQLSSCYLTTIADDLDGIYEGIKENALLSKFAGGLGNDWTPVRAMGSHIKGTNGKSQGVVPFLKVVNDTAVAVNQGGKRKGAVCAYLETWHADIEEFLELRKNTGDDRRRTHDMNTANWIPDLFMKRVMEGGEWSLFSPSETADLHDLYGRAFEKAYTAYEARGERGELKVYKRIPALSLWRKMLTMLFETGHPWVTFKDPCNIRSPQQHMGVVHSSNLCTEITLNTNDDEIAVCNLGSVNLAAHLKADGSLDGDKLQRTIRIALRMLDNVIDINFYPVKKARNSNLKHRPVGMGVMGFQDCLHIKRVPYGSNAAVEFADESMEMVAYYAYLASTELAEERGRYPSYSGSLWDRGVLPHDSINLLAAERGGYLEVDRTERMDWNLLRDRIKQFGMRNSNCLAIAPTATIANIIGVSASIEPTYQNLFVKSNLSGEFTVTNEYLVRDLKAAGLWDEVMVADLKYFDGSLGQIDRVPAELKAIYATAFELDPRWLVEAASRRQKWIDQAQSLNLYMAGASGKKLDELYKHAWIKGLKTTYYLRTLAATSAEKSTGRGGELNAVSSGNSQQAPAAEVDNTPATDAKFCSIDNPDCESCQ

SEQ ID NO: 6833 - protein, 2793 aa, Chromobacterium substugae
MNHPQPSQPTSASENRLLPSRQPERVAIIGAACRFPGANSLQALRNLLLEEREAVDQIAIDRGAIAADGVSRAGLIDPPDGFDPPFFGIAQREANQMDPQQRLVMELAVEALESAGIPRASLAGSRTGVYIGISTFDYSRLQMNEGQDLDLYAGTGNAFSIVANRLSYFLNLAGPSLAVDTACSSSLTAAHLAVRALRAGEIDLAIVGGVNLLLAPDLMKVFAGAKMLSPDGRCKTFDAAADGYVRGEGAGIVILKRASQLQPESERALALIAGSAVNQDGRTNGLTAPSGPAQVGVIRDALADAGLLPADIDAVELHGTGTPLGDPIEAQALGEVFAADREQPLAVGSVKTNIGHLEAAAGIAGLLKGVIALREAKLPSSLNFRQANPDIDLARLKLAVASAPVALPSARRPARIGVSSFGFGGTNAHLILETAPAQPPRTAHADDAASWLLPLSAASADALRAQAAQYAALLERSGGAALADIVHTAARHRDHMDHRLAAHGDRGQLIAALRAAAGGQTHPGLSLGRRPAAGARKLALHGAAPELRAALAQAGIAADAELESSSPEAWQQQLPGRWDILAPSHGEAAALPERLRPLAAPADAMAALGLLYAYGHELDWQRIQPAGALAELPAYPWQRRRCWYGDQGLAARVTDRPRHLLALAAASAEALSSQAAQALQDCAQLPPDALADFCHAANAGLAKQPWRASVGAADSEELRRGLQQLASRPQPAPAPAAEPGVVFLLTGQGSALAGAGAELYASHPRFRDAIEHCSSLLKPVLDVSLSRLLFDRVRGDALLQNTCYAQPAWVALSWSLAQLWADWGVRPAALLGHSLGEYTAAALSGMASIEQILPLVAARGALMQETAGAAGMVAVKASAEQLRELVAPHAGSLALAADNGPASCVLSGASDALAEALKALDAQGIRWRTLDVSTAFHSPLLDPVLERMAALAAPIDWQPGTVPVISNLNGLAHAAAPDAAYWAAHARGTVQFRQGVQTLLAQGHRLFLELGPRPTLSALGRAASGELAVNWLSSLDGAGNDWQAMLDSAGALHNAGVNLDWSRFDQPYRRRALPAPAARSSIPSSLEPSMPQVNSSLDPRSNPSTSDDHVRQVRADLVRQIAKALGESEADLQTDRLFIEMGADSVMLAEAMRGIQASYGVKISARQLLNELNTIDRLSVHLAEQTAPQAAPAAAAPAPAIALPAHAAAGDMNALFQQQLNLVQQVIHSQLAALGGAPQAAPAPIRPVAAAIAALPAAPSSIPAAKAAPARAAGSAQSQQQAAHFAAFSQAYIARTATSKRLADERRQRLADVRASAGFRPTLKEIVYPLTGNRADGARVWDVDGNEYIDISMDFGVNIFGHGAPFLKAALHEQAENSLALGTRSTLAGEVSTMLCEMTGMDRVLFCQSGSESLMTALRLARLLRDRSRVAVFRKSYHGHFDGLLGDRSAIGDATEPVAPGILPNFVADLLMLDYCDDAALQAIEANADQLAAVLVEPIQSRVLDAQPREFLHKLREVTRRHGILLIFDEMITGFRCAPGGAQEVFGVEADLVTYGKTIGGGVPMAALAARGSLLDGIDGGIWRFGDDSAPDAGTTFFAGTFNNHPLGLAMAHAVLKELKQRGPAFQQSLTERTRQLTERLNQYFQAEKLPLSMIHFGSVFRFKHAGNLDLFYYHLLHRGLFVWEGRNCFLCDAHGQQEIDFIVDSVIDSVEALRAGGYLPARPAGTGLAAGEAPLSDTQRQIWLASQLDASGAAAYCETVALELGGRIEAAALQRALAELSARHEALRTTVHGDKGIQRVHAELAIPLTLGEGGDGADWLRAFSATPFALESAGPLQAGLFQLADGKPVLALRAHHILIDGWSLALILEELGALLDPAGRAALEAAQPFRRQLEWLLSARDEQAEAFWSQRLADAPEALPLPRANAGDDGQQARWQGERLRLPVPAGTADALTQLAVRQKATLFTTTLSLTLALFHTLFDRDDILLGVPTHGRLDGLERMVGQAAQIMPLRSRLAPGARFEQLLETVDFELEAMSDHQAYPLARLLEPVLAGGERPGALTVTFNLDRVRQSDFAGLPVTLLDAPVSGVKFDLAINLMQTPKGWLLDLDYQSRRYRREDIQRLAERWLDWAARVAADPAVELERANPLPAAELQQVLRGFNATANGKTALPVPQRIARQAALTPDAIAITADGRHIDYRTLDLAARTIASELVNHGAGPEKIVAVMLPRSAELVASLLGIFYTGAAYMPIDPDEPALRREEIFAETQPIALVTDAAIASRLAVDCPAIIVESPEELAAGWPSTADAWVNPAPVEAGDLAYVIYTSGSTNKPKGVLCTHGGLANLMEWTTERFPLDAADAVLQKAPYTFDISLWELCWPLLTGARLVVAPPETHRDPDYLARLIAAERVTAAQFVPAMLEAFAATPAARECRSLRHLFAGGEALLPSQCIAVRELGLPGLELHNLYGPTEATILVTHYTLRAGGRGAVPIGYPIANTSLRIVDSRGRPVGVGIEGDLLIGGVQLARGYLNRPEQNAAAFIETVADDGAPLRLYRSGDRARWLDDGAVEYLGRVDNQVKLRGLRIEIGEIEHALRAHPAIQEAVVDLRGDSAATQRLLAWIVPRQQAEALPAGDWQQALREYLAQRLPIYMIPAQFAALAALPLSRHGKIDRGALIEPRPDAGAVQAPRNPVEAELLDYARQNLALEMAGVEDNFFVAGGQSLAAAQLVTWAQQRFGARLALKDFLLKPTLAQLALLISQAGPASADDEGGLRSRERRRVRRDQIENETLGGADK

SEQ ID NO: 6834 - protein, 3521 aa, Chromobacterium substugae
MQDNSMAHEVFLCDASAAQQRLWLVCGLEGERSNYTIAGALRLSGPMRPEALQQALDDCLVRHETLRTGFVDVDGVPMQAIEPAASLPLARVDLGALPREEALRQAMDAAAELARRPFALEKPPLLRAALFRLADDDWLLALAIHHIVCDGPSLGLLMQDLARAYAHRQDPAQPALAELPLQFADFAEWQQEQLASPASEALLAAWEARLAGVPDLQPPTDFPRPALREARGARHEAHLPAAVRDAMAALARELETTPFAVLLAAWGMTLAGWSGQDDFAIGSPVSARNDPALAEVVGMFAETSALRFKLEGDPSVDQVLLSMRDVWRDSLAFSGAPFDRLVQRLRRPQDRSRTPLIQTMFSLNPPALPLDMAGLQAETLSLPDGDAKADLSLEVDETGDGYALTLDYDGALFRAETIAWLAERYAALLAQLPAARAQPLRALLAAAPAQRLASDAEREQLDRFNDTALALPGAPLLHAQLARQAAQTPAAPALWHDGRQMDFAELNRRANRLAHHLRALGVMPDSRVALHFERGFDQLIALWAVLKAGGAYVPLDPVYPQERLEFMLADSGAQIVLTESELAPRLAGAAARVLALDSAELAAALAQLPDSDPDDAEIGLRPDHLAYVLYTSGSTGRPKGVMVEHRSLLNLQAALQPLLAALPPGSRHSLNAPISFDASLEPLLQLLSGHCLYIIPNELRADAPALLAFIREHRLDALDCTPAIMEPLLAAGFGDGGHVPRCVLIGGEAISEHTWNRLRAIDDCFIYNTYGPTECTVDSTYCELHEAGDMPHIGRPMANTRVYLLDEAGRLLAPGEVGELYIAGDCVTRGYLNRPELNAERFLADPFRPGERMYRSGDLGRWLPDGSLQYLGRNDLQVKIRGQRLELGEIEAQLCRCDGVRDAVVVVREDTPGDKRLVAYLVPAAGAAPTAAQLREELARTLAEVMLPSAFVTLDALPMTPNGKVDRRALPAVGQQDLALQAYEAPQGEIETAIAELWQELFAIDRVGRHDDFFALGGHSLLATRVASRLGKRFGIRLPMTTLFDSPALRALAARIEAAQASLRAPAETPAAAPVDAAAGAPLSAAQTGMWFIHQLAPANTAYVLSGAIRIDGPLQPELLRRTLDILLQRHEILRSRFDQIDGEPRQFAQPAAPLALPLEDLSQLDEDARQRMLRARLEAEARTPFDLTQAPLLRARLFALAPQSHALSLSLHHIVADGWSIGILWRELAQIYAALAAGRAPDLPAAPSYADYARAEAARLRDEQSQDDLAYWRQALADVPALELPLDHARPPQTDNAAAEYRFTLPAALRAQMDKLAQQAGASRFMVMLAAFQMLLARWSGQRDFAVGVPVSGRDGLDVHDTVGCFVNTLALRADLSGDCGFLSLLERVKASSLAAFAHQGLPFKRLVDELRPAHDADRTPLFQVLFNYQHTDHGRHAVEGLQMETLAVDAGAAQFELGLYVEDDGTDIVASLVYRTDLFAPRHIARMGAALQMLLEAGADPARSLWLAPIVNDHDRELMAAWNHTDVDFGPAVHIDTLIAEQARRTPHACAVEAEDGALDYAALMARADALAVRLRRLGAGPGKLVAVHLPRGQDLPMALVGILRSGAGYLPLDPDLPHERLSYIVEDAAPVAIVAYPGSTGWLSAPLPEVVPVDEAGPETEALPAIARSVDDLAYVIYTSGSTGKPKGVLVPHVGVVNRLLWGQSAFGLAAGDKVLQKTSASFDVSVWEFFWPLANGATLVMARQGGQRDHEYLSALIEKSGITHMHFVPSMLAIFLAEVDAARCASLRQVFTSGETLPPQLRDRFHDWTRHARLFNMYGPTETCIEMTMWPCAPIERGQPLPIGRPIANSRVHILDENGMEMPVGVPGEICIAGVQVAHGYLNRPELSAERFLPDTLDHRPGGLLYRSGDIGRWCDGGWIEYVGRRDNQIKLRGFRIELGEIESVLRQHPGVSDATVLVAGADAESQRLVAFLLAPDGGIDVAALRREIASRLPEIMIPSTILPLPGFPLTSSGKTDRRALLAQLAQAAAPAAGHSPLGEVERQLAAIWCEVLGLASIDTRANFFEAGGNSLLMIKVHSRLKALYQPAPALVDLLRHPTIAALAAHLAPGGQDQAAPLAAAPRRAEGDDAIAIIGMAGRFPGADSVEALWDNLLAGRSGVREISREEALTDGADPALLDHPGYVPFSGVLEGIDQFDEKLFGYSPADAALIDPQGRLLLETAWEALESAGLDPARAGGRIGMFAGGSVSTYALGALKNLTLADSELLRALFSNDKDYLASRAAYKLGLTGPAIGVQTACSTSLVAVSLAIRSVLSGECDAALAGGISVAVPQRVGYLYEEGSILSPDGRCRAFDNAAAGTVPGNGAGLVVLKRLSRALADGDPIRAVIRGIAINNDGDDKVGFSAPSIAGQENVLRAALQNAGLRGEDIGYVETHGTGTRLGDQVELSALNAALGKDGGACLIGSLKSGIGHLDAAAGVAGLIKAALTVERGVIPASLHVEQPNALLAETASRFQVATAAQDWQPDGRPRRAGVSSFGIGGTNAHCIVEQPPRTEAAAIQTSAQLLTLSANDGASLARLSERLQTALAQPGADLAAIAWTLQTGRRELPWRLAVAASDAASAAEALAAATPPRDAAAAPELWFAFPGQGSQRAAMGAGLFAEEPLFRQTVETCLALLDRELAATLRAAVFSPQPPADADALLARTDIAQPALFIMEYALATLLQAWGLRPSALVGHSLGEISAAALAGMLQLGDALRLVALRGRLMHDSPAGGMLQVALSADALRAMLPAELAIAACNAPELTVVAGPADAVDRFADALRGQGIDHQRLDTGYAFHSQLMDQAAAEFSRQLDNLQTAAPSQPILTNLSGGWLSAEDALDAGRWARQIRQPVLFAQALEQARLRGALVLEVGPGRTLAAFARQAGVAAVAALPQAGAENGRRALLAAVGQLWQAGCAPDWRALQHDAPPRRVPLPTYPFNRKRHWLAQNAAAPVQGRSGAHLALLDWRYAEAPELRPLRRAAILGGDAALAGALAEKLRARGVEAHCWRELPAQRDIELLVALTPDFDALARLAGQLASQPARLLVVTRNAQLDDENADADAAMTAAAALAIGQELPELSLRQVDLAGGDPARRPRQLAALADECLASGPAVLVLSDGRRRAPSLCPLDVPAATAAQAGAVTLITGGFGNVGMAFARRLAGAGAAKLALLGRRIPADDDPRLLELRALGAEVLPLAGDIAEPGVARQAVEAALARFGRLDAVIHAAGIAGDAAHRPILETDAAESAAIWAAKRDGSLHLAEALQGLPLDHVLLCSSLSTVLGGLGFAAYAAGNRWLEVFAERQSRSGDTRWLALAFDGWRFDEPAGKDAALSAAQGVALAEQAIAAGLSGRVLASAGQLQERLARWTQGGGETDAAPAAPVDIAGYANPAEAIVAQTLAETLALPAIGPDDNFFELGGDSLVATRVIAKLRGATGLPLSVGLVLQAPTVRLLAAAIAALQGGAAAVADDAEEYEEGAL

SEQ ID NO: 6835 - protein, 2354 aa, Chromobacterium substugae
MSAEAIRLLAELNTLGISVWAEQGQLRFRAPKGRLTEPLKAELAARRDALLALLDKDAAAETAIVRRDMPAGQPVPLSPQQHSVWMAEQNGGGHAFLIPGALSLRGALDVDALRAALQALVNRHEALRCAIRLVDDVPMQVALPDVRFELPLTDLSAQGQAGREASVAAQLAAEAEQAFDLATPPLLRARLLRLAADNHVLILTPHHIMSDGWSIDIMVRELSRLYRPDSAPADLGPVPLGYPDFALWQDARRSQGGDRADLDYWRRALADLPAPLELPSDRAAAPDVDFAGAELHAELPAATANGLRQLAKQSGTTLFSALAAAFAALLHRYTGETDLTLGTAIAGRSRAELQDVIGLFAGRLPLRLDLDGNPSFLQLLRRVAGAAAEAFSHAEVPAERILAEAVAPDARPALFQVMIALQNAVKNRLDFIGLEVQPLPIAGHTAKFELFLAVDEADDRLALALEYSTARFDQPAMRQLLNHLVRLAAAAVAAPELPLSELAMLDADERRALLAPPRSPKAWDGAGDLWRRFLQAADAHPERPALTLPAQWQHAGPDTGLSYGALRDRAQALAGSLRRAGVRPGEIVALAGDRSGDFIVGMLAILAAGGGYMPLAPDLPPSRVQEMLEDSGAARLVFSDDAGAALAGSFAAAFDARAAANGDDGAELPAIDPASPAYVMFTSGSTGRPKGVVVSHANALHFVANMPTTPGSGREVFLQFAPSGFDASVIEIWSALLIGARLVIAPPGLPSLDALAELIESRGVNVCWLTAGLFHQMCEAHPAALSRLDYLLSGGDRLSVAAARAVLAQNGPARVYNAYGPTETTVFATLHRILPADVGPDARSVPLGGAHGDARLYILDSRREPVPAGAAGELYIGGAGVSAGYINRPDLTAERFLPDPFNAAPGARMYRSGDLVRRRADGLLEFMGRADRQVKIRGFRIEPAEIEAHLQEHPAISQAAVEPQKQGGIQRLVAYVVASAPLSLDDIRDFLAERLPEHMIPGALVALDALPLTRNGKLDRRALPQPAVESSAGQEPASAEARLLAAIWRDVLQAERIGLDDNFYELGGDSIMAMQVAMRLTRQEWELRPQDMLRHPTLRAQSRLLRRKAKTLARREFSQPLPLTPIQNWFFQLPLANRNHWNQALRLALEPAAAERLETALAALEQTHDALRLRFSPDAGGWRQLPAAAASPRLRRERVAGEEQAGERIAAAQRSLDIEHGPVWTALLLEGLGDWPQLVLIAHHLVVDGVSWRILLEDLALALQGRALTPPALGLCDWAAHLAEQPDAEPDAEPAAAETAPALPPLDHPQGGNLESQTAIASLLLPPDAATQLLGPANAPYRTEPTELLLAAIMLGLRDAFGRDALTVALERHGREADGIDLSGTVGWFTAIAAVRLDLAAAQTPGQALLAVKQAARTAPRRMRNGDGRAPAVAFNYLGRFDNTLPPGGPFRPLDADSGVCTDPAGARPYALEIVASVDADGLRVDFRHSAEQFERATIAAWVDAARANLLALAALADAETAGGRAPCDFPLSGIASQRELDDLLAEHQLAAPALDDLLPVSAQQRGMLLENLAHPGRGMHVEQFVATFAGPLEPAALEAAWSGLIARHETLRSGFIWRHDGEPLRVVHRQAAAGWQHLDWRADAGAESRIGDWLAVDAAAGFAGSAAPLRFATMRLDDERWLFVWTYHHALLDGWSVARLLAEVLEPASGKAAPASARDHARWLASRDREAAAAFWRRYLADAATPSLPGRRDAELEPGEGYADLRQTLDATRAEKLETLARRRRITPAMLAQGAWALTLAWASGQDDVVFASTVSGRPTEIEGSEAWVGLFINSLPLRLTVPAAGDAWRWLEQLGDNAAERSQYEWCAGGDIHAWSGLSLGRSLSDTLIIFENYPNTPQQPVAEGGARLVSVAGRGARTHFPVTLLIMPGDGWRCEFVCDNQYIPAEEAARLLDAFIRLLAALADEGAALDGVRAALPPQPPRLCRQPERVVQPPRTALELEIAKLWEDLFALSPIGADDNFFLLGGHSLLALDLMARLRARFGRRVPFTAFLAEPTVAGLARLLAGDELQGGVSLLPLADQGRPLYLMPGASGNPLAYLELAQALEGRYALIGAQPDMVDRGAALTIEAVAADLAQAIERRQPQGPVLLAGHSFGSAIAFETARLLARQGRTVGALVLIDTPVPNGGDEFAGFGEIDWIVSIADAAGSYFGQPIDLAPEELEPLPSDARRALMLARFQAAGALPAGASRQVIDDLLATYQNSIAAFSAYRPAYWDGALSVIRSEQEHGIDDPTLGWGGLCREIGITAAAPGDHISMVASAHAAELAKRIVLCVDSALEAGQARDKEAAATV

SEQ ID NO: 6836 - protein, 451 aa, Chromobacterium substugae
MDRHAAPGRRRRPADRQRGARDAQPLPQLDRRHLPRLSRQRRRRPRRQPLRPGRRQPYRRRRLRQLAGRGAAGLPGAAQRRRRHHGHRRGGHRQFQCRLSQLQQNSGAVQNRQGALLRRRRRRHHDFRRRGHAGAQAAGRRRGRRRPHLRRDPRPGRLHRRRRRRHLRAAQRRPDARAARRLRRRRLRSAVGGPDRSPRHRHRGRRRGGDRIAGSRAGRGRRADRAGQRQGPDRPHQGGRRRGQPDQDRAGALSQSDPGHAECAGAQRAPEAGRPLLPAAPRPAVAGSRQRPAPRRRQRVRLRRRQSARSGRGIPGQAPRPQPPRGRAHAAERRHPGGTGAPLPRTGRPAASRRPQRAAVAGRAAASRGRPRRPVGPLAGRRARTAEERRRHAGQAARPGRLVAAHRRPLPPPGAGGRSGGGVQRPGFANRGHGFAPADRPAASPAILRSL

SEQ ID NO: 6837 - protein, 378 aa, Chromobacterium substugae
MEPDQKLKDTLAIYRDRISILKKGYAQERYRIEQLCRSFLGDIVTREVTSVDIATYRDQRLTQVNPKTQKLLSTATVRLEMSLLSNCFDIARIEWGLCDSNPVSNVRKPKIPPGRDRRMTPREERLILRYAHAHSNPELYSIIVIALQTAMRQGEILGMRWEYINLKTRVVHLPETKNGSKRDVPLSLKARDALIRLGVKSKGKVFSYSAAGLKSTWRLMNQTLDIKDLHFHDARHEAISRLFELNSLDMMEISAISGHKSLSMLKRYTHLKAHKLVRKLEGNKNKGKQVVLDHMVPYPAVIMRRKDTVTIRLLDFDDLQETAPDEPLAIRLAQDALLRRLMTSMRDATPIPPADQYLDSVDERHIIMIDPLANHSTL

SEQ ID NO: 6838 - protein, 87 aa, Chromobacterium substugae
MNSQNIYNIAFGIVLRDLRKQKGYSQEALGFEANLARNYISLMELGQRSPTLDTLTALCSALDIPFPALAMLIQAKTTETHGTRSKT

SEQ ID NO: 6839 - protein, 161 aa, Chromobacterium substugae
MAKRILLLMLLTWLPAAWAEAPPEHFDVRRTANCALDASDRFGVPYLLLMALKVKESGVQFSNPYVTGRNSNGSVDISYWQINDFWLPKLARYGIDRARLYDPCVNAHVAAWLLSTEVRRRGSWEAGIGAYHSPNPARARPYALHVLKIWASLRQEYPGWG

SEQ ID NO: 6840 - protein, 257 aa, Chromobacterium substugae
MNQQESLLPVERHEESQDSAESRLPVVLAFPEDRPIIGRDLDAFKDYFGATVAQALAALGIQTHGRWSTIVKKNADMPVDGAIANLVRWYAAHPERFPFGQVDMPTLRLRLSINQDSFAQLFGRRKVAVSHWERKQVKPEPQVQIIAREMDDLLKSYEQQAEQERDGSLVVLQRLLSKLEDIDEDKNLRGKSEILAAIRETLLMEEKNISVKQEATTRSLDMLHEFMDIAALNSSLIPAPPPRRKGVRQKKVPISGE

SEQ ID NO: 6841 - protein, 250 aa, Chromobacterium substugae
MPLLLALPLAPVRAETVTDQQADAIVTRAVESVAGGAVARIRPHRAFSGFLQRNGAAGLMQAARGRRDKAVLVLSGVMYESGCYKMAGAYFRHNYQFSALGHAEPAAARVGFDRLAGPASAWCVELGSDDWPAAPRCKKPSPAAKGKQARWDKLAAQAEQARARRNAYLSSIRFNRFDYVAAVTSPTLDLYDPAMQRPDNAACAILADDLSKALFSRLRHDAGDDAYYLKHRQAIDAAREVWRKMDGLEK

SEQ ID NO: 6842 - protein, 248 aa, Chromobacterium substugae
MKTFLLCFAGALSAIACGSAAVLLSSGQAGADGISLPQGGGGNGGGPAGFCFATPFQGAVRVTSPASAARKHPTLGTTRPHYGDDISLPSNTPIYAPADGVVERVAFNVNNAGNFINLKHPNGYLTRYLHLNSISVKSGQRVHAGDLLGYSGMSGGNNTGPNLHWEAHYLVYKNPSPPKGPTSMLCSGAVSTSDQSEPKQTGDENNTVEWPKDSDAPDPVWDACPIQPPPVASQGWRLDEPGRTSKPY

SEQ ID NO: 6843 - protein, 329 aa, Chromobacterium substugae
MTIKQKLNSLPLKRKVLVLLLGGGLALAPTLALADLSNDILGKILNQVTQILQQQYQQFAAMIQQMDVMRQQGEAMRDKMGQESDKNRQQQCDIWCGKSLPKPGEVPADANNTGSPGAAMSARRGMTAQLQAVTGNMAGNMDQNTAIQGYYGALANWFQSATPQQKQQVQQPLSFAPGDVPSAEDRKLADYNAKLTIGLEPVPPVSSAQIKSNPAAQEYEARRIGYNSAQLVAYDSYRQYDLSAEEVKTVSDVLLSMSQQTIENMNPGTAMKAQVQLLAVQSGLLLSQYQSSLRQERLLAVMAANNARMSMSDRLRRLSQSQAVQSYAK

SEQ ID NO: 6844 - protein, 528 aa, Chromobacterium substugae
MQGVSGTALACLLGMQVAPVLPGFIAVARAEASAASYGPAAGQSAAELAQRLRALAQNQVMANYPVLREAYVQRQLAKLRQDAQNLPDTEANQAYREAVGDFSWMRPQLEDAASLDYYGMPDALANELVAQANAGLVRQVMAKYPQQVLAVMANQAISLEMGKMFPAAADQAAEAVVWGSKNSIVQYLGNLDKDQFVQSMVNSVVDYAKQQAIDYFKKWIKKIIQENIITKITSEIIKNYPYIGPYISWYQTQKQKLDNIKHRIDQIKKEAELYLKKLGFDNAMERQQEDMTWGKQNLPAYPNGDGSSEFGTSGGVRSNQQVIERYARQERGDLAQWSYDGDRPGTFYGWMGSYPAERRAAVMRPYVIGPRLGQDGQLQPVGAAERENVRRNAWLTLGLEPNTPFTAKPGSPAYQEELAVRAQMASVMSLSYGSYMEGWMAQDRITQLASTIQMFTPSVISGLSTGQANGCRVMLKQLSTEVQMQTSQSQLRFERLFAASSGMLGNIERKEQLAGLSQGAPIGAINGR

SEQ ID NO: 6845 - protein, 713 aa, Chromobacterium substugae
MSVLSEGAKGIGFVFLERVLGSDALSYYGIHTTGVNSVPMTTGMALAADVALWFTPLITFYILGMGLIYSSQEGVVLGKRWSAVIVPLRGVGGLMFSAPVVPGGLSAIQVMVVGLALLGNYIGNEAANVLAERIFLPSSGYVHTKPASLLNNTDAAATAFATITAAAVCMNTASNLGADGNPAKTNPAPGGGSALGIGMQLWGIATGTGGGGGGGGGTGISLSDLCGGAQNAQATRPDAQPSSSSTTDGYPSGRMDCGSSSFVGPCRKVEAANSTLKDALSATLGRMGGVLDERILATLAATYLMQMNSAIDMDMTDVIKENTKAVQKLGWPGLGNFYQKYSSVSGEIDNYIYYSGEPSFDFKDIGDETRAGMALNDQTRMAFKRAFKAFNFSVQGVLSGVGGLMQAGNTAINNANASIMGELQVNVENRILRSLLFGVGNSAYDVGAFDAVQRLGGLLNMFGTTTLNMLVCEKRSGSDNSCDKSTANESAQSGMVSNAVKSIAGGGMADVATMVAKSAVMAGTVLTMLLPSLPTIYFVLMTLEWVIWLVVAALASPLWMIFHMLPDGESLVHSRAETGWGLLAYITLFPLLVVLGFCASMTLFNVAVPFAFEMMMSITGSTAVGSGLDFLVKPLLMAAVVIGVTFLTMGLMISLPHRIANWLNINPQSDSLQEGKSQLGISAPKLTDMSGGAANVGASGWKGALSKGVKPGK

SEQ ID NO: 6846 - protein, 267 aa, Chromobacterium substugae
MHDQAHSAPTRESLVAALRKREFSMHYQPQLSCRTARVAGAEALMRWHSAERNGPVSPASFIPLAEQSGFIVELGDWSMASALRMMAAWRDEARLPADFRLAINLSRRQIVPELPGKVERLIAQAGLEPSCVELEITESYLFHDLPTMVEVTRQLRKLGVRVAIDDFGTGFSVLEHLRHIPATTIKIDCSFTRQMLEIERDHIIMRNLIRMVRDLGMESVCEGVETMAQLEAVKDMGADYWQGFLFSPALPGAEFRGLLDAPGMDLR

SEQ ID NO: 6847 - protein, 81 aa, Chromobacterium substugae
MGVVFKGSETSCIGRMQQLRRQSILGLPLPTCGAVRVVNHQGVVAATLLADAPQQRLAPTNRQALYALDQDMVEHLGHTPR

SEQ ID NO: 6848 - protein, 307 aa, Chromobacterium substugae
MRIDKRSALALGGTTLALLAAFSWLGLQGSAPARAAGSLFAIGLLLGSFLNVLAFRLPQMMEQAWQREAAEACGLPPPEQAPLSLSHPHSHCPGCRNTLKTWQLVPVFSYLLLRGRCAFCASPISPRYPLVELSVGLIFAAVGWRLGPSPAALAHLALLYLLLALALIDLDSKLLPDSLTQPLLWLGLLANLLQSLAPLQDAVIGAMAGYLSMWLIAAAFRLCTGKEGLGIGDFKLMAALGAWLGWEALPLIITIGSISSALVGIALIVAKRTKREQTQPFGPFLIAGGIVALLWGKEITRWYLALA

SEQ ID NO: 6849 - protein, 236 aa, Chromobacterium substugae
MREEMPLFDVPAPPSANPLTIPYRAPAPRNYAEARDLLVKSSLRAVDIAKLNLQKKLEDQPQRARRANFIASQGRIQAGLGFAKLALLADGTAKAPVTLYWKIGEKAVFQARGTPTADVCDGVRRIWMSAIWYDIWEKGIAKSQASLDNLPAIMFQSGAALFNDRKLGMAQASQQVRETLGSGGELRLENRSQKPFYQFSLDSVLSNACLNGNMTYTDTGAALPLYGAPYPGLFRP

SEQ ID NO: 6850 - protein, 305 aa, Chromobacterium substugae
MALDEDRLSFEDEPPVARNASRTMAAPAHQDLKFDDEPMDSPPAAQPKKDAKRIALLALIGGVVVVMLTKPLWQKVLNPPPVEDPAPTAMRPMDPVKPMVNTPPAQLTHQAAPASLGSASVAQPPSAAAPSQPQALLQPGANSGQAAASPSPLQPDAAADAAAEPALLAPSAKKTALSREPAAGGDADASQPKAAQAKEAAQPESLEAKVARLEKEVKTLRERNRQMASRGAGQARAPKAHGDGGKDAGSKVLGMSSTSVWVKKSNGGTAELRVGDHFRNGEVIQSIDQQAQVVETDRGRYKVSF

SEQ ID NO: 6851 - protein, 245 aa, Chromobacterium substugae
MRKFFAKMLLGSDTLNKLHSIQQSEALEEEAGKRFEDAGQMPPKVSSPTITREQIRSLIEIDMEIHGDIFIGRGVKISGRVMGNLIPNGAIDDCDPIVIVSQGGDVCGDLHARVVVVAGSLDGDIHADHVLLMPTAKVSGTVNYRHTLRQDIGSALSGMVRRVEAIALLDQPPRPGEAARAALQNTAAGKADAIPVLPVEPDSVVAPLVRAVPAAQDTAEIESLYRGLDVARENPAGGRVVALGA

SEQ ID NO: 6852 - protein, 106 aa, Chromobacterium substugae
MGLARELPPEALDDEEDARWAYLPFLQLAIERMCVMALLAEDHDVAFAPLDDAALPRMRQDCGADPVFARAVADYLAALATLGSMSGRGEDELHRSIAGLYQGRAQ

SEQ ID NO: 6853 - protein, 650 aa, Chromobacterium substugae
MMDRHPHGRRAYAQEAAQRIHEQVAALGAEHVFAAPLAGARHFNPLTGTVYQGINHLLLQSALPAASSDPRWLSYKQIQSLGLGLAPGARAGLLLFARPMQALTGPAGPALKGCSVFNGAQILGLPPLSAHPAAAHAGGGKLQQLVGAILGELGLREESGGAAAIYDPVGEIIRVPQAGYFRNMREYNAARLRKAAQWAAQHEKRPRAAKRRPRHHGPDDPLEELWAHIVSALLMGMIGFGAAMPAEGRQLGGAIPLLQRMGEIDFMEWFHGAHQVEQVLGWLGQLSPTLARLMEIERQFVRGNLLEGGDTSAPQAQPSAATPEAQIAGGQLADAGETEREMAREARRHALLMDVALLTAPELAHQLASHFGAQQVLAETDAAIHEKFQHWAQGAVMGGMFDGAAAKARELFGMFLRERGEEVGHLLEKDGESQRQARMAAAIEMPSAGSAGKIAVIGGAEPAAPAREISIQPFRDGKGGWLKVGHQDVIELGLVRQIADDDSRMTPSAVYLAFREDAPHCDAQRLMDAVDAAGWKIQFQQYVESKDSQIRSYASYFAPLVGYMPKIGDKLKLVEGVASISSKSGSGGWVVSFDDAGKQRALSSGRFYDFIESVIEGDFLSPPAAGKPERAAAPQPKAGRPALDDAALGF

SEQ ID NO: 6854 - protein, 142 aa, Chromobacterium substugae
MFNLTVVAMEEELKKLESDLIAMMDDRFMAVEDSLARLVNLGEQHQRKLVSNDMTVRRFLPQFGMCVVICSALIVVPVAAAAWYLQEGKVQQLQAQTREYQRQAVRSAAFDQLYQAADSGLRLRMQNAVEQAAEQAGTAGRQ

SEQ ID NO: 6855 - protein, 906 aa, Chromobacterium substugae
MAAPMRRSQVERDVVPFSHKVLGWLRRQEPAFLTGLGVVYLLCPIFPLFTLAFAGAAMLMSRNRVIDHPKGPFWKPVPGGDKKLAWTRMEGPPDKGGKGVWCMGNAMDTKEEIWVSDDTMRVHATLFGTTGGGKTVALEGLICQAIGHGSGVIMVDGKSDPKTWFDIVTMAKMYGREDDLLVLNFISSTGFEKLAILDDDDAGGAKDKMDLLGQIHSNTFNPFTYGSADTLTELVTGLMRPDGGGDGAMWRGRAEAMIRALMRGLVAMRDAGKITLSVQALRDYMRLDKLGELESDESIPGYAREQLTGYLDELPGFREAINAKNNDPAAFDTYWEQASKQHGFLTMQFTELLGLLSGTYGHICNVEWGDVDFQDVVYNRRILYVMLPALEKAPSSLANLGRLTVAGIKNALSVSLKAQLTGSKQEIVDSRPTNSDTALLAIMDEYGSYAVEGFGDVAAQARSLGVSVIFAGQDYPSFKKGSEIEASRILANTGMKIFLKTEDQETADIAIKRAGQGVYAWAGGKRKLENSDRLVDTGDASYREENRLTYLDLVDMAEGQAWFMNRNHLIKMNTFYVQLDGAVAKDAKHNTLFPLGNDMSKALAADKIMQDVMGVSEPGKGGESMLRFKRRIFDDVEQLFRLAEQREIPADPGSGWSAAEQAAGALEEDVFVRISDLQAEHGLLMRAAVVAELAGGMLADVPMVERMAEREEAALGARMSPDQLAGYADSLLEQAELEGGAASDAERERMPAEAKAGVAAPDAVAEEEHAPLPLTGFSAAAFFHATETEAEPEEAPGGNFDLADLAGFFGAGGEAEPQSHQEEEGGVDPYLSEVLLECEALAEEHGLLKQAMRIDAALATLLGRGGDAERELDEMDQQAGYILGSEDAGQFLELLLAEAEEERAQV

SEQ ID NO: 6856 - protein, 440 aa, Chromobacterium substugae
MHIEETVSNQPAGNGPWSTLMAMRIGPLPLPLYLSLAAIVVAAAIAHRLPNDLIGGLAVMMLSGFLLGELGKRLPVLKHIGGSAILCLFVPSALLGYKLFDPDMLKALTTAMKTANLQYLYIACLVVGSILGMSHKVLVQGFLRMFIPLLVGTLGAVAAGMLVGLLFGYTPWHTFFYIIIPILGGGIGEGILPLSIGYSEMTRIPQAQIVATLIPAALIGNVVAILLAGLLHFYGKKRPRFSGNGMLVKTGEDRELLAAQHEAPINLSLMGSGLLLTCSFFTLGSLFAPITGIPGPILMIITAALVKVSRVMPAQVELGSYQMYKFMTSNLTFAILVGLGTLFVPWNQMAASVTPGYVLLCAVIVLAMVASGFGIGLLLKMYPVESAIVAACHSGLGGTGDVAILSAANRMEMMPFAQISTRIGGAAMIVLATLLMKLLH

SEQ ID NO: 6857 - protein, 212 aa, Chromobacterium substugae
MTVHTRIEDLAAPLPVSNLDTDQIMPKQFLRRIDKAGLAEGLLYDMRFGPDGKPRPAFVLNRPEYAAARILVAGPNFGCGSSREHAVWGLRQYGIQAVIAPSFGEIFYSNAMNNSLMLVALAEADVEAILADVSAPENSLVAIDVASMTVRSRSLTASFSLSERHRRMFLEGLDMIGATLAMQDQIHAFAAKHWQQRPWLKDIASTTKNRLA

SEQ ID NO: 6858 - protein, 476 aa, Chromobacterium substugae
MTALQTPPQTLYQKLVETHTVARLDTQNVLLYADLHIMNEYTSPQAFAGLAEAGRTVSQPGQNVAVVDHIIPTHPVAIRIIEEPNSALQASNLKKNCDRHGIPLFDANDRFQGIEHVIAPELGMIRPGMVVLCGDSHTTTYGALGALGFGIGTSEVEHVLATQTLVYRLAQTMRIHVAGRLPLGTTAKDLILLIINRIGAHGARGYVVEFCGEAIESLTVEARMTLCNMAVEAGARGALIAPDALTLEYIAHHCPDLAGATLDAAKVDWRALRSDDGAPFDLELEFQAGDVEPYVTWGTSPDQSIPISGRIPVAASAPEGADRLTMQRALRYTGLTEGAQLEGLPVQRVFIGSCTNARIEDLRAVADIVRGRSVAPTVRAMIVPGSGEVRRQAEQEGLAQLFIEAGFEWRQPGCSLCLAMNDDVLNPGERCASTTNRNFEGRQGRDAITHLMSPAMAAAAAVAGCITDVRKLGVQA

SEQ ID NO: 6859 - protein, 318 aa, Chromobacterium substugae
MKYKTVFNLNAKMNSISDVAFFLEVVKAGTLSGAAQELGVSTAAVSRRLANLEARLGIRLLNRTTRRAAVTHEGELYLAEGKKILGELEELEQRLASAQAIPKGLLRVNATFGFGRQFIAPAIADFVELYPDVDVQLSLSDRPVNLIEEGFDVCIRFGELPDARITSRKIASNRRLLCASPAYLERFGAPVSPMDLQRHRCIVIRESDETYGAWHLHSGNTQANVKVRGTVSTNDGEAAVSWALRGLGILLRSEWNVAPYLRSGRLREVLGDWRFPAADIHAVYPMKNNLSAKVRAFVSHLDKHFEPYRPRGDGKSGW

SEQ ID NO: 6860 - protein, 300 aa, Chromobacterium substugae
MYQQAASHFSTVRDLLRFAVTRFNEAELTYGHGTHNAHDEAAYLILTALQLPIDQLDPYLDAKLLPSELEDVLELIRRRAEEHVPVAYLTNEAWQGEFSFYVDERVLVPRSFIYELLGEPLEPWIEHPELVHRALDLCTGSGCLAIQLAHHYPDAEIDAVDISLDALEVASINVEHYGLQDRINLVHTDMFEGIEEKYDLIISNPPYVDAESVDALPEEYLHEPEIALGSGEDGLDATREILRRAPEFLNERGVLMVEIGHNRDMLEECFPTLPFMWMETQSGDGFVFLLTREDIVTAGI

SEQ ID NO: 6861 - protein, 458 aa, Chromobacterium substugae
MNKLSKDIFKAYDIRGIVGKTLTAAVARQIGQAVGSEALARKVRAIVVGRDGRLSGPELCEALSEGIRAAGVDVIDVGRVATPMLYFAAHQLGTLSGVMVTGSHNPPDYNGFKMMLAGDTLAGQDIQKLYQRIVDGDLAAGEGGYRTEDIAEAYFERITSDIKLERPLNIVVDSGNGVAGAFGPLLYRRLGCKVRELFCDVDGTFPNHHPDPAKPENLKDVIEALQKTDAEIGLAFDGDGDRLGVVTKDGNIIWPDRQLMLYAADVLERNPKAKVIFDVKSTRLLKPWIKQNGGVPVMARTGHSFIKAKIKETGALLAGEMSGHVFFKERWYGFDDGIYTGARLLEVLSRVEDPSELLNALPNAVSTPELNLKMAKEGENHALIAKLQESASFDGAEEVNTLDGLRVEYKDGFGLARASNTTPVIVLRFEADTEEALERIKGDFRRVLGTATSAKLPF

SEQ ID NO: 6862 - protein, 342 aa, Chromobacterium substugae
MISPQVALNRLIDGNELFYDEMLDLMRQIMRGELSPAQTAAILIGLRVKVESVSEIAAAATVMREFATHVPVADRANLVDTCGTGGDKSHTFNISTTAAFVAAAAGARVAKHGGRSVSSSSGSADVLEQLGVNLALSPEQAGRCIDEIGLGFMFAPNHHSAMKHVAPIRKELGARTIFNILGPLTNPADADKQLMGVFHPDLVGIQSRVLKQLGSKHVMIVHGCDGLDELTLSGPSMVAELKNGEILEYQVEPGEFGLMRCELKDLRADTAEQSRLRLLSVLDGEPGPARDIVLFNAGAAIYTADIAPSLADGVTMAREALDSGKARQKLDQLVALSRQFGN

SEQ ID NO: 6863 - protein, 129 aa, Chromobacterium substugae
MRMRLTLALALLASPAWAGALDDCAQSAADTPAVAACLQQRHADAQRLLAAQEDKSLAAMRKLDRASDNRFHAARALLRARQAYQTYRRQQCDWLAASYASGNGADRARLACQIDLDTQRLAELGRQGS

SEQ ID NO: 6864 - protein, 202 aa, Chromobacterium substugae
MATKSSAIKDLTPMLLMIDNYDSFTYNLVQYFGELGQDVRVFRNDEISLQQIEELQPKYLVISPGPCTPNEAGVSVPAILHFAGKLPIMGVCLGHQGIGQAFGGKVIHAKQLMHGKVSPVSHLDKGMFRGLPNPVTCTRYHSLVIERESLPDCLEVTAWTDDGEIMGVRHKTLPIEGVQFHPESILTEHGHQMLDNFLKEFA

SEQ ID NO: 6865 - protein, 40 aa, Chromobacterium substugae
MTHKRIHVKPEAGPRRLRLPSPRGRTPPAPVGCACRRYPV

SEQ ID NO: 6866 - protein, 566 aa, Chromobacterium substugae
MERTFTVLVAEDVEATRRLMGLVIEEMGHAVRYAENGRQAVEQCRRQLPDMILMDCMMPVMDGQEAIREIRRLCGDRWLPIIFLSARSDEEAHISSLDVGADDYLVKPINLTMLAAKIRVMQRICEMQSRISADSQKLLNYYNSNEREQRFAKHVLDSIVGSEEQDLPGVCGWQLSAEQFSGDVLARALSPTGQLCIMLADSTGHGLSAALACLPAVDIFYAMVRRGFPLTAMAREINAKLNRLLPVGRFVAAALVAIDWEQARIEVWNGGMPCVVFAADDGALLKEWKSQFPPLGIFGVEDFRWESETYFWEQSGQLVLCSDGLTEAEDAQGRQFGSRGVLQALARAGEDAPLDAIRLAVLAHLGGVKNRDDISLGVVRLEADASMAAERGAEPLERDDGGLLSNWQIQLEFNAEELRRDQALPMLIGWLNQLGLRGGQFKQVLLVVTELFNNALDHGVLRLDSQIKAKPDGYERYFVLRRERLNGLREGWVALRIERRRHEGRDGIFIRLCDSGAGFDHVSLLEGLRREPSELPSGRGLPLVRALCRQLVFHGCGSEVVAEFPL

SEQ ID NO: 6867 - protein, 169 aa, Chromobacterium substugae
MTPSLEKNGYMLTTLDSLFGASQSNSLWYLSFGLACCAVEMMHAAAARYDMDRFGLIPRATPRQADLMIIAGTLTNKMAPAMRKVYDQMAEPRYVLSMGSCANGGGYYHYSYSVVRGCDRIVPVDVYVPGCPPTAEALLYGLMQLQAKVRRNATASGRALPGAAATAPR

SEQ ID NO: 6868 - protein, 286 aa, Chromobacterium substugae
MRIPATPFPLIGVLLAGQSQAEINGRPLGCTPRCFVSGPFSQPIAIRLSPGTRFISALLRTGQLSRLFPLDCQRIADQSWPLEELAGRPAADALHDALQAARQPWQMARILEDWLRRQAARREEAKDGGPLLLPPDWLFADSRALAERCGLGLRQFERRFLASYGQSLRDTRRQMRFVSMMGLLISRPDAAGQLAGLAADCGYFDQPHMARDFRALSGLTPGDFLRRSHGDRNLEMSLIQYQDHELPLVLGEGNRDILLPPDVVSVQAGGARHGYSGAIVDSEAMP

SEQ ID NO: 6869 - protein, 173 aa, Chromobacterium substugae
MGEAIAAEARFPGIRRGAFMSGHGYWAAAIALAAILSVQAASAADAAAGQCRTLTDIEGRYRCAGECVTTAADGSRSLVKVSGEEDAIRRFDGSQWIYQIDITGSGGFAETEIGGLSGHVLQTATAHVSDQQYPVLEEYAFAADDHCRATGYVKTVRNPDPVALKACSLACSR

SEQ ID NO: 6870 - protein, 267 aa, Chromobacterium substugae
MSTTTIEQLSRIVQSHRAYTHPIFQHWAHAAPDAEACAALFHQIQAFCAATRPGQAFPGALEMLGLISQAQLMAEIAQSEQGHGADLARMAGHIVNRSGARPRFADVNDQQQVETELKEASDRLLADHPGYERPTGLLLQTRRAMAAFQRRARSDFDSTMRNLGTAFALEIISNRALIPGEKQALVDTGHYGVRLEDPEMHYLLDHWGECGAESQHENHVREAVAATLTASTAPLILEGMLDFLDPLAEMWDVLDQSLLHACAGHAA

SEQ ID NO: 6871 - protein, 244 aa, Chromobacterium substugae
MEHHTYHHPPGTIEHADMPDEFREILIHQMLANGEGELSAGDTYVDSFYPLAPNADERYICVKFAAEEVDHFRRFARLLAEMGIDTSHMLRQDKKERRFFAAESMTTDFNTWEERAAFSFLCELEGHYQIKEMVDSPYRPLAIEAREILKEEAMHFAHGALLMRRAREQADSRHRAQQALDKMYPMALDMFGKSDSRRSRLAVKWGLRTCTNHELREVYQRDIDQHIVRLGYRVPDASAGRKYF

SEQ ID NO: 6872 - protein, 138 aa, Chromobacterium substugae
MKQDAPLLLDVAQAKKILAESPFGPWWNFQVEAVSPGKAILRLPLKPEHYRPGGVAQGGSMMTLADVAFWLALMTVAGVDTPAVTLEMKTNFLRAARTDLSCEAEVMTAGRRILYGTATITDSEGKIVSHHTLTYINA

SEQ ID NO: 6873 - protein, 229 aa, Chromobacterium substugae
MHPDFQTAYQSTPMADARHKVLRNTYGLLGLSMIPTVMGAIVGTHMSFAFLAGSPIIGMLLIMAVFYGLVFAIEKNRYSSAGVFLMLGFTFMMGVLLGPLLQFALKFSNGGQLIMTAGAATSLVFFVMAGIASTTKRDLSGLGNFLTVGAIVLMVAVVANLFLRMPAFQLMISAAFALFSSLMILWQVKVVVDGGENSYISAALSIYISIYNLFTSLLQLLLAFGGNRD

SEQ ID NO: 6874 - protein, 115 aa, Chromobacterium substugae
MQFSRVRQFLRARAGNFQIELFSSPSSRNTIAISIEAFSADGVFQDALEREMQFSMLDAAFMIAHGTSEDLMMILGCCQQLARSALCAAGDCPGGWPDRQEELKSVLSLPWSLAV

SEQ ID NO: 6875 - protein, 139 aa, Chromobacterium substugae
MLIEQLSGFLPLKQLVVRAFLHQEDWELSARALVSEHHEHQHEAWHSRVIQQKDVIQDFGCYSSYISRPENTQWHETILRHQSEWHGSLDMIRLIESLKKTNPAMSRDAVRAAETLLNGWYRQASEALRDATGRHAQYA

SEQ ID NO: 6876 - protein, 128 aa, Chromobacterium substugae
MCTQNALENYRLQCLAIRMLEQAALDMAVKPRNPNEAGITKQERYMRNQAASHKQEAEKWLSDLTEKANGFNFLLCSAVIGDHLKLNNLPTDEIASQIRKAVLQAPSEMALVLSNLRRNMMNEVAPAQ

SEQ ID NO: 6877 - protein, 105 aa, Chromobacterium substugae
MRKIQAVLKDIAQKTLLLASLIDEATRVGVLSQEQADDLVQGVRIRGHLSNSLETMAYWTAKDLNDPALAEEFQELVISIRDFLAWVDETVGKLQAALHDDSAVA

SEQ ID NO: 6878 - protein, 169 aa, Chromobacterium substugae
MYDDGRVFLVAGYWAKLKKAFAAASVYVIADTATIASSLAKRCMPQFLPAGVMSLAEVRRYVAYMRRIVSGDEICLMQEGISRQHGKLPDDQVFVVVGFSKNHSPDRDPVVNFVAAKGEAEATMLQQSAMPSLSVSGVASLAKLLELQSGMERVASGEMPALKEQGVIR

SEQ ID NO: 6879 - protein, 202 aa, Chromobacterium substugae
MRERFDEWKRQAFLDGGPPASMTESNVAKFFLRAEALKQQDALGAMPLSTLFPMSSAPITALDAAAVRRAAVAGHTGLTREVVDMAIRPADVTPVAPREMQKMAASLQQASQAKPEGVNVDRNLLDFFQMRGNAKYRKDLMINVALEEAHGAKGLAERVERRMGALGEAEQGLVKRLLNGESPADVMKDARAPKKPTSSLAM

SEQ ID NO: 6880 - protein, 199 aa, Chromobacterium substugae
MPDLSRRGFLRQAGGAFLALSGLSALPDRSDAEALAVREQAGNPFAAIWERPREVVIHRQATGERHRILLWHPQQGWLRDGYVEACNLLRDVVAGEVRQMDLGLLNMLYAIQSWYLANGVYEPLVVTSGYRNPARNRGIEGAAKNSMHTYGKAVDMRVRGLSTAQLWQMSAALRAGGVGYYPGKGFVHIDTGRVRYWQG

SEQ ID NO: 6881 - protein, 72 aa, Chromobacterium substugae
MVVEDELSQTDLQQFFKSLNSAAHDPDGRAVYIPPATPRAGARDGGLEDEEIARLFGVGGNQLFISEQGASE

SEQ ID NO: 6882 - protein, 128 aa, Chromobacterium substugae
MRFFGFIINPLLAPFKTLAAMHRSLMPGARESGGSGWTRPDNHEAVRVTAGKTSRLIWYCTACCPLLAALALLKGLPYLLAYNLMMAAATGVVLALRYALIARQMQTGDLAQSRIGDAFRHGWWFPKS

SEQ ID NO: 6883 - protein, 312 aa, Chromobacterium substugae
MSSFRNAAKSSGQPNGTPLAPAPYRYRKNHVINVPIQSNIHVSNQGAFTLFGGVNVLESRDLALRSAEEYVRVTSKLGIPYVFKGSFDKANRSSIHSYRGPGLEEGMKILQAVKDAFGVPVITDVHEPWQAAAAAEVADVLQLPAFLARQTDLVVALAKTGRVINIKKPQFMSPPQIQNVVEKFVEAGNEQLILCDRGTCLGYDNLVVDMLGFGVMKKVTGNRPVIFDVTHALQQREAGAAASGGRRAQVAELARAGMAVGLAGLFLEAHPDPAQAKCDGPSALPLHLLEPFLADLKALDDLIKSFSPLQVD

SEQ ID NO: 6884 - protein, 327 aa, Chromobacterium substugae
MILKEKAFTEAKDWKQAAGDAAEKEMAFYLRRYFADDQEVYVLNDVRLELDGDAAQMDHVLIHPAGLTIVESKSVSGRLQMKADGQWLRWFDDRSSGMASPIIQARMQSEFLRKYLRSRTAQPEVIDRLAMDVIVSISSKGQFIPPKGIDVPEVCKADQVGERIRAKSQGEVAFPASHRRILGQYLAKMHKPRAEPAPVESAAPMPAAAVAPAKPEAPALQHLAYIGPLLKPAGLLRSLGGGAALRKVYATLCKGCQSQRLEFRYGKFGYYLKCLDCGENTAIRLDCRQCGKQTRLRKQEECLFVECKDCDLSEVLHRNDRPLPELA

SEQ ID NO: 6885 - protein, 234 aa, Chromobacterium substugae
MSDLSAFPITGTWPAKHPDRLQLYSLPTPNGVKVSIMLEEIGLPYEAHLVSFERNEQLSPAFLSLNPNNKIPAILDPDGPGGKPLALFESGAILIYLADKTGKLLPSDPAARYEAIQWLMFQMGGVGPMFGQLGFFHKFAGREYEDKRPRDRYAAESRRLLQVLEGRLDGRAWIMGDEYSIADIAIWPWVRNLVGFYDAGELVGFADFPNVRWTLQAFVERPAVARGLAIPTRD

SEQ ID NO: 6886 - protein, 960 aa, Chromobacterium substugae
MTETAIGAQIRRPLLQGRHWIAGQWLPAGRFDEAARQRRILAGWHAGASAYRFPDGDLLRYAAPVEQLCEQLDGWPLQLLGRALCSAPLTEAEYQQLPPADLWLVTGGRAQALNLADAEALRPGDWLDASAYAVVDMYDCRHTLPRQVEQAPVTEQSLRQLLGGAVPPASPQQLQFLQALDHPRQEASAQPAPQSPWRKRLIVAAVLAACVGLGVLIAAGSDAPAPSYDAGSNAGSSSGGPSHFFPLLALAALAYRFRDRRAPPRQAAPAKPAGKPGKGGATAQALIPARRLAAQAMPQAWRDWLARAAMTSHLSRVLGRRQAAYMREMLAMFETGRINEALRHAIPLGGDGASTGQAFGTPNARRDLSLTPRHGSAGPSIQLGDELNQHLRQLYRRTFDKLDREGKIDQAVFVLAELLQAHAEALDYLERHERFSQAAELALAWDMPAALIVRLMCKAGDLPRALAVARRDHAFAHAIPQLESRWPEATRQLREEWAQSLVEQGRWLEAAQAIWPLASQRERAAQWLAQAEEAGGNLAAEALVQRALLLPDTLRRHESRILAIRDGENQAAERAAIAHALLAAGQHTPASRLLARAMFNHWLVDQDNREGRLSRRQLQTLLNISQDGLLQADLPGKLPAPLPNPLQNQKEVGWLRAPTLAGLAIMDAALLANGRLLVALGEAGAAIVDPRGKIAHRFPAPADSIVLADSGQVALAVIWRGDALRVHRLDLARREQQDLGAVALDCYADSFDGVGWAVGQDRQIRVLDVARGLHSVLWQVGDLPGRVARVMRSPNCEHYELAGDDGKMQLWQYSLPGRRLQSRGHIPVHESAKNATVIPSPWGSYRYCWLAADKNGHPWLGNHPPGQKESFLALPPDMAGGSLNVTLGRGWLAVAMSREAAVCTLLARAGADAPDIAFSWPAGSKVQLKMQNDSWLMFDRQGRIVTMDMERCSISMLTVS

SEQ ID NO: 6887 - protein, 624 aa, Chromobacterium substugae
MQLPDALKPWHDCLSGFSAELAPEVGELLRRLSPALGRFQAAIRGDDEAPQGVDALQRRGPYERLLASEWLLADELPDEFLRRAAGNELLFLAPTPRESRASSRILALFHCGNLQLGAARLAHLALCILLERRASAAGGDFAWGSLQAPGEWREGAQTHALRQLLATRSYRNFNQECSQQWLAALDQLETRPGECWLIGYPLPDKGLAASAFTHQVDIRPTLDGDALDIVVRDRAGQRKLTLPLPPQAAGRALLAGNFDTQTEARQLAGRFSLRHAPLLSPDGSHVAAFLLGEKETLLLHVPKPGRSSRQKPRRVQWSSAGSALGLAFTRKTVGAVAQLGDTLAFSQLPGLGKVQLPPQDMLQLAPGAARLLDAAWLQHDNCARLYARDRVGNLVFWVAPGKRGVHSGPAPGTTHLQLREVLAMCQQDARTLLYVRHQAGQLRLGRLWAEPPSGSTRPAAASSRQGPLGPLDNEWTVPGACAADSEALLGFAQPNLFACAVRQPSALGECWRLHAGRPHAAAASIDYQLPPGWSALGLVPRADASTAFQLVLFHKAQNQLGLLCDGRILILYQPIHPIAKISYAPASAAIALLTEQRELIVYSVTEQCVALRLQGQAAPGEQHD

SEQ ID NO: 6888 - protein, 130 aa, Chromobacterium substugae
MPPQAAVAFDAAAQRLLLRLERMSDERRAPLMATAGPGLLVVIGPEHALPWVDGVEYARADADFSRLWLPALWQPDAPSEALAQALHRRSPHWPQLLWREPARLIPLNRQLPVSAELLADIRRQWRLAPA

SEQ ID NO: 6889 - protein, 376 aa, Chromobacterium substugae
MNVNIMKSPSQQAATQVRAGIRTATRGLVGRDQLAELIMLAAVAQEHLLVVGPPGTAKSAVVRRVAQGMGGRYFEYLLGRFTEPSELFGPVDLRKLREGTVETDTAGMLPEADVVFLDEIFLGSTAILNTLLGVLNERRFRRGHTQMRCPLRVCVGAANALPDDPALAAFGDRFLLHTFVEPVADHQLEDLLAGGWQAEDAAPESAMRLADLDTLCAAVKGVRMDAVRPLLADAIRQLRGAGISLSDRRIVKSQRLIAAAAALAGRDEAGEADLWPLLYVLPTQEAQQTARETLRERLAASANPTLASAVETAAVQPLSRVARLLESAEACLADPDGGAAVEALLREIDANFDAASLPETLANARQELAARLTVAA

SEQ ID NO: 6890 - protein, 331 aa, Chromobacterium substugae
MAVLLAGLAFSSAAAMAAPVALAYYSDYPGNYAALTRYYENFNAVSVDFYNIASDGAISGNGAAPPTQALSFLRSRKIPAYGCVSNVDGDWSPDIAHAVSTTALNQSVANLVKFAQANGFAGINIDFEAVAQGDRNHFSHFIQTLGRALHAKGLKLIVSVPAFSAKDYDDQANYGYDLQALGAAADYLQIMTYDEAIPAWDPGPVAGSGWMEDDLDYATSLVPAAKILSGIPVYGYDWKRAGDGGMLYWKDTQALIARYGAQPRYDAGSNSLTFSYAAADGSRHTVWTENARSVALKAGLVNAYGLGGVSTYALGMENAAFWAAVRQGLSQ

SEQ ID NO: 6891 - protein, 482 aa, Chromobacterium substugae
MTKTTISIQRALCAALCAAALAGCAVGPDYAKPKLDIPASFKEDGRWKTAEPQDAMPRGDWWSVFHDQTLNGLMDTLNRQSPTIAQAEAQYREAQAQLRQAQAGLFPSLSANAAKTRGVSTPGGGAATAYNLGLSASWEVDLWGAVRREVEAGKAKQQASEAQLAAIRLSSQAQLATAYLQLAVADAQLANLRASEKLLADTLQLTRNQYAAGIVGDDAVASAESQWKTSQAATVDKQLTRAQLEHAIAAQLGQAPASFALPPAAQAPYLPQIPAGLPSTLLERRPDIAAAERNMAAANAQIGIAKAAFFPTLSLGASGGYRGSSFADWVSLPNRIWSVGPSLALTLFDSGLRSAQTDQAVASYDASVASYRQTVLSALQGVEDNLSAQSLLEQEAGMQSAALAAAKRAEAISLNQYQAGTVAYLNVLSAQNTRINAENNLWSVKNRQYASSVALIAALGGSWAPPRSHEKNRACARFFHPP

SEQ ID NO: 6892 - protein, 1034 aa, Chromobacterium substugae
MIPSAPFIRRPVATTLLTLAILLAGMLAFKLLPVSPLPQVDFPTISVSAKLPGASPETMAATVATPLERALGRIAGITEMTSTSSLGSSNITLQFDLDRDINGAARDVQAAINAAHSLLPTGMPSNPTYRKVNPADAPIMILALTSDSLTRGQMYDAADSILGQKLSQVDGIGNVVIGGGAQPAVRVEMNPMQLNHYGIGMETVRAAITSTNANRPKGFLENEDKHWQVQANDQAGKASDYLPLIVSYKNGSAVRISDVADVKDSVVDLRNAGMLAKQPAVMLILFRQPGANIIDTVDRVKTLLPKLQASIPAAIKINEVMDRTPTIRASLSEVERSLVISIGLVILVVFLFLRSGRATAIPAITVPVSLVGTFAVMYLAGFSLNNLSLMALTIATGFVVDDTIVVLENISRHIEDGMKPFQAALQGAREVGFTVLSMSISLIAVFIPILLMGGIIGRLFREFAVTLSVAILVSLVVSLTTTPMLCARWLKNHDASRPPGRLFQWSEKVFDAMLDAYRRSLTWALRHSRLMMAILAATIALNVFLYVVIAKGFFPQQDTGRLTGMIKADQSISFQAMQLKLQRFINVVGADPAVDKVVGFTGGGQRNGANMFVSLKPLSERKENADQVIARLRKKLAKEPGAQLFLQSVQDIRIGGRASNAQYQYTLQGDDLNELREWTPKVQLAMSKIPFLADLNSDQEVKGLQTSLVFDRDAMARLGLTQSQVDSVLNDAFGQRQVSTIYNALNQYHVVLEVAPEYWQNPEALRNIYLQTPGGQPTPLSAFASWKPTNTSLSVNHQSQFAATTISFNLPPGISLSDATKAIDAALADTGLPSSIHASFQGTAKSFQASLDSQPMLILAALVAVYIVLGMLYESVVHPITILSTLPSAGVGALLALMATGGEFNIIALIGILLLIGIVKKNAIMMIDFALSAEREHKLPPEEAILQACLLRFRPIMMTTLAALFGALPLALGRGDGAEMRTPLGISIVGGLLLSQLLTLYTTPIVYLYLDRFRLWCLKWRGSLGNALAGGGKE

SEQ ID NO: 6893 - protein, 1033 aa, Chromobacterium substugae
MNPSRPFILRPVATTLLMVAILLTGLVSWRMLPVSALPEVDYPTIQVVTLYPGASPDVMTSSVTAPLERQFGQMPGLSQMSSASSGGASVITLQFSLDLTLDVAEQEVQAAINAAGNLLPADLPSPPIYNKVNPADTPILTIAVSSPTLPLTKLEDMVDTRLAQKLSQVPGVGLVSISGGQRPAVRIQSNPKALAARGLTQEDIRTAIANANVNQAKGSFDGPLQASTVDGNDQLQSAAEYKNVVIAYQNGAPVRVQDVAKVVDSAENVRLAAWAGATPAVILNVQRQPGANVIQVTDRIKALLPQLKTTLPGSVDVAVLSDRTVTIRASVEDVEFELMLAIALVVMVIFVFLRNVPATIIPAVAVPLSLVGTFGVMYLTGFSINNLTLMALTIATGFVVDDAIVMIENIARYIEEGEKPMAAALKGSKQIGFTIISLTISLIAVLIPLLFMGDVVGRLFREFAITLAVSILISAFISLTLTPMMCARLLKHVPEEKQGRFYHASGKFFDDIIARYGKMLSWVLDRQKTTLLVAIGTVALTAALYVWVPKGFFPLQDTGSIQGISEASQSISFSAMADRQEKLASALLKDPAVDSLSSFIGVDGTNTTLNSGRLLINLKPKGERDDIRTVLARLQARADEMPGMSLYLQAVQDLTIDARVSRTQYQFTLQATSQGDLSAWVPKLVHRLQQEPSLADVASDLQDKGLQAYVNINRDTASRLGVTTAAVDNALYDAFGQRLISTIFTQTNQYRVVLEVDPQHQRDPLSLKGIYVPTASGGPVPLDAVATIEERPASLAINHLGQFPTATISFNLKQGASLGEAVDAIRQAEADLGLPASMDTKFQGAAMAFQASLSNTLWLILAAIVTMYIVLGVLYESYIHPITILSTLPSAGIGALLALMVSGTDLSVIAIIGIILLIGIVKKNAIMMIDFALEAEREQGMSPREAIYQACLLRFRPILMTTMAALLGALPLMLGGGMGSELREPLGITMVGGLMVSQVLTLFTTPVIYLAFDRLASRFGRKDKPQPAEEAQA

SEQ ID NO: 6894 - protein, 416 aa, Chromobacterium substugae
MSTPTSAKSNRLPLVIAAIAVIGGGWWWHQHSKSAKDAAANAKGGAPMAVGVTAARTLDAPLQLNALGTVNSTYTVTVRSRVDGQLDKVHFEEGQLVKQGQLLAELDPRPYLAALTQAQGQLLRDQALLQNAQLDLARYRQLLGQNSISKQQVDTQDALVKQYQGTVKLDQGSVDNAKLQLDYSRVTAPVAGRVGLRQVDPGNIVHASDANGVVVITQTQPINVVFAIPEVSLSQVLQAAADNKQLKVEAWDRDNKHKLADGVLLAMDNQLNTSTGTINIKAKFANEKQALFPNQFVNVNLQLGVRKNAIVVPTAAVQLGKAGSYVYTVGSDSTVSISKVAVGPASGDVTIIESGLRAGQQVVIDGVDKLRNGAKVKVIDRAAQSQEAAAAASEGKPHRKHGASGDWGKRHASAAN

SEQ ID NO: 6895 - protein, 125 aa, Chromobacterium substugae
MFCRAGLPRAALADRRARIIKAEKNDIVRSHCLARMRQNMQKTKMSCSQKKQTRPSHPLWPLHPAHAVPRRRQFRLTAAALPVPAISQARRRNQFWERLRPSARISWPCGTAPYAMDKPRRVHEM

SEQ ID NO: 6896 - protein, 510 aa, Chromobacterium substugae
MDMDKKQDAPELRRSLQARHLSMIAIGGSIGTGLFLASGATVAGAGAGGALLAYALVGLMVYFLMTSLGEMAAFMPVSGSFQVYGSRFVDPAFGFAQGWNYWYNWAVTIAVELAAAAIIMHYWYPAVPGVVWSAGFLVLIFALNYFSVKGFGEAEFWCSMLKVATIIAFIVIGFLMIFGIMTEPQPQRIAPGLGVMMQGQGPFVGGLAAFVGVAMVVGFSFQGTELIGVAAGESANPGRTIPRAVRQIFWRILMFYMLSILIIGLILPYNDPLLLKNEMKDVGASPFTLVFNRAGLAFAASLMNAVILSAILSAGNSGMYASTRMLYAMAKNGMAPARFGKLTADGVPRNALYATTLVACLCFLTSLFDSNAVYMWLLNSSGMTGFIAWLGVAISHYRFRRAYVRQGYDLADLPYKAKWFPLGPLFAFALCMLIMLGQNYTAFTAAKVDWNGVVATYVGIPLFLALWWGYRVKHKTRLVPLEQVDLADAHRKARELREEGRGGKLAEAQA

SEQ ID NO: 6897 - protein, 169 aa, Chromobacterium substugae
MTPQQIVGMAARLFALWLVVISFQSLGIASFLGGRPDSGAAAPLLYVMPLLPLLLAAFLWFFPMFIAHKLVPRTHEANALKIPGRELLAAGAAILGLWALLRALPQLLAVLGLLIAADRPALGFYFTPDRRLDLLSCLLEAAFGIFLVARPWWVARRILPEGAPRTDAR

SEQ ID NO: 6898 - protein, 233 aa, Chromobacterium substugae
MPLLSIFLTKFLFVMAALLPIMNPPGLVPIFISMTARNTPQQRRYLARRIALYCALLLVGSMYVGGYVLSFFGVSLPVVQMSGGLLITFAAWRMLNDTPAEASQPSTEPSRGDSQAELKQRAFYPLTFPLTVGPGSISVAITIGATLTGSGKGIVRYAVAPLAGSAAILACSVLVYLCYSHADKLLRYLGQTGSVVFLRLSAFILLCLGVQIMWDGFGELAAQWLRDNAASFH

SEQ ID NO: 6899 - protein, 377 aa, Chromobacterium substugae
MSTSAFFIPSLNLMGAGCLRQAIDAMRGHGFRRALIVTDQGLVKAGLAGKVVDMLAAADIEPTVFDGVHPNPSCANVNAGLALLKEKRCDVVVSLGGGSPHDCAKAIALVAVNGGKIQDYEGVDKSAKPQLPLVAINTTAGTASEMTRFCIITDESRHIKMAIVDKHTTPILSVNDPETMAGMPAALTAATGMDALTHAVEAYVSTIATPITDACALKAVELIAGFLRRAVKDGKDMEAREQMAYAQFLAGMAFNNASLGYVHAMAHQLGGFYDLPHGVCNAVLLPHVQAFNAEAAGGRLGDVAVALGEEARSPEAAIAAIRRLAADVGIPAGLAQLGVKDADIPLLAGNALNDACGLTNPRKASHEEICAIFRAAL

SEQ ID NO: 6900 - protein, 393 aa, Chromobacterium substugae
MSDLQPSSLHPETQAIRAGRTVSEFGEHSQALYLTSSFTYESAAQAAAMFLGEVEGYTYSRFTNPTVAAFQQRLAAMEGGERAIATATGMAAIQAIMMTLLKAGDHIVSSQSLFGSTTNLFAGQLSKFGVATRFVDARDLAAWRAAITPETRLLFLETPSNPLTEVADVAAIAAIAHEHGALLVVDNSFCSPALQQPLALGADLVMHSATKFLDGHGRVMGGAVVGSDALIEQIYLHVRAAGPSLSPFNAWTLLSGMETLHLRMEKHSANALELARWLESLPQVERVYYPGLESHPQHELARRQQKSGGAVVSFVVKGGREAAWRVVDAAQVISRTANLGDVKSTITHPASTTHARVSQEARDRAGIVEGLLRVSVGLENVADLKQDLLRGLD

SEQ ID NO: 6901 - protein, 229 aa, Chromobacterium substugae
MSKTKPQANTIKALENMEASRPDTATRILDVAERLFVEHGFEATSLRMITQQAEVNLAAVNYHFGSKDALFESVFMRRLAPLLEGCLLELDKLEAEEGELPLDQLVLSFIRPCLALSKDPSRGGAMFVRLLSRTLVENHRLLRETISQQYSVFVQRYTSAFQKALPHLEPEQLAWRMHLAFSVMFNAFAGNDVLKIFTRSQIVTARDPDMIVKYLVPFVIAGLVSPVEG

SEQ ID NO: 6902 - protein, 817 aa, Chromobacterium substugae
MIAAILLIALLGALAYFAAPVLAWTVGIAAWLAALQFVFHCPPSVAVWAVFAVVAAVLNIVPLRRAVFTGPVFGIFKKITPAMSQTEQEAINAGTVWWDRDLFSGKPDYQRLLSFPDPKLTAEEQAFIDGPTEQLCGMIDDWKITHELKDLPPEVWQFIKDNGFLGMIVKKKYGGLEFSNYAHAKVVTKIATRGGSAAVSVMVPNSLGPGELLQHYGTEAQKDYYLPRLAKGQEVPCFALTSPYAGSDAGSIPDFGVVCRGSYTHPRTGEHFENVLGVRVSWEKRWITLAPVATILGLAFKMYDPDHLLGDKEDIGITCALVPTEHAGVEIGRRHFPGGAAFMNGPTWGKDVFIPLDWIIGGRDFAGQGWRMLVECLSVGRCISLPAMSVACGKLTTWTTGAYARIRDQFGLPIGKFEGVDEAMARIGGFTYQMEASQDLALTALDNGEKPSVLSAILKYHNTERMRKTLNDAMDVHGGKAVVLGPRNYLARGYQAIPIGITVEGANILTRSMIIYGQGAIRCHPFVLREMKAAMANDGAEFDKAITGHINFVISNKVRAFWLGLTGACFAGSPKGGVTARYYKQTTRLSSAFALLSDMAMFSLGGSLKFREKLSARLGDMLSGLYIATACLKRFERDGAPKEDIAVMSWAVENALYDVQVAMDGFLANLPNRALAWILRRIIFPWGLTLKPASDRVGTKVARALMEPGATRDRLTRGMYVSKDENDAVGVLGHALEAVLATEPVEQKLRKLARDGKFRTITARERLAEALQTGLITQAEFDAVARARKLKRDVIMVDDFDMKLEQHDDKMLQRLIF

SEQ ID NO: 6903 - protein, 125 aa, Chromobacterium substugae
MEQQEQRIPVLRVRALPTSTNAYGRVQAGWLMSQIDMAGSLDAERLSRGPVTTVAVNAFQFAAPIMLGDVVDMYVERLRIGQKSITLKISVEAERMDGSHVRVTEVIATYVAIDRDGKSRLLGQD

SEQ ID NO: 6904 - protein, 493 aa, Chromobacterium substugae
MKLKHLSLSVMIMGTALGLASTQAAASGYQFGSQSVSGQGTAHANGAEANDPSTIFSNPAGLTRLDGTQLSTGVTLVVPHSEYTDNGSKNVLGQPTGGDNGGTFAPKAVAAPTFYLSSKINDRITAGIGMYVPYGAKLDYGFNWAGRYALKSIDLQSLNINPSIAFKLDERNSLGFGISAQYMDATLEQMADATSGLAMKAAAAGGITGPYGPGGATVTLTNPAQISAVMRAGGIGGDGLAHVEGNDWGFGWNIGYMFQLNENTRFGLAYRSTVKQSLQGSSTWTFNNVQGNVTIGGVTLPAAVAAKLAHPDASASVDVSTPETASANFFHQLNPKIALMGDVTWVRNSRLQQIDIKQSTVNGVVQGDLVLHQNWKDTWRVSVGSNYQLSDAWMLRGGLAWEQSPVKSDDQRHPAIPDSDRIWLSLGANFKINKQSSIDMAYSFIDFKSANVNYSDTCNPTGNNGACTGNGGTVNGSYKTYLQLLGLQYNYRF

SEQ ID NO: 6905 - protein, 799 aa, Chromobacterium substugae
MFQQIEETMSQTKFNVRKVAVLGAGVMGAQIAAHLVNAKVPTILFDLPAKEGDKNGIALKAIDGLKKLKPSPLAGSDVVAHIQPANYDDHLHLLKDCDLVIEAIAERMDWKVDLYHKVAPHLGEHTIFATNTSGLSINKLAEGCPDSVRPRFCGVHFFNPPRYMHLVEIIPCVTSDAHILDNLERFLVSTLGKGVVRAKDTPNFVANRIGVFSMLATIANAAKYGIRFDVVDDLTGPRLGRPKSATFRTADVVGLDTFAHVVKTMQDTLPQDPWHGLFQTPDWMQKLIAAGALGAKTKAGIYKKDGKRMLVLDPAKGEYVGSGEKGDDAVKDILKIADPAEKFQKLRDSEHPQAQFLWACFRDVFHYISYHLGDIANCARDVDFAIRWGFGWSAGPFETWQSAGWQQVAKWLQEDVKAGKALTAAELPAWVLESDRAGVHFAEGSFNAADKKLIGRSALDVYQRQLAPAKVLGEAVAPLGETVFENEGVRAFTTGDDVLVVSFKSKAHAIGPAVLEGLNTAIDIAEDRFKGLVIWQTEEPFSVGADLQSMMPAFMMGDWDAIDSMIGRFQTTALRLRYSQIPTVAATQGYVFGGGCEFAMHCDKTVAALESYVGLVEVGVGLLPGGGGCKEFALRASQEARGDVLAALKDYFMNIATAKVATSGVEAQELGFFRKGDPVVFNAYELLYVAKKQALVLAESGYRPPLKVKGFPVAGRSGAASIKGQLVNMLEGNFISQHDFFIASQIADVMTGGDVEAGTLVNEQWILDLERKAFMTLLKNSKTQDRIANMLTTGKPLRN

SEQ ID NO: 6906 - protein, 56 aa, Chromobacterium substugae
MFAHFRFSCRPADPSGRNQPTYHLAIGRACGRIRSERAEVKARSAAVQVVRRASQP

SEQ ID NO: 6907 - protein, 400 aa, Chromobacterium substugae
MSKQVQEAYIVAATRTPVGKAPRGMMRHVRPDDMLAHVITGALAQVPTLDPKLISDCVVGCAFPEAEQGLNMARIGVLLAGLPNTVGGITINRYCSSGINAVQMAADRIRLGEADVVIAAGSESMSLVPMMGNKVSLNPEIFAKDENYGIAYGMGLTAEKVAQQWGVSREDQDAFAVESHRRALAAIDGGKFKSEITPLEVTYRTPNLETGEVVSKTRVLDTDEGPRRETTLEGLAKLKTVFDAKGSVTAGNSSQMSDGAGAVILVSERVLKEFNLVPLARYVTFSVKGVPPEIMGIGPKEAIPAALAQAGLKQDDLKWIELNEAFAAQALAVARDLELDMSKVNPHGGAIALGHPLGATGAIRTATLVHGMRDAGLKGHGMVTMCIGTGMGAAGIIEVL

SEQ ID NO: 6908 - protein, 363 aa, Chromobacterium substugae
MTNKTLFRIAAAALLAGAACANAASAAQPANPQTARFAPLYYGQTLWIMLGSPVPDGWVITRSSGNQNEITDTHGASYTQQLSVMLGSPIPKDWVVIRSTGTTNVIYYSKGASLGTEIAVMLGSPTPDGWVIVRGDGKMNVLHNLNGSSYGSEITVMLGSPIPADWVVVRANGNSNVIRYTKGAAPGTEISVMLGSPIPDGWAIVRGDGNMNTLRNLNGSSYGNEITVMLGSPIPADWVVVRANGNSNVIRYTKGAAPGTEISVMLGSPIPDGWAIVRGDGNMNTLRNLNGSSYGNEITVMLGSPIPADWVVVRANGNSNVIRYTKGAAPGTEITVMLGSPIPAGWVVVRSSGNMNVIRYMGR

SEQ ID NO: 6909 - protein, 628 aa, Chromobacterium substugae
MKIAHKAGLISALVLAVTVSTLSWIQYRSIADSVRRDKQQEIAQTGQVLAAQIENWLNGKLKQIDLMAQLIDSGFSAERIQEVFDRPQHKQEFLLIFGGLDTDGKRITNDPKWNPPPDWDARKRPWYPVAKNANGAALTDPYPDAASGEILISAVAKLTDKGAVKGAFGGDLSLKTVSEALNTVNFNGAGYAFLLSADGKIISHPDGKLNGKSVADLFGGQAPALSKDLQDIDVNGKKLMVAFQPLDKLQNAKWLVGIVLDTDKVMANVRSLGQQAMIGAVIGVILSMLALSSLMGRLMQAPLLQLKSSLAQINSGNGDLTRRIDDSASDEFGEVAHELNTFLAYLQQLVGDIQRISHSVHDSTEQSANEARQSRNEAARLQQELDGLASAIQEMADTTGEINNNASAVAAAAKQAHEETDGRVKQVAQSAQSICKLAQTMEETSQSMGELAAFSKNIESIVQVITGVAEQTNLLALNAAIEAARAGELGRGFAVVADEVRKLASQTQSATQEIRSTIEQLQRGVGQAHQKMEESRERAGHTVAEAEQTSEMLLRIQDVIADINRKNSEIASTIQRQSGMAQDISHSAGNIQQIGQQVADVAEVQLQHCNETSEKVARQDTLISRFRI

SEQ ID NO: 6910 - protein, 75 aa, Chromobacterium substugae
MLDSGKLTPEEYQNMAAVLHIRPLNQNLGYPVPARFNLLSGIQALIGNSRMICRHDQVRAETHGLQVLKAYQAHA

SEQ ID NO: 6911 - protein, 54 aa, Chromobacterium substugae
MLTPALSAKPVASAPRIADAAQASGFVRMLTEAQSDAPAPKAAGKLNLENLSTD

SEQ ID NO: 6912 - protein, 119 aa, Chromobacterium substugae
MEPNRTPYTLDLLSDELDMVIRALKSGQPTLWEAKQLTQRYREVFIDQTRDLLPAHEGCEQTVAGRLLVVQELELALDRFREIGVSPKTRMRDVPCLDTALRYSLDEAAAGRPGGISFR

SEQ ID NO: 6913 - protein, 156 aa, Chromobacterium substugae
MAGVELPDDVICLGGEPESIVSIRCRKVASRGTITLAGAGGNCGQIAAPGGGLLLAQPESSSMASQSGLQFELSIFQILFVGGRRGRIIYCRLVLARPGRLGGRCLLLGLAGARHRGVALGDHGPHFPAQRQQGDDHHQQQRLAPVFQQRQHQQGS

SEQ ID NO: 6914 - protein, 144 aa, Chromobacterium substugae
MKTNAEGIALIQQFEGLRLQAYQDVVGVWTIGYGHTGPDVRAGLTITQAQATQLLAADLARFEAGVGRLVSVPLNGNQFSALVSFTYNLGLGSLQSSTLLRLLNTGDYAGAAGQFPRWDRAGGQQLPGLLKRRLAEQALFQEPC

SEQ ID NO: 6915 - protein, 64 aa, Chromobacterium substugae
MLTDDDGQLEPAYIWGGVATAIGLGLQVYCTIQGKPFDLQGYGIGAGALIAGLGVGKKMGAKPQ

SEQ ID NO: 6916 - protein, 204 aa, Chromobacterium substugae
MTEKQHLAVAGAPANEHAHHDTLAEDVFYPDHPPRTESATFRHTKAAGHAARLPCAISGHTEGAEYHHLLCEWAFSGAVDWRTVRGVALGEITQLPVLDLLTDQPIPGQFFSAEHSLLWALCKLAEAKGFDWRAFDPARPELFVDSMANMLVLHSKFHRHRDHGIHEMSLPEWIFQAFPRVKGFVFTPDEMPAPPAFPHDLKAA

SEQ ID NO: 6917 - protein, 90 aa, Chromobacterium substugae
MSQAELMLTALTGVLSLFSAALGWWLISLHNRHERLRADHEDLRVRVADEYCRRVDLRDMVDDMKQDIHQAIAALREDMRASMSRMNAGR

SEQ ID NO: 6918 - protein, 184 aa, Chromobacterium substugae
MIYYAKSTGGFYDPEIHGAAMPSDAVQITDAQHEALLAGQAAGQIITSDSGGNPVLTAPPAPTLAQVQAAQVAQLQAGCQAAITAGFTSSALGAPHQYPSQPTDQANLASDVAAAPTAPAGWTSGIWCAANGAWSLQQHTAAQLAQVNADWVAARGALQQKYANLMIKVQAATTVAAVQAITWS

SEQ ID NO: 6919 - protein, 427 aa, Chromobacterium substugae
MYQYDDPTAVSQMPPPGAAGTAGYFTDGNPASGQPATLLRADFMNTLMMELVNAIQAGGLVPTKGKNNQLAQVLGGLAPVGINVQFIQKSGPVKLPAHSFFEFNGTVDCTATLPDPTQSIPVLAYFWNGSTSNQLTLATAVGAFFGQGIPANGATFNLPPGYGALVCGDTHNYIVLLSCYSKNPPVGDSSNLNATTNWTQNTLSAAISALNLGQYATSNALANAVAPLAQASRIGSNAGAVLYQAAATQPLSDIGKLVELSGSFTLNTPSFNGVPAGAAMEYINTGNGPVTISGNGASFFYNSASVASVTLQSGQSARCVFDGTSIVVTGGFGAASIGSNGYQKLPSGLIFQWGAASVASASDTLVTLPIAFPNQLGQVLLGEAYNLGSSVAIYGSWSINTASPKTSFYLRNSSASGNAVSWFAIGN

SEQ ID NO: 6920 - protein, 198 aa, Chromobacterium substugae
MPLPNYTALDYQGALQRLLPRGRVWPREPDAVQSKVALALAQVYGRTHARANNLLVDAFPATAYELLPEWESTLGLPDPVLGPATTLQGRRGQVVAQLTAVGGQSAAYFVQVAARLGYTISITNFAPFRMGQSAMGGQLGGPEWAHTWAVHAPLETVISWRMGQSAMGEPLNSWGNAPLQQVLSRLVPAHAILQFNYA

SEQ ID NO: 6921 - protein, 378 aa, Chromobacterium substugae
MPYATPTLTALRQQVAQDIAANVPGGDGLLRFSNLGVMASAQAAMAYGHYDYIDFVAKQSTPWTATGEFLQGWGAMKGVYIKPATPAAGAATFPGQVNAQLPSGALITRGDGQQYIVTAAGVVGANSSVTVPISAVPDPIGLVGAAGNSPAGTVLSLAQSLPGIQASGVAATALTGGADLEGDEPYRSRVLSAFQSTPQGGAQKDYITWAMAVPGVSRAWCAPNGFGPGTVVVYVMLDGAESANGGFPVGSNGVSQFDQGPGGVPRGVVATGDQLTVANAIAPLQPVTALVYVVSPISNPVPFTIKGVPVASQAAVALAIAGVFFQYGQPGGSISLQLIWSAIATVAGVSDFIVVSPSGADITSPTGYLPVLGPITWQ

SEQ ID NO: 6922 - protein, 145 aa, Chromobacterium substugae
MDISTVWVAGTHGDWVLAGSELLAGNDLQSAILLSLGTDREAGPDDVIPDGSGDPRGWCLDDTARPIGSRLWLLARAKQTRETANRARDYIAEALQWLIDDGVVAKFDITTQWVAPSTLGAQVVSYSTAGARSAVQFKWAWNGVN

SEQ ID NO: 6923 - protein, 202 aa, Chromobacterium substugae
MIQQIERLARRVWMLLGRGRITAPASDGGPVQVLQVQMGRDETRDHLRRLADYGFTSHPPVGSDAVVLFPLGDRNNGVVVATNHQGSRMTGLKPGEVAIFDNRGQSVYLTAGGIVVNGAGLPLTVNNTPTVTVNASAGVKLNTPELDVSGLIKAGGDIIDNAGSNAHSMAQMRGIFNGHNHAVQGVQGGSSTVTTQQPNQQE

SEQ ID NO: 6924 - protein, 361 aa, Chromobacterium substugae
MDDLTLVTNGQRISGWTTVNVVRGIERFPSGFQIGMTEHYPKEFGRFLLNPGDPVQVLLGSDIVVTGYVDDFTPALSSGAHSIAVSGRGKCQDLVDCSHFFNGCQMTNITPLAMAIQLATPYGIDVVSDVGAGEVVPVWQLPWGETPYNILEPVARNSQMLVYENPDGSLRLSQAMRASAGVRYPVVAEGVNIESITMRWSMAQRFSQYIGRSLPMDMMSDVGVGPDVVAVVNDPGVPRLRVRSIIAETGDTSDFQITKARVNWEAVRRAGRSSQANVTVDSWRDEAGNLWQPNTLVTLVAPTVHVPRANWLISEVAYRRDETGTHADLTLMPPEAFAVQPVNLFPTMRDVVAGAAQGGNG

SEQ ID NO: 6925 - protein, 104 aa, Chromobacterium substugae
MIGFLLVMVMSDGWQGGVVPQGIYKTAEDCLQAGPRWVLHNNNIGHPSTFYCQKKAVPKGQQWSEAGITPQMREKWAKQQAEKYKNITYTMPEDPFSASTEPAH

SEQ ID NO: 6926 - protein, 480 aa, Chromobacterium substugae
MSFQDVLNTATRTAGALDGVVSAAGQLTDALGLGGATFWDQLRPASYRGIPFAVLASDGEFGRRLAEHEYPNRDVLWVEDMGRRGRRINLIGFLVGDDVISQMQQMIAAAEQEGRGELVHPTLGTLYVSLGPMRVSERWDQGRYVELSMQFVESGDREFPDEQQDTSSWLSNLADEAGLSVEADFVAGLIGQVKQGVAVVQSVVSTAAQWASRINQVVSAAKGIYNSVAGVAGQLQTLDSFANRYGDPRGVAAPSTPTPSPTRRAVAASAIQRQAVTASAAAVSAAAGQLGAQAAAIQPLPAAVSQSVAALVAASASPMDAINALTALSQLPMPQGVDTSPMGVAMTTAQQQTVAMMRRAAVIGVCRAVSAYQPTSYDDAASLRSRVSQLVEREAVAAADAGSMASYQALRDLRTAVVADLTARGGSLARMMPVSIPQPMPSMVLAQRLYRDPSRAGELAQQAGAIHPLFMPTQFNALAQ

SEQ ID NO: 6927 - protein, 247 aa, Chromobacterium substugae
MNLVTMNGQPMTMSSREIAELCEKEHKNVIRDIRVMLDELGGGSDLSHVQESKDLRGYTSSISLPKDLTLTLIAGYNVRLRKRIIDRWMELEQKVAAPVLPDFQDPVAAARAWADQLEGRQIAEQQKVLLEHKVAEQAPKVQFHDDVANTINCQTMDEVAKELGTGRNRLYAFLREKGVLMQSNEPYQRFIDQGYFRVIPSPWRKRGELQMGQKTVVTGKGMTYIHRLINNLAVELPANDRLAERSA

SEQ ID NO: 6928 - protein, 79 aa, Chromobacterium substugae
MKSSTLTSPVQVLADSVESLDLITVQLDDLRTLMSAIARLSADDADIRGIAIHAKGIAGGLHNDADVLREQIQNHILAA

SEQ ID NO: 6929 - protein, 171 aa, Chromobacterium substugae
MNELIVSNFNDFVMLAGDKIVTDSRRVAKAFGKRHDNVLRAVRQLAAESGAWGLLNFEEATYLDEQNGQRYDCYQMTKDGFVLLVMGFTGRKALDVKIGYINAFNAMAEQLKRRDLGLWQQMQELIAREVESKVRASFGSRLMLERKREIPRLESERFLLEGAIQPSLLLN

SEQ ID NO: 6930 - protein, 54 aa, Chromobacterium substugae
MKKALLLIAALSLALPAVSFAGKHGGGHYAGGKGSSHKGGHYKNKATNDHYRKR

SEQ ID NO: 6931 - protein, 722 aa, Chromobacterium substugae
MAAADNQFRIRITAQDQAGPIVQKLEARLGKFATRLALGKKVDDLSKSQLEQRVTQRFDGLAKKIQGIGTALGSTASNLSAPVSAIAGGAIIAGITASATSWASYGNSVLRTAQMTGVGTDELQKLRGAAKLAGVEAEQLDGGISALGSTLNDAANGRNMAALAMLNRLGISIHRTKDGAVDTSAALKDLAQVMVSPKMSAQTKSMIAGQFGVQGLMPMLMDGRKKLEDDMAKTKAMGAVQTPEQLKAADQAKRHEREAGLGHQRASNWLGDFVGPIYSKLMESAAKMLSEHPGATLAGGAAVGLGGSWLLRKGLSAISNRMIESVVKQVSQELAGGAAKVAGQAAASEAAAAASAGVKQLSRVTLPFFGELASRLSLGLGLLLESPELNRGENEFVRAQQQRNGTASSRWHGLDMNGKAFADLKDKAKAAYQPWYEFGDENALQYMSRYIKENPQAKPTGWTDAAQAAPAAGQRLAQAAQSELPQKAQSAKALPRGVRNNNPGNLQFVGQAGAVKEAGAGGRFAVFDTPEAGLNAMAKQLKRYSNSGLTSVQSIIQKWAPKSENNTAAYVAAVAKRMGVDSNQRLNLGSTDVMRSLMDAMIVRENGHNPYSAQMLDASAAVGVNYKGKSRAAGTVSPRSASAPSSAATRSESSSVALDPAQKMLIDQLRSLQDAVAKLSDAKIHIAVSGLPAGARATASGGQATVSSASKYNYSMPEMISP

SEQ ID NO: 6932 - protein, 91 aa, Chromobacterium substugae
MSEAQKTEVADELTLELRKPVGLGDEQFHVLELREPLVDELEKFHEQLEKKTPIFATKFLISLVSGVPVAAIGRLGARDFKAAEAYLANFF

SEQ ID NO: 6933 - protein, 123 aa, Chromobacterium substugae
MAVDNTYLLAGTCQLSVNGTSYMVAGDFGYSPAKVKRETKAGRDGVHGYSETPIPGFIKAKLRDSGNLTVAELSTMTNVTVTLQLANGKTVVGRNMWTVESPEVDSVEAEIDVRWEGMSVEEA

SEQ ID NO: 6934 - protein, 498 aa, Chromobacterium substugae
MTIPFKTIPQALRVGLFYAEMDNSRANTAQASQRALIIGQATAAAIVMGTVPNVPVISQGVADAQTVGGPNSMLALLTAWYRKNDQFGEVWYLPLADDPGATPAAGSITIASAPTAAGTFYLYVAGIRYAIPVLPTQQPAQIAAYIASVLSADAGCPLLATNAANSAVVTLTAVNKGPCGNDIDLRLNYLGPTGGETMPAGLGVQIAAMSGGATAPSLATALANLGDQPFDFIVCPFNDTTSLNALQQFMNDQTGRWSYAKQLYGHVFTALRGTLGALTTFGVTRNNQHETVMGFYDSPTPAWLWAAATAAATAVSVRADPAQPLQTVPLIGVLAPPVQSRFQLTDRNTLLYDGISTFTVAQDGTVAIENLITTYQKNAFGNADNSYLEVETMFTLAYVVRFLRTRVTSKFARVKLAADGTKFAPGSNIVTPSTIRGELVAAYGELEHAGIVQKSAAFKAALIVELDASNPGRVNVLFAPTLVNQLRIFALLNQFRLM

SEQ ID NO: 6935 - protein, 63 aa, Chromobacterium substugae
MYVKPKAGFAIRDPDLLDLLPAAGREVPDTDYWLRRLRDGDVEQVALAVSVDATDTAKKGGDK

SEQ ID NO: 6936 - protein, 178 aa, Chromobacterium substugae
MLFRTQLRSAVVAALQAANTLAGQKVYVPRDLPTTPPGMPLILVQTPMERKQGRGPLGAPQFLTTATVAVNARVVGASAGEAESLLDTLCDQIENAVLTNYTVLRMVQQVLAVETEIEVTGQQREHLGEAWLRFDFEYPEVFEPSINQPLIDVHGAVSATVGTASAPPVEFDFSIHQE

SEQ ID NO: 6937 - protein, 108 aa, Chromobacterium substugae
MIDWDAAVLAPLEGVFGEPVTYTTTTGQSISISGVFDEAYRAVDGLGGSIYTSTSQPVLGIRAAALPFPPQSGDVVAILRTGIVYSVADVHPDGHGAIKLMLNYVSGG

SEQ ID NO: 6938 - protein, 348 aa, Chromobacterium substugae
MPANILDIFHQDAFSAITLTDAVQRNPYQPNGLGELNIFDPNPIRTKALAVEERQGKLVLIPFSERGGEGTQRTTEKRKMRYFDVPRLMHDDTVYAEELQGIREFGQESVLMQVMEEVERRLSGPTGLLASVEYTKEYLRLAAVQGLCLNPGDGSVLYNWFDEFGIKQAPEVGFNLAAGVANTLRPICNGITRAMARAAQGSFTSSTRVHALCGDGFYDLFSNHPDVIRTFLNWSDAAELRNNGQGGAFDSFEFGGIRWWNYRGSDDNATIKIPDDKVKFFPVGAPGIFREANAPGETVDWVNTPGKPVYVLPIFDTVRRMWWKMETYSYPLFICTRPEVLMSGRAES

SEQ ID NO: 6939 - protein, 185 aa, Chromobacterium substugae
MVLAGTVLGQISASNAAPVASAAAGAANVGNGTLTIGTQPQAGFTPAGLFTITLTAPTVFSITGPGNFNNVDLPVGTALDADGMVFTVAAGSTPFAVGDSFTITVTSPGTAGQWRPLNPAATDGSQVAAGVLFASKDVTTGPKPALAVTRLAEVNGSELLWPPGITPAQQAVAISQLAQPHILVR

SEQ ID NO: 6940 - protein, 224 aa, Chromobacterium substugae
MSFLSSLSGKLSFAHLAGVSGSRGSRADSGQDDDDDGKRSRRAEDDDLDDDDRKNSRRAEGDDPDDDDDDGKRSRRAEGDDPDDDDRDGGKGKRGKKAKRAEEPDADEDEDRDNDPDAEDDEDEMHGKSACARARRRERARCAAIFGSKAAARNPVLAANLAFNSSMTRSEALAVLRDTPAGAPAGNAGRAARNPQLGATDGVPPSGKAQQASAWDKVFAKARR

SEQ ID NO: 6941 - protein, 287 aa, Chromobacterium substugae
MINYPHLAQRLFNVPLAITPQKAEVVMAALADRFGLARLFHANGRVVALDDWDGDVGAPAETKPYQVVAGVAVIPVSGTLVQKLGTMQPYSGMTGYDGIRANLSLALADDSVHGIVFDIDSPGGEVAGCFDLADAIYAARGEKPIWSILTENAYSAAYALASATDRIIVPRTGGTGSVGVICMHVDMSKALGAAGVNVTIIHYGDKKANGSDVRPLSSEALADFQADVDEMGELFVDTVARNRGISARAVRSTQAGTFMGAAGVKIGFADAVMAPDAAFRSLLAKLG

SEQ ID NO: 6942 - protein, 547 aa, Chromobacterium substugae
MLGSDGRPLPPARASFGDSTVRTEGLPLAGSSVFPYDASSWSTQEMGDWLPFIRSPDAEINQFRDRMVARSRDLVRNDGLAQGAVTRILDNTVGVSMRLSSMPDYRALATMTGIREFDAVWANEFQQVVEALWRGFADDIGRYNDLSRQLTVSQQLRLGLRHKLVDGDSLIVNYWKPDRVYPGAARYATCYLVVDPDRLSNPWQMVDTKYLRNGVEIDDDGVPIAYHIRKAHQNDWYNAIESNEWERIEREDDDGWVRVIHDFERDRAGQNRGIGIFTSVLSRFKMLARYYGVELQAATIASSFGTYITSPFDSAQVEEAINGSDELSAYQDLRADFHEARPVMLNGARIPTLAPGESIETVAAAHPHSGFGEFVRAMQLTFAAASGISAEQITQDWSRTNYSSARAALLESWKTLERRRAEFKIGTASPMYATWLHEAMDNGDLPLPRNAPDFLEFRTQYARCEWLSVGRGWVDPVKEPQGSVLKMDAGLSTLKRECAEQGLDYEEAIDQRALEVRKFKEAGLKLPDWYGAPATEASTPEESPTPQ

SEQ ID NO: 6943 - protein, 84 aa, Chromobacterium substugae
MFTPQTNNFTGIPQATLQQWLTEAQLALHRLSTGGLGESYSYTQGDGTKSVTYTRANLAQLQQHINSLMYALGMRRRRPIRPVF

SEQ ID NO: 6944 - protein, 679 aa, Chromobacterium substugae
MTLRGTSAKAELLRASFVRGWTPPPRISVPTWADRYRKLAREAGSTSGNWETATVEVARGPMLAVTEPGVHIITTMCCTQLMKTALIENVFGYFAHLDPCPILLLQPKDEAAEQFSKERISPLIRVTPALRDLIGSSKTRNADETLLYKSFPGGFLALAGAGSPDNLARRPIRVLLSDEVDKYPVTREGDPITLAEERTATFGVNWLSVRACSPTLEDESRIADSYGESDQRRASVECPHCGERVFLDFFKHVNWDKPDGRHDPKTARIYCDCCGSGWSEGERLRALRTTRWHQTRPFDCCGHRHSPLDLYEQAKQAGGDSVAAVWDWWDGERHAVYRAKCPECGEWGVDNSHAGYQASKLFSPWQKDKPADIARKYLAAKGDADKEQAWWNTQMGLPHRPHSGKELRLESLVARCEVWPGEVPDGVAVLTVGIDVQDYRLEMEVVGWGRNEESWSIDYHVIDGEMSEPETQKQLDEYLKRIWRRDDGRGFSAMAACIDSGGHHTQAVYEFAKARLGRKVWAIKGESARSGQRNPVWPTKRPRSRTKATFRPIILGVNAAKDTIRNRLHLEVPGPGYMHFPTDRDINYFAQITAERIVVKETGGVRYRVWEQPSGKANEASDCRVYAYGALCGLLHFGLKLNQLSTSTAVKVEQAAHSNALPEEAKLPAAKRSLVRRMA

SEQ ID NO: 6945 - protein, 106 aa, Chromobacterium substugae
MIAGGAVPDRDYAEALRIKENYLALLRQLEYEQKSGQLIEIEVAKGVLFECARAARDAWLNWPARVGPLVAADLGLEADRVTEVLTEHAHKHIQQLGDPEGDFGQG

SEQ ID NO: 6946 - protein, 207 aa, Chromobacterium substugae
MQRDQLPFATAQALTVVAKTVQAAESKQIASKFKNPTPFTRNSVGVRAARKSNQEAMVFIKDQAARYLAPYESGGEHVLNSKALLNPKDIKKNAYGQLSRGTLARLRARPDIFIGKVKTRRGIVDGVWQRPVDPRRVTLLNGKRKKLRGLNEVMDDKRGHLKLLIRFGDALPVDIHLGYHELAIAQVNRHFNREMGHALARALASAR

SEQ ID NO: 6947 - protein, 74 aa, Chromobacterium substugae
MDLLDVTPFVLSFIRLGALLLIACAVGAFAAFYVDHRMALMEYPMHMRKRYRTLAFEFSTLAVVVLGSLETFLG

SEQ ID NO: 6948 - protein, 66 aa, Chromobacterium substugae
MHMEHARAVLDACHLREGQHVLMASGRAARVGEIGPTTIRFDYFERLSKEDYIIIPRHRVPEMVRV

SEQ ID NO: 6949 - protein, 53 aa, Chromobacterium substugae
MSANHTYEQIASDFQLWGEYFDTAAEMTEEEFNAMSTEDKVALQVQAFGPENE

SEQ ID NO: 6950 - protein, 162 aa, Chromobacterium substugae
MQFSTVRALVGWAFQIETTSMVKVQKFGEAVAPAFDGLSPHDLKAQSAMVMAKISRLPFEQRAVLWALHVQRETEMVYLTTHTPGKYGYKTDLDIIRTWATGEGPGCRDLGDRHGLSHMTLHRYGKGVVAQLERMMNQAYAALEGPMAEVLDRLCYVERRTA

SEQ ID NO: 6951 - protein, 147 aa, Chromobacterium substugae
MTAIRFTVPGTPVGKGRPKVSTRGGKFARMYTPEKTASYEGMIALAAQAAMAGRAPLTGPADVTIHMVLPIPTSWSKRKQAAALTNQVYPTKKPDADNVVKALFDGMNGVVWVDDVQACDIVVRKRYGATPGVTVQVQEIQGALFAA

SEQ ID NO: 6952 - protein, 39 aa, Chromobacterium substugae
MKRISTWRRAIAGALLVAALLATSPLWLLALIQLKLGAQ

SEQ ID NO: 6953 - protein, 185 aa, Chromobacterium substugae
MNDIFRSLRGRFGNAFVDKFRSGERVPKDQGLPYEGMDIGLLEAIDVWVHELRNLSPADIRHGLESKFRYPPSADEFVQACCSRDYAPPASDSYDALPAPTMSREEAEVHIAQVHQAAKGMQFPSGHGQRMDNWLKIADEVARGVYKGGTIGKRYAAEALAKAGRPVPEALQAYLPKTNPMEDAA

SEQ ID NO: 6954 - protein, 85 aa, Chromobacterium substugae
MERFIAHHQAARSLRADDTAWQAQYRKWLLDQRQFNADRNRVTDAKVQAAQKSGNTIHDQRAAAMDTIGVGQQYLTGGKHAALAS

SEQ ID NO: 6955 - protein, 40 aa, Chromobacterium substugae
MVFRPGDTQAKLMAYTLPGARKLKPATIETVAGRRRLKQV

SEQ ID NO: 6956 - protein, 139 aa, Chromobacterium substugae
MNWRDAAHKTVHSAGGSKVIAERMGGYAGVIRAKANPDDNSRWFDMQEMVELMSLTNDHRMLEALADEFGYMLTSVPEEIDSADRGLMQMISDSLKGHDGEAEKRRGLAQLKGHAGAALRRKINKLQSFLADLAQLTDD

SEQ ID NO: 6957 - protein, 37 aa, Chromobacterium substugae
MEASSVEELIRQIKAKGPDAVLEVIKGLADNSDKFTN

SEQ ID NO: 6958 - protein, 251 aa, Chromobacterium substugae
MTKSISNLPEVLELFQTKPGSAVYLTAVMRRMLLKVRTQQDLHAALAMIKVISDAPTILVAFCADSGLQPSTTMNLGWSEGWLSRYAARAYHEVDPIASALPGVAVPWSHHLIGKVSPNEKFRAYLRDCSRFGMDYGMSYVAEYNDCRIVLSMIGKHVEQDLELRHTLELLCPDVTDVAYRVLAGQRATSKLEKNQQILIDLICNQGLKKTEVAAALGMTNRGVDYHLKQLMTLYGARTVEQLMYRFGACE

SEQ ID NO: 6959 - protein, 99 aa, Chromobacterium substugae
MARKWSQTTLARKVGVSRGTISDLENDNVQGTTHILDLAKALNLTPQYIEDGKGSRRPEPTASAPYVAASSLEDLAEKLLDKGPDEVWQLIQLLLTTKR

SEQ ID NO: 6960 - protein, 41 aa, Chromobacterium substugae
MTAANNPLYYAGDAAALDPAGCRLVTMLLVLGEWAFWWVGS

SEQ ID NO: 6961 - protein, 83 aa, Chromobacterium substugae
MIAHASAAPAAAQITVHTCQLQAANSASYATRRLSGYRVDYQQPRTRRRAGLIVLARSMGEALDRVDGLMPGYVMSGWGRARK

SEQ ID NO: 6962 - protein, 38 aa, Chromobacterium substugae
MGEGAEVKAFIKNTLGGLLMVALFFSALTLAQIAEQLK

SEQ ID NO: 6963 - protein, 126 aa, Chromobacterium substugae
MSLQNLSCAVLNDLCRHLSSADRDERLVLAVEHEADLMLSDIECSRGMGESFMDMLLSGAPAELMGELHLYLGQQLLRRVFDRTDLGPHYDQLARAARAFVDASAAATLDRRVESDDPEEDEREAA

SEQ ID NO: 6964 - protein, 56 aa, Chromobacterium substugae
MSRLEQSIIHARNTAEQRDQLLAALERAVAEAVADDLDDWFANAKAAIAAVKGPAA

SEQ ID NO: 6965 - protein, 65 aa, Chromobacterium substugae
MSATTTLSSILYAQRRLSNEIELFGSLPRTQQQLTPEQKRRRDDAWQRRMARELAGEDPINDKAA

SEQ ID NO: 6966 - protein, 312 aa, Chromobacterium substugae
MTATSREEWLALRNTGIGGSDAGTVLNVNPYKTPLQLYLEKRGEIEPDDISEKEAVHFGNVLEDIVAQEYSRRTGRRVERCTTTLRHPKHPFMLGNLDRLVWEGDKRPQHRGEIRTRHLLECKTALGRFIDKSAWGPDGSDEVPMTYMAQCQHYLAVTDAEQIDLAVLLSGPEFRIYPIKRDDELITAMIEQEGEFWERVQSGSAPEMDYDHDTTPDLLAKLYPGTDGSEIVLPDSALHWQQVLAEAKEQVKLYDSIATGAKNHLLHLMGNAAIGKLPDGSQFTRKAITRGAYTVDPVTYIDFRFKKAKEAA

SEQ ID NO: 6967 - protein, 374 aa, Chromobacterium substugae
MSAIIEHESITDVPAYHGHQTSTTALVLDDGSIDRMMRLAEIMASGKATIPQHLRNNSGDCLAVVMQSMQWRMNPFAVAQKTHLVNGTLGYEAQLVAAVINTSGVTTGRFHFEWFGDWTKVIGKFDIRKGDKGEYRVPGWKLADEEGLGVRVWATLKGETEPRVLELLLAQARTRNSTLWADDPKQQLAYLSQKRWSRLYASDVLLGVYTPDELEVVAPEERDITPRANSAPAAAASSSRASQLKQKLGAKPVPTALPGPSLDDVLRAISTAGGKAQMQAAKELASKLGEQEYAVAAEHYQLRVEELRAQAAAQVPAGQASGFDLTGFKTRIANCKDVDTLDLLADEFSSIADGADFEELSQMYQARRGALVGE

SEQ ID NO: 6968 - protein, 306 aa, Chromobacterium substugae
MAWFKQLSFYRLADTVDQSTLSAALERRPFQPCMGLDWFSEGWVAPAGHLDAPVYAERGNLLLALRREDKVLPASVIRDYVDAKVAEVEARELRKVGRKEKLALKEQLTDDLLPRAFVRSGRTLAYIDNNRQWLMVESATASKAEALVSKLREALPPFPAALPRTKIAPHAAMTDWLAIGEAPDGFELDADAVLRDSSENGAQVRVSRIDLTADEIRQHIATGKHASMLGLIWNDKIRFQLTDSLQLKRIQFLDVLQEEASQAGDDRESLFAATFLLMSEELGELVSALVEALGGLEESQQHKEAA

SEQ ID NO: 6969 - protein, 146 aa, Chromobacterium substugae
MEHTFKHLVLYEERHSDGAVITDENGFKVVEANSMAVLLDWDTKLGIGHWADDPRASMELTEEQQAANARRIVACVNACAGLPDALVSHGLVPASRHSTVAQQRDQLLAALEAVCDSFQHVPLGPGALQDLFRARAAIAACKESAT

SEQ ID NO: 6970 - protein, 66 aa, Chromobacterium substugae
MAAVLGAQRRYSATIKGLGLRYLWQIADDAGNRVTLLEIDQRHMEAKDKKEPLTIKRLGFDSVEIV

SEQ ID NO: 6971 - protein, 83 aa, Chromobacterium substugae
MNTHISTMRYAMQIAVLAQLLEQRERQIEQLATVIAIKDEQLATQNSAAMEYVARCDELEARNSELARQRDLLALEAQERRAA

SEQ ID NO: 6972 - protein, 43 aa, Chromobacterium substugae
MSYQTYGEDYHVTPRPDPLPAAAGKADEPRYPDDGVESDGGEL

SEQ ID NO: 6973 - protein, 130 aa, Chromobacterium substugae
MSEITNPYEQVELAAEAAGYLGALDEGSGERQWLADHCTGDEFDPRESFEDAVRLICTLGLLVEVDRGAGVVTVVIGADHVVDHCTMTERFDPDGRFDMDAPASPEYALKLAVTRAAAEIGKCKVMGTAA

SEQ ID NO: 6974 - protein, 131 aa, Chromobacterium substugae
MQGDGDRRMTCPYDSWLPDQPAPMPAAPELYRPSSGQAGEWFISEWCAHCERDKCQNGSKPMDECGQDDLCQILGRTMFLDVDDPDYPREWIDDPEHGPRCTAFVEIGQPLPPARDTQTIDMFQLPDQGEE

SEQ ID NO: 6975 - protein, 262 aa, Chromobacterium substugae
MQFFPPHQTYVEPFGGAAGVLLQKPRSYAEIYNDLDGDVSNFFRVLRNPLQRAMLIEAVTLTPYSRAEFEQAWEPATDPIERARRLSIRAQMGFGSAGATKGTTGFRIDSRREYGTAQHLWAYYPDQLANAGQRLAGVLIENASAIDVMHQHDSAQTLHFVDPPYLHETRVRGAQYGRYYRHELSDNDHRELLGVLLDLEGFVVLSGYPSDLYDQVLAGWERHVTGSRISAGRGGAVRTECVWLNPACSAALHQNDLFKEIA

SEQ ID NO: 6976 - protein, 159 aa, Chromobacterium substugae
MTHLTQLADAARAVIAAFDRAGELTDELISALELALNGAELSPATEQSGEAVAWIEIHGSGVIYGVYMNAAEDLPLNVRLNLYTRPQPAPAVPDDGAVRETLLNVIRRLNQNPYSLTKIECIREVEAMLAAAPQPLTCTCPSGDGSLRWPCPRHPPESA

SEQ ID NO: 6977 - protein, 62 aa, Chromobacterium substugae
MTTAALPAPPVYRYTQRRDGAVIYVGPEPPAPEPGTSCTRMAWLAVPGMEWGGQWADPEIVF

SEQ ID NO: 6978 - protein, 47 aa, Chromobacterium substugae
MLVAKLLGHVTVEMVRRHYGRYITQPNGIVLKGDYSGFGTDPEGKAG

SEQ ID NO: 6979 - protein, 556 aa, Chromobacterium substugae
MLLSLTVKDFVIVDSIALDFAAGFTVLTGETGAGKSILLDALGLLLGDRAEGAQVREGAERAEITAEFSTERRPEIDAWLQTNELSGDEGVLLLRRLIDRSGRSKSFVNGQAATLAQLKQLGEFLVDIHGQHAHQSLMKSETQRQLLDAYAGSVALARDVHKAWQEWQAARQARNDAERLSRESEVERERLTWQIGELSDLNLQPDEWNTLSQSHTRLANSAELVQSAQLAVDTLSEQDNSCLTQLAQVQSRLSKLSSLDPRLADTLSLLDSVDAELREVVYSLRDYASDIDQDPGQLAEMERRLELLMSAARKYRIQPADLGDKLADWQQQLAALEASVDIEALSVAEAASLARYRAQAESLSGKRRQAARELSERIGKEMQRLAMGGSRFAIELSALAEPGAHGMESIEYLVAANAGTSLRPLAKVASGGELSRISLAMQVVISQVASVPTLIFDEVDVGIGGRVAEVIGHMLRDLGQRYQVLCITHLPQVASCGKHHWQVSKREQKGQVLSRISPLDAEQRVLEIARMLGGAELTQTTREHAAEMLASNAAAL

SEQ ID NO: 6980 - protein, 291 aa, Chromobacterium substugae
MERLFKHICLVARHSKPGITASLLQLADHLAAGGSTVLIDKESLSAEEAGGHALIDRNDMGKLADLCIVLGGDGTMLSIARLLAPYRVPLVGINQGRLGFMTDIPLHEMLTSIDAILHGQFVPEDRILLQASVVREDAEVASALAFNDVVFSRGAVGSMIEFEIFIDNQFVYSQRSDGLIVSTPTGSTAYSLAAGGPILHPTLQAIALVPICPQSLSNRPIAVNDSCEVEFMLTRGLDARVHFDGQLHCDLMEMDRVLIRRYRNPLRILHPEGYNYYDMLRHKLHWGERLL

SEQ ID NO: 6981 - protein, 222 aa, Chromobacterium substugae
MQNTTPTVFIVDDDPAVLDSLAMLITAQGMKTVTFPNAMEFLDGYQGNQICCLVLDIRMPQITGLALQEQLIERDIAIPIVFITGHGDIEQCRRAFQTGAIDFLTKPIDQARLIDSLRKGIRLSIQQHQKEEETQEVMGQLSRISGREREVLELVADGLSSKEIARELDLSPRTIEVHRANLFSKLGVDSLADLVRFYLKALEATGKKRSEDSFFNEAPPNQ

SEQ ID NO: 6982 - protein, 762 aa, Chromobacterium substugae
MPDVEVPRPSPFCAIKTHLQLLLRASARSKWLAALCWLLGFGLLLAHNLLLDLRLQRQEFQQTAELMLQNISHRLRNSELLQAEVGDIVSSAHPGRQARIRSLALAAAQSQPQLYYIGYQPLVDQDERAGFERQQSQLLGKPYLIRDYLHDQHNNWRDAAAWRPAPPRPRYLPLSMAEPGLGSRDWNEMGLDLLDDSVLSSSINRALGHTQASSPTLQLNNGELGLALFQAVYRASPPSPVPMIRIEQADGVIVQVLYLKPLLALPPQLENRYTLKLQRHDSGADTGVVTLLRQSDDQTGGWPAALLPRLSHRASLSAAALPYDLVLSRQLQFERASPGEILLSALFALLPAYLLLVILALLEYNRQAREQIQDDIFREREYASVALRGIGDAVISIDTRQIIQYLNPAAEALLGLPAAQVLQRRLQQVVPLHYEFSRNPVQDPVDQAIASRQVVYLAQNCYLKRHNGEKLLVEGAVAPLLGRSGQLIGTVITFRDTAPIRRRMLAALEASETRLRQHEMELARVARINTMGEMASGIAHEINQPLSAIMSYCQAGLSLLDDDEIDMAMLRRALTSSVSQADRAGRIIHRLREFVTRKNQQLVPVQLNQAVHNALSLLDYELQDHDIHIEQNFSTELPLVYADTIQLEQVVLNLARNAVEAMEHTRPWGRLSLTTRRQGERVQLIISDNGSGIPPDKLDRIFDPFFSTKPNGMGLGLAICQTAVEAFGGKLIAGNKPGSGAEFIIDLPCGARRVAAPSGVEA

SEQ ID NO: 6983 - protein, 176 aa, Chromobacterium substugae
MEKAILGGGCFWCLDAAYSGLDGVERVVSGYCGGHTADPDYKQVCSGHSGHVEVVEIHFDPARIDYATLLQVFFAVHDPTTLNRQGNDVGSQYASAIFYLDDGQRAIAERTLQELRAEQVFADPIVTRVEPAQRFHPAEGYHQGYYAQNQQQNYCQLVISPKLAKIRRRFAALMRN

SEQ ID NO: 6984 - protein, 308 aa, Chromobacterium substugae
MRIYRTDQFPLPLPAGHRFPAEKYRLLAEQVAQFAPERLDPAPAASRYELLRAHDSAYVDAVLNGCLDARQQREIGLPWSMQLAERSRRSVGATIAASRSALQQGCGVNLAGGTHHAGRGRGSGFCVFNDVAVAALLMLSEGQIRRALVIDLDVHQGDGTAAITATEDRIFTFSMHGARNFPFDRVSSDLDIDLPDGTGDAEYLAILADALPRVFAAASPDLAYYLAGADPYRGDRLGRLALSQEGLARRDRLVMETCRRHGAALVVAMAGGYAVPITDTVTIQTETVRLACRIFGAGELDETVSPRR

SEQ ID NO: 6985 - protein, 71 aa, Chromobacterium substugae
MPVPGIYQHYGNRRHYQLLGIARHSETGEPMAVYRALYGDFTLWTRPAGMFDETVDHEGRQMPRFSLIRAL

SEQ ID NO: 6986 - protein, 151 aa, Chromobacterium substugae
MATQLSIATPESVGSWLPLFTAYLAFYKVSQPPEQCLDFLSERLRRRQAVAFVVATDNRPQGFALMYTGFSSLSLQPCWMLHDLFVAPDARGQGFGRMLIQRCQQYARDLGGGEIMLQTAHDNLAAQKLYENHGFALDRDFRVYGWSSRHS

SEQ ID NO: 6987 - protein, 315 aa, Chromobacterium substugae
MKLVLAPMEGLVDDVMRDVLTRIGGIDMCVTEFVRVTSALLPTRTFMRLAPELERAGNTRAGVPVRVQLLGSDAACLAENGAKAASLGAPGVDLNFGCPAPTVNRHRGGAVLLNEPELLHEIVAAVRRAVPAAIPVTAKMRLGYEDKSRALECALAIESAGAGELTVHGRTKVEGYRPPAHWDWIARIRETVAIPVIANGEVWTLDDYRAIRAESGCDTVMIGRGLVACPDLAARIVAGGPAAPMDWGEMMPWVLDFFRQCWSKSGENRYPVARLKQWLGLLKRTWPEAEQLFEAIRREQEPEKIDNILMARLGK

SEQ ID NO: 6988 - protein, 510 aa, Chromobacterium substugae
MESTSSVGWLERLIPPVWYGSLTVFVAATAIFALMLCLARPDSRKRVSRTMLITLAALLVVNFSGQTGAGQMVRQSAVVVMGLALIRLWAMLLFRLFMPALRLHPPRILEDILVTVGYIGWGLVLLRLAGLDLSHIVTTSAVITAVLAFSMQDTLGNILAGLSLQFDNSVEIGEWIKVGDLVGRVVEINWRATTVETRNWETLVIPNSVLMKNHFAILGKRHGCAQQWRRWVWFNINWDTLPTQIITVVESSLREAQLPGVALSPEPNCILMGFENGYSRYAVRYWLTNLAADDLTDSIVRTHVDAALRRHNLRMASPFYNVLTIKENEKYMEARMKKHLEERVLALRKVELLSSLNDEEMVVLADQLKFTPFVTGDIIMHQGSVAHWLYIMLSGEVEVWISLADGNRKLVDVLKAGSFFGEMGLMTGESRSGTVIARSNVECLRLDKDAFQAILVSRKELAETISSILAERLEERRNRMPEELLDGGDPAPRRAELVERIRNFFGLSKH

SEQ ID NO: 6989 - protein, 48 aa, Chromobacterium substugae
MGKPSNCIKMKFNDWKRLPRPYRAMIEGQPQVLVSRPGRDYFMPVQFV

SEQ ID NO: 6990 - protein, 198 aa, Chromobacterium substugae
MEQPKDKPRGGKRSGAGRKSAFGGDKTIALRVPEPLKPILQQWLDDYRSWRTANSEEASNFRTLGSQLSELSLPLFASSVPAGSPVPADDLKEADIDLNAHLVNRPGDTFMVTVKGDSMQGAGIHDGDLLLVERSREPRNGKVVVAALNGELTVKRLERSANGLRLLPENPAYQPITVPEDASFFIWGVVTRVIHKVD

SEQ ID NO: 6991 - protein, 76 aa, Chromobacterium substugae
MGIVKISEQMHDNLRTASEALSRSINSQAEHWLRIGMLAEIHPDLRYSEICQLLLRSSREGQALDLRQQQAAEAGR

SEQ ID NO: 6992 - protein, 263 aa, Chromobacterium substugae
MSGVKIKTPAEVAKAREAGKLVAELLAMIGEHVRPGVSTEELDAICREHIVKVQRAIPANIGYYGYPKTICASVNQVVCHGIPSEKQILQNGDIVNIDVAVIKDGWHGDSSRMYFVGAPRPEAKLLVDTCHRAMWAGIREVRPGATLGDVGHAIQAVTQQAGFSVVREYCGHGIGKVYHEEPEVLHYGRRGAGLRLRPGMVFTIEPMINAGKAPTRQLDDGWTVVTQDGSWSAQWEHMVAVTTQGFEVLTPWPDGEGGYPAQA

SEQ ID NO: 6993 - protein, 230 aa, Chromobacterium substugae
MARAERLLDLLQLLRRHRYPVTAAALAAELGISVRTVYRDIASLQLQGADIAGEPGLGYQLRPGFLLPPLMFAEEELEALVLGMRWVAKRVDARLADAAGNALAKVAAVLPAELRSQLEDAALLVGPAQTEPAAVDMARLRDAIRQQRKLVLRYRDAKGEESRRVVWPFALGFFEQVQVLAAWCELRQDFRHFRCDKMISCDSPGERYPRRRQALLREWRKLHGIAEGAV

SEQ ID NO: 6994 - protein, 190 aa, Chromobacterium substugae
MTRAITLLTENFSDWETALINSAGRGYYGFDVRFAAPGGAALTSSGGLMVTPHLAIESISLDELDLLIVCGGTLWRTGQAPDLTPLLTQARARGIALAGICDGTRMLAQAGVLNGVRHTSNSAENLAVPGYAGGAHYQDVPYAVADQRVVTAPGTAPVSFMAAILATLGIGGADLDAYLAQHAAEHARPA

SEQ ID NO: 6995 - protein, 139 aa, Chromobacterium substugae
MIQDVQTDQEIADCFAVMRQLRPHLQEDGFVAVVRAQMAEGYRLAYLLEDGEVACVAGYRIHRNLMMGKSLYVDDLSTDESARSQGCGARMMAWLREAALDAGCAEIHLDSGVQRHRAHRFYLNRNMDIVCYHFSEQLR

SEQ ID NO: 6996 - protein, 143 aa, Chromobacterium substugae
MIRQAQTDQEIAGCFAVLRQLRPRLQEAGFIDAMRELMAEGYRLAYLLEDGEVACVAGYRISRNLLMKKSLYVGELSTAEAARSRGCGARMMDWLRQAARAEGCVRLHLDSGIDRHRAHRFYLNRDMRISSYHFSEALPPAAP

SEQ ID NO: 6997 - protein, 181 aa, Chromobacterium substugae
MLFTEMPALDHPDAMLRPLYPDDILAWHDYLTLPQIYQHTSWNVRCSSELEHYAWQPEQFTEVSALRFAIADSRDDHLLGTAGFHTVTPANASAEIAYDLSPAAQGRGIARAACASLLAWGHGHLGLARIQATVLPENARSIQVLERCGFQREGLLRSYRKVRGPSRDFWMYSHIAEGGNA

SEQ ID NO: 6998 - protein, 369 aa, Chromobacterium substugae
MTEFSSLLQQGNAWLFIPSAILLGALHGLEPGHSKTMMAAFIVAVRGTVKQAVLLGLSATLSHTAVVWAVAMAGLYFGRNWNMEKAEPYFQLASAALIVAVAGWMVWRTWRNLRAEHQHGHRHAHPHDESRIIDTGHGTVRLEIFEDGAPPRFRLHDEAKRGHGWPAEQAWVETERPDGSRQRFAFVQRDGFIESEQAIPEPHQFMARLSLGYGHHSHDYDVAFAEHGHPAPANAAALEALTDGYQDPHELAHANDIRRRFANSDVTTGQIVMFGLTGGLIPCPASITVLLLCLQLKKVALGATLVLCFGIGLALTMVASGVLAAVSVKHVSRRWSGFGDFARKAPYFSGGLIALVGLYVGCHGWAALP

SEQ ID NO: 6999 - protein, 91 aa, Chromobacterium substugae
MAHTIRDKAKLLARVRRIQGQAAALEKRLDAGDEDCGAVLQQIAAIRGAVNGLMAAVIEGHLSEHLVNEPEQAQRQRDLDAVLQVLKSYLK

SEQ ID NO: 7000 - protein, 137 aa, Chromobacterium substugae
MLSPDHAKADHQAVCRSANAIRHVFGPQNHWPPTDISFDENLADLRRHLAEFEQRQAFAYCLLTPDGKHYLGCLYLKPIKSRLENDWRKQSFQAQAFLWLSLGDNPLQEEQTLATLQNWLSRHWPLASIARPGRAPG

SEQ ID NO: 7001 - protein, 122 aa, Chromobacterium substugae
MQHPDFVILYVDQPMRSADFYSRLFDLQPIQLSPTFAMFKFASGMRLGLWSRHTAEPAAEMMGGGGEVVVRLEDFAALDACLADWRAQGLRIVQPITDMDFGRTFTALDPDSHRLRAYVRTE

SEQ ID NO: 7002 - protein, 145 aa, Chromobacterium substugae
MLKTELRTVPSWLIKRAAHALTRHAEAQLRPLGLGMASLPVLTALKNGEAATQAELARLLQVEQPSMAQTLARLERDQLILRRPSAAGKRAQIVEATALGRERLAQAIPAMAAGNARALAGFSREEEAVLASLLQRVCANLGDAP

SEQ ID NO: 7003 - protein, 364 aa, Chromobacterium substugae
MPLPSGVAIVGAGPAGLLLARGLLLRGIPFTLFDRDASAASRPQGGMLDLHPDTGQQALRSVGLFESFLRIARYEDQGMRVFDRDGRLLMEKGAEGGDCPEVDRGPLRDMLLDALPAGCVRWGHALREAEALPGGGFELRFGNGAARRFDFVVGADGAWSRVRPLLSRAEPIYAGLVYHELSISDIDAAHPELSALVGRGTLVAKGGGKTLFAQRNANAQVRVYAVLRQALAADGRRAAPASKAELLAAFADWDSSLRRLIQAADEPARPWPIHALPVGHRWKGRDDVTLIGDAAHLMAPAGEGANLALRDACDLAAALGRDDWRAALRSHEARMFARAELAAARAQRMLAEGAAGDGRLREVS

SEQ ID NO: 7004 - protein, 250 aa, Chromobacterium substugae
MNSLGKRCLPWLLALPCGLQAAPAASLPAPIQALAQQGYEILDSFEAPGGLTGYAALYLSRPQTVYLTPDGQHAIAGAITDARGDKWNQAGLDRQFGAAMLRQLENSAWIADGDAKAPRAVYVFTDPNCPYCSQFWRDARPWVDAGKVQLRHILVGILEADSPGKAMALLADADPEAALARHERQPGGGIQPLARPPRAAADKLAANHQLMERFGAFSTPAIFYLDATGALRKAQGAPSPASLAKIMNGE

SEQ ID NO: 7005 - protein, 288 aa, Chromobacterium substugae
MQNFNEAEREQLYRAAIGPQRQEYYLARFLRFDSQGKPGAGWHWPNLFITFFWLLYRKQWLPALIYYLLPGLFLLAIGLLSALAGAKASGFLSLLYLAFMAGMLLLPPLCADAFYYRRCQAKIRLSAQKAGPNLDARLAWLAKSGGVSRIAPAIAIVMAALFGAGLLAATAIPAYQNYAIRAQVADALSANQGYQEAIGRYYSQRRALPSTLADSGYTAGAQPESVRAAAYDKQSGALTLSMSLPRNKVNTLVLAPVPDAQGRIRWVCSSTLPDAALPDACRRPDAAR

SEQ ID NO: 7006 - protein, 184 aa, Chromobacterium substugae
MAKLFFRYAAMNSGKSTQLLQIANNYESMDKKVALYTSAIDDRYGVGMITSRLNIQRESNTFDAGFDFLAHDYGDTACVLIDEAQFMTPEQAQQLHRLAHSRNIPVICFGLRTDFQGHPFPGSAWLLSLADDVEEIKTICHCGRKATMHIRIDGAGQRVKEGPQVEIGGEARYRAVCGRCFHKA

SEQ ID NO: 7007 - protein, 305 aa, Chromobacterium substugae
MADGRAGAFAFESVTPGQIIDFVKRAPADKAVVTGMLSLPRQAQGPVPAVVILHGSLGINPGEWMWAKRMNELGYASFVVDSFSGRHIAETEKDQTRLSMAADIADGYAALRLLATHPAIDPKRIAVMGFSRGGVAALYSSLEPFRKGVIDDDVRFAAHVAFYPSCGIHYAANHLDGAPVLMLLGGKDDYTPAAPCLDYADALKAKGAQVTVKVYPDAYHAFDRFTPLRAVSSATSARLCHGEYDLDSGRFTMAGSAGVVSGGEAKIAAQACLSRGVTIGGDPVGREQSPALVADFLKSVFAKDR

SEQ ID NO: 7008 - protein, 131 aa, Chromobacterium substugae
MSKLPFNQGQPAFIPLSTFQRYPETEMVERSRAFYADIRRRKTVREFTSQPVPREVIENALRAAGTAPSGANHQPWHFAVVSDPERKRQIREGAEAEEREFYTHRRRRNGRTLWRRWARIQTNLFWKPRHT

SEQ ID NO: 7009 - protein, 282 aa, Chromobacterium substugae
MLSYRHAFHAGNHADVLKHLIEIELLNYLGQKDKPYWYIDTHAGAGAYSLVEGYATKNAEFESGIARLWQRDDLPEAVRGYVEVVKRMNPDGELKFYPGSPWCAADVMPESDKLRLFELHPTDAQLLQQNFEGSGRRVQIQQANGFEGIKAILPPPPRRALVLIDPPYEDKRDYQNVNTALKEGLKRFATGVYAVWYPCLQRAEMKEMIPALKKLPAKNWLRAELHVQGPSADGFGMHGSGMFILNAPWTLPKTLNEVLPYLAQHLGQDAKASFILETGGDL

SEQ ID NO: 7010 - protein, 249 aa, Chromobacterium substugae
MLQILYRDDQLIAIQKPAGLLVHRTVLDRNETRFAIQLLRDQIGQRVYPVHRLDKGTSGVLLFALDKDASREMSWQFERQQVAKRYLAVVRGHADDAGHIDHPLSRRPDDLEWIGEKVETAPQPAQTDYRTLARIELPIAVERYPTSRYSLVELAPLTGRRHQLRRHLKHIAHPIIGDSTHGKGRHNRMFAEQLDCARMLLACVEMRLTHPVTGQPLRLDCPLEENFSALLTRLGWADAARAAGIELTI

SEQ ID NO: 7011 - protein, 334 aa, Chromobacterium substugae
MTIQLKRISFAVAAAVLSAAACAKDFTPAVIYDSAGKFDKSFSEAAYNGAERFKKDFKVNYRDGQISSDAQKEQLLRKMAGSGADVVVAVGFNFSQAVETVAKEFPKVKFTLIDAVAKGPNVQSIVFKEQEGSFLVGMAAALKSKTGKVGYIGGMDIPMIRAFGCGYAQGAKYANKNVAVLQNMTGTTPQAFNDPARGTELAKSQFDRGADVIFVAAGGTGMGVLQAAKNAGKFSIGVDSNQNYLFPGSVLTSMVKKVDVAVYNTFKDAKDGSWKSGVRVLGLKEQAVDWALDKNNRPQITPDMEKKIAAAKAEIISGKIKVVDYRANNSCPVQ

SEQ ID NO: 7012 - protein, 509 aa, Chromobacterium substugae
MTEFAIELTGINKSFGAVQANRDVTMSVPKGSIHGVIGENGAGKSTLMSILYGYYQADSGTIRVNGKDARIRNSQEAIRLGIGMVHQHFMLVDTFTVLENIVLGAEGGRLLKGGMDEAREHLKELNRNYSLEVDPDAVVGELGVGLQQRVEILKALYRGADVLILDEPTAVLTPQEADHLFHILRSLKEQGKTVILITHKLREVMDSTDNVSVMRAGTVVANVRTCDVDKEKLADLMVGRKVTLKVDKAERAPGAVVLDVKSLCLTDERQVKLLDGLNFQVKAGEIVGVAGVSGNGQSELLEVLAGMRAPSAGVVAYKGEDLLKLPCKRAPRAAVYRRMGISHIPEDRSREGLVKSFSTYENAILGYHGDKTLNSGPLYSRKKLVERTRDFIAQFDIRPGNPLLRVGLLSGGNQQKVVLAREIHANPDLLLIGQPTRGVDIGAIEFIHKRLIELRDEGKAILLVSVELEEILALSDRILVMAGGQITGEVAAKDADTISLGLLMGGHKH

SEQ ID NO: 7013 - protein, 364 aa, Chromobacterium substugae
MKFGQPSTLPRWAQLTILPALNLLAALLVTGFVTWMIGENPWECLQLLIHGAFGYGEGAGYTLFYTTSYIFAGLAVATAFHAGLFNIGGEGQAYLAGLGVTLVMLGFDHTLPSYVLIPLAVLAAMGFGAAWAYIPAYLQAKRGSHIVVTTIMFNFIAYSLMLYLISHQLIEAGSQNPTTRQFAETGWIPQLHTLFSSLPNSPLNLTFVLALLASALFYLIVWHSRWGFELRTVGTNEHAAGYAGMSVSRVIIIAMCVSGALAGLSSVNDLLGSSHRMNVLFTNGVGFVGIAVALMGRNHPVGIILSALLFGALTQGGSDLSFEKPMITREMILFIQGLIILFCGALENLFEPFIAGLFKRKDKK

SEQ ID NO: 7014 - protein, 321 aa, Chromobacterium substugae
MEMFFSLLDSTVRVATPLVLAALAGMFSERSGVVDISLEGKMLVAAFASAAAAYVTHNPWLGLLAGIMAAVSMAMVHAFVSVTYNGNQLISGMAINTVASGITPVLGLAWFQQGGNSPQLPDEGRFHEIVLPFADALRDVPVVGLVYSKLISGHSILVYLTVFVVIPLVTWVLYKTRFGLRLRAVGENPHAADTAGISVAKVRYTALFWGGVLCGMAGTYLSVYQTGSFIKEMTAGKGFLALAALIFGKWRPVPAVIGCLLFAFADAIQIRLEGVALPVIGQIPSQAIAVIPYVLTVLLLAGFVGRALAPKAIGVPFVKSR

SEQ ID NO: 7015 - protein, 397 aa, Chromobacterium substugae
MLSYQQARDWLLERARPLSARQILPLAQIHGRVLAEPVRAALDVPPHDNSSMDGYALRCADFAAAMPVSQRIAAGAAPQPLQPGSAARIFTGAPIPPGADAVIMQEQAQLDADGKVRFAAAPRPGQNIRLRGEDIANGQEILPAGRRLTAADLGLAASIGLAALPVLQPLRVAVFLTGDELVEPGQPLAAGQIYNSNRYWLLPALRQLGCETIDLGAVRDDLDATRRLLRDAAAAADVVITCGGVSVGEEDHVKAAVEAEGELTLWTVAIKPGKPLACGRIGDADFIGLPGNPVSGFVTLQTLVRPFLQKRMGLPLAEQAIQRYPAAFAWPKPDARRSEFLRVRRMLTDEGWQLELYPQQSSGALTSCAWADGLAWLEPGQTVAPGDSLRYWALDLA

SEQ ID NO: 7016 - protein, 113 aa, Chromobacterium substugae
MTRIRFVGESGALLGEADAQAGDNLLDIARLADVPLHWRCGQGTCGTCKVKVLAGMGAPQRPGRKERNVLLRAGAISEQLAGMEEWEEAQPWRLACHLALAERADWEVLCPDD

SEQ ID NO: 7017 - protein, 363 aa, Chromobacterium substugae
MPVANGFPNISILSVFRIAILALLVISCIKVLQPFLGALTWAAIIAISAWPLYSRLCLRLKGRRKLAALLIVLALSAALAIPIGLMALTLADTLPHLANLAHDLTSFRLPDAPSWLVNLPVVGESLQKMWQGVQADLPGFFEKIRPAINDAALWLLSGGANLGLSLLEIVLAIVVAGLLLINGDKLWELVERIVVKLGGETASDLPEVIARTIRSVTTGVVGTALAQTILCVIGLLIAGVPGALVLGFLCFIVAVAQMPTLIVWLPAAGWVFYTGHTGMGIFLLVWGFLLINTIDNVLKPLLISQGAQMPLSVIFLGVIGGLIAWGVIGLFIGPTLLAVGLTMLRHWLERDDNEELACEGEQG

SEQ ID NO: 7018 - protein, 598 aa, Chromobacterium substugae
MQAYLYSTYRTAWQWLAALLACLSFALPAHAVNQDDLLPPEQAFAAKVARHGDQLELTLDVAPGYYLYRDRISISSAPADLTGKPALPAGQEKSDPYFGKQVIYHGKQTIAIPLAAGAPADFQLNVRLQGCAEAGVCYPPYTHKLKVGQAGGSGNKLSAWTEVGTSGKASAGNSELAAKGWLPTLGTFLLAGLGMAFTACMYPLLPIVSSLIAGQGTTLTRRRGFLLSLIYVQGLALTYTAVGVAAGLTGSLLTVWLQQPAVVLTASALMVVFALSMFDLFSIQLPSSIQSRLNDASNRLSGGKAATVFLMGALSALLIGPCVAPPLALALGYIGSTGDAALGGAALYAMALGLGLPLIAIGTFGGHVLPRAGNWMKAVKSAFGVLMLGLAIWLATPFLPAALVMLLWAALLIGAAVFLGAFDSLSAGTGSRARLGKALGLLLFLLGAAQLVGLLSGADNPRYPLKLIAASNAEGAAQPHANFQPVNSSAELDARLAEAKAAGKPLLLDFYADWCIACKEMEAEVFPQAQVAAKLGRFTLLRADVTANSPEHQALLKRFGLFGPPGIILFDAQAAERNRVVGYTPAEAFARELAKVAN

SEQ ID NO: 7019 - protein, 266 aa, Chromobacterium substugae
MRETIHFAHANSFPASVYRKLLGRLAERHHVGYLDTIGHDPAYPVTDCWPRLVEESIRFIESNYAGPVVGVGHSLGGFLMFYAALKRPELFRAIIIMDSPLMGPSRSFGIWLAKRLGFIQRVTPGGNTLKRRDNWASVEMVRDYFARKPAFARFDPECLADYAELGTQDDGRGGRRLKFRPQVEHDIYATLPHDFPRHRGRLKVPAAFLAGAGSDVLGESDLRFMRRHFPMRVETQRGSHLFPLEHPLETADRILQLLEQLAPRQP

SEQ ID NO: 7020 - protein, 357 aa, Chromobacterium substugae
MSESLLKQHRDAIDAIDVEILTLLNQRASHAREIGEIKGGGIIYRPEREAQVLRRLKDLNPGPLPSESIARLFREVMSECLALEKPLSIAYLGPEGTFSQLATVKHFGHAARAVACASIDEAFRLVESRALDYVVAPVENSTEGAVGRTLDLMVSSPLKICGEVVLRIHHHLLRSAEGFDGIRRVYAHAQALAQCHEWLNKNLPADVERVSVASNAEAARLASEDASAAAIAGQAAAERYALLKLAENVEDEPNNTTRFLVLGLQDVGVTGQDKTSVVVSAPNRPGAVHQLLEPVAANGVSMSKFESRPSRAGLWDYVFFIDLEGHRQDERVQKALAGLGERTSFVKVLGSYPAAVL

SEQ ID NO: 7021 - protein, 196 aa, Chromobacterium substugae
MSEIKAICLFCGSNKGAKPEYEAAARIFGRTLAERGVTLVYGAGKVGLMGVAADAALEAGGRVVGVIPEFLKAKEVAHLGLSELHVTETMHQRKALMAQLSDGFIALPGGFGTFDELFEILTWAQLSVHDKPVGVLDAAGFFQPLQAMVRHAVEEGFVPPGNLDLFRIDASLPAILDWMRAYRPQPVAKWLELAKT

SEQ ID NO: 7022 - protein, 206 aa, Chromobacterium substugae
MPAMRSPSANRATVWQRLRRAASWPLVLLLAAVIAFEEYAWDELAAGLAWLAKWPPLTRLERWVATRSPRVALALFLLPALALLPVKLGALFLIEQGHALLGLGVILLAKLGGTALVARLFALTRPALMQVAWFVRLYGKFNACRDWAFERLRSSLPWRWARLALRRVRRWRGQPSAFSRLVRRLAGKWTHARRSEGRSGARGETE

SEQ ID NO: 7023 - protein, 215 aa, Chromobacterium substugae
MAAGGLADWLSGLQPVGRQGDAMTALPELLGKIAECQACASSLPHAPRPVLRASTRSRILLAGQAPGSRVHQSGIPWDDASGRRLREWLGVDEAVFYNEDCFAIVPMGFCYPGTGANGDLPPRPECRRLWHPQLLPLLTDVRLVLAVGAYAQAYHLPDRKATLTETVAGWREYLPRRMPLPHPSPRNQLWLSRHRWFEEELLPELKLRVAAALEP

SEQ ID NO: 7024 - protein, 423 aa, Chromobacterium substugae
MKCVDDFRLRLGKQELVPVMIGGMGVDISTATLALEAARLGGVGHISDAMVPTVTDRRFNTKYVKSKLARYKFNVENPDKSLVQFDLGLLEEATRLHVGNTMQRKEGGGLVFINCMEKLTMNAPKETLRVRMRAALDAGIDGITLAAGLHLGSFALIEDHPRFRDAKLGIIVSSLRALQLFLKKNGRSGRLPDYVVVEGPLAGGHLGFGMDWAQYDLASIFGEIRDWLRSEQLDIPLIPAGGIFTGSDATAFLEAGAGAVQVATRFTVSRECGLPEKVQQEYFKASEEDIEVNQLSPTGYPMRMIKSCPAIGDSIRPNCEAYGYLLDAKGSCSYIDAYHKAQQEAAPGAKRAPVWEKTCLCTHMRNFDCWTCGHYAYRLKDTSHRREDGSYQLLSAEHVFQDYQYSKDNKIALPPREVCLMVG

SEQ ID NO: 7025 - protein, 233 aa, Chromobacterium substugae
MSKIDKHDQQEAVSQKIRYRLKQAGARFHANDNIAAFIEEGELDALQDEVQAKLAGVLESLVIDTENDHNTRDTAKRVAKMFVREVFRGRYAAMPSSTEFPNVERLNELMIVGPITVRSACSHHLCPIIGRVWVGVMPNENSNLIGLSKYARLIDWVMTRPQIQEEAVSQIAELLMRKLQPDGLAIVMEADHFCMHWRGVKDSNSKMTNSVMRGSFLTNPDLRREFLSLMHKP

SEQ ID NO: 7026 - protein, 140 aa, Chromobacterium substugae
MLVRLIYCSRAQQLIDQALVDDILSASRKYNPALGITGLLCYSKDVFMQVVEGSRAHVNRLYLKLARDPRHHSLTLLSFHEIEQRKFANWSMAEVALDKLNASLILRHSPLPALEPFTMPGAGAERLLEDLAESGSIQYR

SEQ ID NO: 7027 - protein, 135 aa, Chromobacterium substugae
MSRFRIIAALALLGAAAAVQAAPAVKTLPSGVKIEILAAGKGATPKASDTVKVNYRGTFKDGKEFDSSYKNGGPISFPLNRVIPCWTQGVSALTVGSKAKLFCPAATAYGSRGAPGAIPPNTDLYFEVELLEIQK

SEQ ID NO: 7028 - protein, 162 aa, Chromobacterium substugae
MAEHLIVENGGKEEKYQALLPQAHALVAGETDLVAALANLSAALAMTFDWLWTGFYLVKGEQLVLGPFQGPIACTRIPHGRGVCGSAWAQNRTLLVDDVDAFPGHIACSSSARSEVVVPIRDAAGKVVAVLDIDSDQLSSFDQTDADYLERIVAPLAALFPA

SEQ ID NO: 7029 - protein, 246 aa, Chromobacterium substugae
MTKRIALVTGGMGGIGSAICKALAEAGHIVVTTYSKPGREQAWHADMKGLGFNDIHSYQCDVTDFAACQDIAARIAKDIGPISILVNNAGITRDASFKKQSKDDWDAVIRTNLDSVFNMTKPVLDSMLEAGFGRIVNISSINGQKGQFGQTNYSAAKAGMHGFTMALAQEVAKKGVTVNTISPGYIATEMVMAVPEDVRSKIVAQIPVGRLGKPEEIAALVGFLCSENAGFITGSNIAMNGGQHMM

SEQ ID NO: 7030 - protein, 291 aa, Chromobacterium substugae
MTASTGQIIRSHGRRFIVEADGRTYDCTTRGKRVDFACGDFVDILIQNQEQAVIERSRERSSLLYRQDDWKAKVIAANVSRILFVIAAVPSPNEELLGRCLIAAEAGDIEPVIVVNKCDLPETPALLAKLQLYVKLGYQLVTLSAKQDFSPLLPLLQGHTSVLVGQSGMGKSTLTNALLPDANARIGDISIALDSGRHTTTHAALYHLDESSHLIDSPGLQEFGLKHLQAADLIHYFPEMRQYIGQCRFHNCTHRVEPNCAIMAAAETGAISRHRLDLLQRLTQELAPVRL

SEQ ID NO: 7031 - protein, 108 aa, Chromobacterium substugae
MNLLELSCTPQHGQSPLAENTVKQLLSGLPDWQIDGIELSKTFRFADFHDTMAFVNALAWIAHREDHHPDMSVHYNRAVVNFSTHDAGGLTLNDFICAAKAEALISRP

SEQ ID NO: 7032 - protein, 415 aa, Chromobacterium substugae
MIEAFSLLFAIALAATLSLKLWLGWRHIRHVGGNRHAVPAAFRDNITLEQHRHAADYTIAKTRLGLLSAWVDTALAAAFTFGGGLQWLALHSQQWFASPLLSGMALIVCMTVLSSLISLPLSLYGTFGVEVRFGFNKMTPRLYLLDQLRGIGISILIGLPLLAVVLWLMDIAGPAWWLWVWLVLCLVQLLGLVLYPILIAPLYNKFWPLADEALKARIDALLARTGFRSNGVYVMDGSRRSSHSNAYFTGFGAGKRIVFYDTLLEKLSHDEIEAVLAHELGHYKRRHIAKRIAVAFTLSLLFLALLGQLLHAPWFYAGLGVTAPSTAMALLLFMIAIPAFTFPLTPLSSRSSRKHEYEADDFAAGETRAADLQSALVKLYRDNGATLTPDPIHSAFYDSHPPAALRIQHLKGSQS

SEQ ID NO: 7033 - protein, 193 aa, Chromobacterium substugae
MKENGRVFRLTSMAQDTNNLIWLDMEMTGLNPDSDRIIEVAMIVTDSHLNVVAESPVLVVHQSDAILDGMDDWNKNTHGKSGLIEKVKNSAINEAEAEQVLLAFMMQYVPERGSPMCGNTIHQDRRFMARWMPKLEAYFHYRNLDVSTLKELCKRWKPEVAKGVVKRGKHEALADILESIEEMRYYREHFLKL

SEQ ID NO: 7034 - protein, 550 aa, Chromobacterium substugae
MVAHRHADINATPIWAKLHQHQRATRHMHMRELFDTDPQRFQRFSLELDGLLLDYSKNRITERTLELLFDLAQAADLKGWMERMRAGERINVSEDRAVLHTALRLPAGAALQLDGRNVTAEVHDVLDRLRRFSDSVRDGAWLGFSGQRIRDVVNLGIGGSDLGPRVVQEGLAAYAHAELNVHFVSNVDGQHLARTLARLDPATTLFIVASKSFTTPETLLNAQAAKAWFLQAGSEADIARHFVAVSTNEPAVRAFGIDPQQMFGFWDWVGGRYSVWSAIGLPVMMAVGYDNFRAFLDGGHAMDRHFFEAPFCANMPVLMALIGIWYNTFYQAHTHAIMPYDHGLRSLPAHIQQLDMESNGKRVGRFGEALDFDTGPVIWGEEGANSQHAFFQLLHQGTRLVPCDFILPLNSHYPVANQHEVLVANCLAQTEALMRGKAEAEVMQELSHLSGEELDMLLPQKLFPGNQPSNTLALDRLTPYSMGMLMALYEHKVFVQGVIWGINSFDQWGVEYGKQLARRILPELSGAAAELSHDSSTNGLVKHFRERHGR

SEQ ID NO: 7035 - protein, 166 aa, Chromobacterium substugae
MADSKQLAVDLGLLLSARGESVATAESCTGGLIAAALTDVPGSSAWFSHGIVSYGNQAKQQLLGVQAASLIDHGAVSETVVREMAQGGQTLADSDWAVAVSGIAGPGGGSPEKPVGLVWFAIAHPGGQTEAWRCLFAGDREAVRRQAVCEALSQLEKRVRSHVHLA

SEQ ID NO: 7036 - protein, 249 aa, Chromobacterium substugae
MEFYAFPAIALLFVGIFTREVIAPASRNTCDRRWLALASILGAATAAVTLAVGFLFAGLIREVSLIPAARGWPDIAVGAASFLLTSFVFYWWHRATHASDWLWRVFHQLHHSPKRVEALTALYAHPLDSAAAVLISAFSSYLVLGATPAAAAWALFFTSVFDLFLHSDLKTPRWLGYLFQRPEMHTVHHAYGHHAQNYGLPVWDLLFGTWSNPAERVARLGFDDDKAERVRHMLLFRDVHKSGADDAER

SEQ ID NO: 7037 - protein, 296 aa, Chromobacterium substugae
MDDPIRHFIDQLAIAGRSAHTLSAYRADLNLLAAMLRPAPLAAAGVNELKRALAKLHAQGLGSRTLARRLSSWRQFYHWLQQNGLRDDNPAASLHAPKRDRLLPKALPVDSAAALLDRIDGDDALEVRDRAIFELIYSCGLRLSEAVALNLDDVDFADHLLRVRGKGNKTRLTPIGAEAASWLNKWLAQRVAQDGESALFTARHGRRLGGRQIENRLRDWAIKTGANQHVHPHMLRHSFASHMLQSSGDLRAVQELLGHANLSSTQIYTALDFQHLAKVYDNAHPRARKKVQPDDD

SEQ ID NO: 7038 - protein, 282 aa, Chromobacterium substugae
MNTRFTGTERYIATDDLMMAVNASIALQRPLLIKGEPGTGKTMLAEEVAASLGRELIVWPIKSTTKAQHGLYEYDAVSRLRDSQLGGDKVHDIANYIIKGKLWQAFEAEQAPVLLIDEIDKADIEFPNDLLRELDQMEFFVHETQQFVRARQRPIIIITSNNEKELPDAFLRRCFFHYIRFPDADTMQSIIDVHFPDIRQQLVKQALEVFFSIRELPGLKKKPTTSELLDWLKLLCGENIGADELENRHARNAPPPLAGALLKNEQDLQLFERLMQMARRRN

SEQ ID NO: 7039 - protein, 137 aa, Chromobacterium substugae
MRNYPPNSPEALARLLAMFMITDGNMDPRELELLEKLHVYHLINLPRKQFAQVLRDFCDDVSDEAGDDGAIRLLDRERIDNLLSEVSDHRKRILTCVLAMDISKSDGTISDSEMALLSYMMKSWGISLDDLEREFAR

SEQ ID NO: 7040 - protein, 142 aa, Chromobacterium substugae
MARIQIELPPRFIFDTALEVRIGDINYAGHLGNDALLRLAQEARLRLFKQLGYASELAVEGAGIVIADVAACYRAEAFHGDRLRFRIGVADIGRHGLDLIYQAVDDNTGKEVARLKTGIVFFDYQARKVAPMPEAFSGKLSQ

SEQ ID NO: 7041 - protein, 149 aa, Chromobacterium substugae
MYQRIFVPVDDSDTSNMALNEACKLAKEFGSSIRLVHVVDLAQFGWGGTEFLDATELQKSIKQAGEQVLGQAGERARALGVEPECKILESWGDKIAAVLSDDASVWGADLLVMGTHGLGGLMHLLMGSVAEGVLKVADMPVLLIRNPGD

SEQ ID NO: 7042 - protein, 107 aa, Chromobacterium substugae
MKLFEKIPNPREIRRKLGLNQQEFWSRIGVTQSGGSRYESGRNMPKPVRELLRLVHVEQIDLSKVRREDFEIVEYLKETHPDLYKSLRKAVRTKIEAQEGGAEATAG

SEQ ID NO: 7043 - protein, 383 aa, Chromobacterium substugae
MLSELIRFDTTSRYSNLQLIEWVREYLAGFGLTSRLTYNDDGSKANLFARIGAEDLPLIVLSGHTDVVPVDGQDWHYPPFELTAGGDGRLYGRGSADMKGFIACVLARVPDFVRLAAEGKLAQGIGIALSYDEEVGCLGVGRMIDALIADGVDVAGCLVGEPTSMKPVIAHKGIAHYRCVVKGRAAHSSLTPHGVNAIEFAARLITHIRKLADAEAAFGHRQPLYDVPFTTMQTGLVRGGVACNIVPADCEFMFECRWLPGDDPQRLVASVADYAATLEQEMQAVAGEAQIRIEPVVYSPAFESDPSSSIRRYVVSLCGCEGGAGVAYTTEAGLFSQAGMPCVVLGPGSIEQAHRPDEFIEVAQLQACYDWLGRLADELIQPR

SEQ ID NO: 7044 - protein, 458 aa, Chromobacterium substugae
MDKSKSGGEVKLRDGFTSSFGVLAATLGSAVGLGNIWKFPYLTGTNGGAGFLVVYVLATLLVGLPVMISEIMLGRKAKRDAVTTLAKLAPAGQPWWLVGAFGVFAAFLIMAFYSEVAAWVFAYIFKAIAGDILSNDPKVTSGAFTALITNPVQSLLWQWLVLGLIGGILLMGVSKGIEAVTKKLMPLLFALLLVIGARSLMLPGASQGLAFLFTPDFSKITAGVVLTAVGLAFFKLSIGMGTMITYGSYFRDDQDVPLTTFRVMCADLFVSLLAGIAIFPAVFAFGFQPAAGPSLLFITIPAVFASMPLGHLFMVVFFVLAAIAATGAMLSILEVPVSVVSERFGISRVKSTIINLLLLALVGAGCALSNSLTADIKLHGMTMFDLFDFVTSNVLMPLGGICLCLFTGWVWGYDRFRDALSNGGALNNARLLKALFFVVRFVSPVLILVVMLKGLKVI

SEQ ID NO: 7045 - protein, 92 aa, Chromobacterium substugae
MKKGILLFWPSFIIAVAATAVFYSIFDPAELTLHGNALFADKLTAYSVFLLASWLFGAANTAIVLLLEKSARDINGFVAPPVVSGDEDGTPS

SEQ ID NO: 7046 - protein, 402 aa, Chromobacterium substugae
MTSSIFAGVELAPRDPILGLNEAFNADARDTKVNLGVGVYSDDNGKIPLLGAVKAAEKARLEALPARGYQPIEGPAAYDKAVQNLLFGQDGELLAAGRVVTAQALGGTGALKIGADFLKRLNPASKVYISDPSWENHRALFESAGFQVENYPYYEAASRGVDFAAMKSHLAALDAGSVIVLHACCHNPTGADMSAAQWDEVVAVCRERGLVPFLDMAYQGFADGIEADALAVRLFAASGMQFLVASSFSKSFSLYGERVGALSIVTAGKDESARVLSQLKRVIRTNYSNPPIHGAAIVAAVLSSPELRQQWEDELAGMRDRIRAMRLRLLAAIKAHGAAVDFSFVTAQRGMFSYTGLSAAQVERLRAEFGIYAVSTGRICLAALNSKNVDYVAAAIAAVIRD

SEQ ID NO: 7047 - protein, 117 aa, Chromobacterium substugae
MTATFPEVLVPQAITAGAFDADDADVRNNLGLLGLLDVYSRDGSYRLTVSLEPVDPDRQPSLWALEVEMEVCADGKVARRAGQQLEYSGSTPGSHLRKLLASGELHGYLLQGTAAAA

SEQ ID NO: 7048 - protein, 214 aa, Chromobacterium substugae
MSKTRIKTYDRIIQESLKLFNEQGERSITTNHIAAHLGISPGNLYYHFRNKEEIVYQIFTMYREFINQRLAVPEDRKMTVDDLVNYLDTAFLAMWQFRFMFYDLPGMLARNPQMQSEYHQFVNTELKNILGEHFREFIRLGLLKMDEEDIEGVSINIWLVVKFWFAFEQTSRPKAPITEESGHRGVLQVLALLKPYVQPEYMHAFRSLYERHAV

SEQ ID NO: 7049 - protein, 281 aa, Chromobacterium substugae
MHTLLDLVAFLRENYSHEITRSLLLILTLLIIRVVVDRLLAANSGVPVEERRRWSINTRNGLFLTGLAGIGFIWANELQTLAVSMLAFAAALILATKELIMCLSGGVVRQMSNSYSLGDHVEIGAVRGRVVDIGLLSTTVMEIGPNHSSHQMTGRALTFPNSLLLSTPVIRENYMGEYVMHIVNVPLAYEVPPARAEQMLMSAAESACLPHVDVARRHMEDMAKRYLVDIPSVEPRISIQPVDEKRYQLILRIAIPARERQRIEQAILHQFLADCYPVVQS

SEQ ID NO: 7050 - protein, 536 aa, Chromobacterium substugae
MSAELSRIAEEVSHRRTFAIISHPDAGKTTLTEKLLLFSGAIQMAGTVKGKKGGKFATSDWMEIEKQRGISVASSVMQFDYRDHTVNLLDTPGHQDFSEDTYRVLTAVDSALMVIDAAKGVEEQTIKLLNVCRLRNTPIVTFMNKCDREVRDSLELLDEVEDVLKIRCSPITWPIGMGKTFRGVYSLLNDAVILFEAGAEKLVSDIEVIQGIDNPRLDELFPLEMEQLRMEIELVKGASNEWSLDEFLAGTLTPVFFGSAINNFGVREILNALIDWAPAPQERDATVRSVDPKEGKFSGFVFKIQANMDPKHRDRIAFLRVCSGQFERGMKMKHLRLNRDIAASSVVTFMSHDREIVEEAYAGDIIGIPNHGNIQIGDSFSEGEELAFTGIPFFAPEMFRSVRIKNPLKLKQLQKGLQQLGEEGAVQVFKPHSGGDLILGAVGVLQFEVVASRLAAEYGVDAIFESASIWSARWFTCDDRKKLDDFVKSLQMNIATDAGGNLAYLAPNRVNLQLTQERWPDIVFHETREHAVKLND

SEQ ID NO: 7051 - protein, 47 aa, Chromobacterium substugae
MRELAGRRPQDQRFGADFDGLERGLLRCQGGVASQAKGDRGQAKWKD

SEQ ID NO: 7052 - protein, 694 aa, Chromobacterium substugae
MRPAASKLAQEEIARPQAKSLAEVLDALPGVNAGGSPRPGGQTINVWGFGDVEQVQVYLDGAGQGFDKYQQGTSFVDPELLGSVEVIKGGHSPFYGNGAFGGVVKAETKTVNELLLPGRSVGGFAKLGYQDNGHRFSQSLAAYAGGAGQPADILAYVTHSKGGDGTQPDGTPYRFSGGEQQGGMLKLGWRPADGHSLKLGFVRQDDELRTPWAARRGDIPAPSAYDIAKYGLEEAWLRKTVWREQTVESMTADWSYVSSDLPWLDLRLSYAQSRRFQHDTRPDGVNSSAFDSQFGKESWVSQRDKQWELRNVANLGEGWSSQQVTVGVAWSRKDRDAIAYMPSKARDPSYNYGLMNPRYSPPGSETMQSAYWVHEWRPLDGFSLTPSLRYDHIEVRGRQNLAPTYNNPAKGHDYSALAFAGWSPRLAASWRFLPRWTLDAGYAHTWRAPNADEVYDVQTLGSTTASSRQLRPEKLKALKLGLAYDGGGVLAAGDKLSASLAWFRQDVTDAIGQRIGPNRGDAPGAPLPAVIGFYRNLPGYVIRGFEFDSRYQWRGAFASLSLSSVVGERRHSLRDPWGKDEPMVDIPPRKAVLTAGYTFAPAGLTLGAQGKFVRAQDRVPQNVNPEAVGYAYPAQHGYALAGLFAVWQPATAGLKGMEVRLAVDNLFNRSYQPYLTEGAEGMGRAIRSSVSWRF

SEQ ID NO: 7053 - protein, 204 aa, Chromobacterium substugae
MFTGIVQGVAEVVAIEEKQDFRTHIVRLPQAMLPGLQLGASVAHNGCCLTVTQVDGDRVHFDLMRETLRITNLGELKTGDAVNVERAARFGDDIGGHAMSGHVMGLAEVVEVIESPNNRTIWFELPAGLEKYVFAKGYIGIDGISLTVGAVEGRRFCVHLIPETLTRTNIAARRPGARINIEIDPQTQAIVDTVERVLAQRGQA

SEQ ID NO: 7054 - protein, 220 aa, Chromobacterium substugae
MILRDLPVVASWSGGKDSCLALWRAVQAGARPQALLTMLDETGERSRSHGARPEVLALQADALGLPQRLGRASWNDYREVFVERLRAAAADGARAVVFGDIDLAAHREWEEGVCAEAGLEAILPLWQQARADLVREFVAAGFVARIVMVNAALADEKWLGRIVDARLIAEMLAEGVDPCGEAGEFHTLVVDGPLFARPLALRDGAVAHLGDYRALDLLPA

SEQ ID NO: 7055 - protein, 374 aa, Chromobacterium substugae
MAISPIQDIIADIKAGKMVVLMDAEDRENEGDLVMAAEFVTPEAINFMAKHGRGLICLTLSEERCKLLNLPMMATNNGTSFGTNFTVSVEAAEGVTTGISAADRAHTIQTAVARLAKASDLVQPGHVFPLKAQNGGVLIRAGHTEAGCDLAMLAGVEPAGVICEIMNDDGTMARLPELIEFAKQHGLKIGTIADLIQYRSRTESLVEKVGERPVETPFGSFDLHVFRDITTSATHLALSKGKIRADKETLVRVHEPLSVIDVLAPLCSHHSWTVPNALETMEETGGGVMILLYRDETGQDLAERALGQEAARQKWDSKTFGIGAQMLKALGVGKMKLMSSPVSLPSMAGFELEVTGFCQPGHFHVDGQGGPGVA

SEQ ID NO: 7056 - protein, 155 aa, Chromobacterium substugae
MLDAIQCIEPNFSGKGLKVGIVMARFNTPVCHGLRDACLAELEKLGVAAGDITLATVPGALEVPLVLQTMAQTERFDALVALGAVIRGETYHFELVSNESGAGVTRVGLDFDIPVANAILTTENDEQAEVRMQEKGADAARVAVEMANLHKTLRG

SEQ ID NO: 7057 - protein, 149 aa, Chromobacterium substugae
MKTARRRAREFAVQGIYEWELNQDRPASLIEKHLRENEYFAKADEALFRNILYGVLKDVSTLSAQIGRYYERAEDEVSPVERAVLLMAALELTQSPETPYPVIINEAIEITKTFGGTDGHKFVNGVLDKLAADVRGDEVLAQKQRRKQD

SEQ ID NO: 7058 - protein, 316 aa, Chromobacterium substugae
MNEFELIARHFQRPAPSALLGVGDDAAIVRPTPGCDLHMSVDMLVEGRHFFADVAPRALGHKTLAVNLSDMAAMGARARWALLSIALPKADEAWVAEFAAGFHALALEHGVELIGGDTTCGPLTLSVTVLGEAPSGQALRRDAARPGDDVWVSGELGLGALAVRQRLGWLTVDDADLLQTARQRLEYPQPRLALGRLLLPVAHAAADVSDGLMADLGHILAASGVAAEIQADALPSDPRLEALRARHLDCLAAGGDDYELVFTAPPQRRAQVEAAGAQCACRVSRIGRIVEGSGGKLLDAAGHPIPLQKEGYDHFG

SEQ ID NO: 7059 - protein, 151 aa, Chromobacterium substugae
MSHPAHLLSFGFGSGLMKKAPGTWGTLVAYPLFFPLLALGVDGWWLMALCAPLFALGVYVCGITGKALGVHDYGGIVWDEVVGMLMVLAFAPASWQGWLLAFALFRLFDIVKPWPIRWFDQRVGGGFGVMVDDVIAALFALAAQWLIWRAL

SEQ ID NO: 7060 - protein, 969 aa, Chromobacterium substugae
MFLLLLLAAAGWLVKTGKISLPSLTSKLDGLLGVEGRPERYEPDYFAEPRETPPAPEAEAAMAARSEDSVDAPEIETVPPQPEPPQAQAVRPEIRLPRRVAPPPEAPRETIVLPRRPEPPAREAPVELPKLELSREYRKKTRLPPRSREDELPVIGLSEMQSNMRQDFRRRQRASGVAMPAGEGELPVIGSHEVREKVASLHAHRRAAPPVQPSLPKVELAPIVRANLPPAGKPAPAFRPPEAVAHPQAAAMIRPAAAPAMPAAETAARPVAMPVEAAEPPAAAAPIPPSEPLAAAAESISAMAPQPWPVLDSETAAMAASAPDEPEQTTTELTREAAPVAAAEPAAQTAPEWQAAAEAEAGFDAETEVETAAADDEPAQAARTPWRWPQTREVLVQQENARPAIVQQTVLQSEALAAPSLAATTDKLAANPMPWVLIDKAADAPPPEPSLQAADAEASESTAEAPAWTERAAYDDSILPGLELLRPADAVTVACSQDELLERGIVIEEKCAEFKVKVSVVDAYAGPVITRYEVEPAVGVRGNQVVNLMKDLSRALGLASIRVVETIPGKTCMGLELPNPKRQMIRLSEIFAADVFQQPASRLTLALGKDITGEPVTMDLAKAPHLLVAGTTGSGKSVGVNAMILSMLYKATPDEVRFIMIDPKMLELSVYNDIPHLLAPVVTDMKLAANALNWCVGEMERRYRLMSSLGVRNLAGYNQKVREAAEQGQRISNPFSLTPETPEPLDKLPFIVVVVDEFADLMMVAGKKIEELIARLAQKARAAGIHLILATQRPSVDVITGLIKANIPTRIAFQVSSKIDSRTILDQMGAESLLGQGDMLFLPPGTGYPQRVHGAFVTDDEVHAVVEHLKQFGEPDYVEGLLTGESEADEASADATAKAQAATESDPLYDEAVEIVLRTRKPSISGVQRHLRIGYNRAARLIEEMEAAGIVSAMESNGNRTVLVPQRDF

SEQ ID NO: 7061 - protein, 174 aa, Chromobacterium substugae
MPLHNHQTKTARVKLMKSIVMAACLLGVSFAALADGKSDCRAAAGSYLTGTVVSGPQFASGQDLNGVELSHTHVRLRADQDGRTYDVAMDNVYASGYDTAGESVPYPLSTIQAGDRLQLCGQLYTSGVGIHWVHSNCGVKPTSRQPNGWVKKINADGSVSGNYEANTEYCQLWP

SEQ ID NO: 7062 - protein, 44 aa, Chromobacterium substugae
MQVLLFAALVAAVIAVAKLLATPEQEQPRLVPIRIRRDEASRRR

SEQ ID NO: 7063 - protein, 396 aa, Chromobacterium substugae
MFIDFFYALRNAGLPVTLKEFLTLLEALRLHVAFGSLDDFYYLARTALVKDEKHFDRYDQVFGQHFRGLEMALDDLQRAIPEEWLRKQAEKYLSDEEKRRLQALGWDKLMETLRQRLEEQKERHQGGNKWIGTGGTSPFGAFGYHPEGIRIGQNQSRHRRAVKVWDQREFRNFDDQVELGTRNIKLALRRLREFARDGAEEVLDLDATIAATARKAGMLDLRMQRELRNSVKVLVLFDVGGSMDDHIRACEELFSAVKSEFKHLEYFYFHNCVYESVWKDNNRRQSQRFSTWDLIHTFGDDYKLIFVGDASMSPYEIAYPGGSVEHMNEESGETWLKRLLAHFKHAVWLNPLGEEHWQYTQSVAMLRQLMAQRMRPMTLGGLDQAMRDLKKTAARA

SEQ ID NO: 7064 - protein, 476 aa, Chromobacterium substugae
MDAIKMPTQEEGSLLEAFGRLKSIAQATPYPALEMRRAWLGALERLIQENRETLIAAVNQDFGQRSAVETRLAELFPSLEAIRHARRHLKGWMKPERRRVSFWFMPASASVLPQPLGVVGVVVPWNYPLFLAFGPIVAALAAGNRVMVKMSEYTPATGALLSELALRYFGRDLLTVVNGGPELGQAFTRLPFDHLLFTGSTAVGRHVMRAAADNLTPVTLELGGKSPALVARGADLRRSAEAIVAGKLMNAGQTCVAPDYVLVNEKDCGLLLDEIRAAAARAYPTLADNPDYSAIINDRHYQRLQGWLEAARQAGARIDAVNPANENLAARRKFPLTLVQRCPDDCALMQEEIFGPILPIVAYDKFDEALSYINKRPRPLALYLFDNDPLRVERVLKETVSGGVSVNDTLLHVVQDDLPFGGVGPSGMGHYHAKEGFLAFSKLKPVFRQSRLSGSRLTRAPYGRMVEWLLKLMLRR

SEQ ID NO: 7065 - protein, 172 aa, Chromobacterium substugae
MPSRRELLKTGALGAAALLLAGYWATPQADPLAQPGGAATLWLQPQDAAIIRALAPVMLGLDGLPLEQVAAGVDRAVLGLPPALRQELRQLFDLLQNRWARRWLAGIGSPWASAAPHELERFLRRWRNSRFQLKRSVYQALHQLINAAWYGNPASWAALGYRLPEGVVGMLP

SEQ ID NO: 7066 - protein, 536 aa, Chromobacterium substugae
MSGKIPDPIRAGLALGWKAFDGAAQGQDLAWDADVAIIGSGAGGAVAAEALSAAGLDVLILEEGGFYSSSDFRMLEAKAYPELYQESAGRQTADKAISILQGRSVGGGTTVNWTSSFRTPPDTLRWWQERYGLASLTPEAMRPWFEKAEARLGIAPWDGQPNGNNLVLERGCQALGLRHARIRRNVRGCWNLGYCGMGCPTNAKQSMLVTCIPQALEHGARLLSRARVDRLQANQSSSRIVQVHGSLLAADGVLATGRRFVVRARHVVLAAGAIGSPAILLRSGLADSSGQTGKRTFLHPVALCAAQMPELIQPFNGAPQTVYSDHFMHTQSLDGPLGFKLEVPPIHPLLASVTFPGWGARQAQLLRQLPHLHATLALLRDGFHPDSQGGEVRLRGDGSPLLDYPLNDVIWDGVYRSWLAMAELQFAAGASLVMPLHERAEPVSSWRQAREQIAELPLQALQAKLVSAHVMGGMAMSDDPSRGVVDEYGRHWLWRNLTIIDGSIFPTSIGANPQLSIYAFAWRAADALIRQLGREG

SEQ ID NO: 7067 - protein, 117 aa, Chromobacterium substugae
MDLQQALLKHVEWETRFRVAIFMQERMDEDNIGRDDCCELGKWLHGPGQSRFGHLSVYQTCLSRHAILHLEAAKIAGLVNRQQFSQAEQALDDGAYAVAASAASVAIEQLRQQTEPR

SEQ ID NO: 7068 - protein, 618 aa, Chromobacterium substugae
MTEHTAPDLESSLRRLCQEPGKTETLALLVAALRPGNGQAPQQSTVNLQALSFLLEHHADYRQALRLALCTLLAETRQIPLYTEAGILANDGFGTTLLHRLGERALPMPHNPDSLRDRFGLLFSHKHDYLWLEAVPDATWHALWRALAWDEAPRQDSERQTRLQLLESVQVLSARITAIGLEPELVRVCPEVERFASPFMHLNAEVQRYVDGYHQALVDGTPPPEDEKQVLVLLEQCEAILGKVRKNAARYGISVSLTYHGLRLAQSIARLRALLELLSPEHDPAEKPQLFRLLVDFARAENRKYSLRDLFKSNTELLALQVTEHAGRHGEHYIAEDRRDWAKMGKAAMGAGFIVGFMALIKLMLARGHLPLLWEGIAFGLNYAIGFIIVQILHLTIATKQPAMTAARLAAALHEQNGRKKQLEVLADLITKVVRTQFVAIMGNVLLAIPTAALIALGWSALFGAPVVDAAKAQKLLHEIDPLHSLALPHAAIAGIFLFLSGTIGTILGLPLDIRHITFSSANLAFASVALDFQVPLSAVLLGCAGVALIGMTNLAVSFFMALWVALRSRKLSGTMLLPLVPMLAKRFLRQPLAFFLPPPSAPQAETETAPPLDESRG

SEQ ID NO: 7069 - protein, 194 aa, Chromobacterium substugae
MSNGSDSKNDTRKRILDLAEELLLTRGFNGFSYQHISSALGVRNAAIHYHFPKKSDLGVALIQRYRRRFLRFTEQQADWDAPRRLESYFGLSDQYYQQHKQICPSGILSTEFQTLPEDMQQEASAFIDEMRQWAVAIVRLGRDVGLMRYAGTPEAVGMMLFSALQGGLQLARIDDGALPLLKQQVRVTLGLGES

SEQ ID NO: 7070 - protein, 170 aa, Chromobacterium substugae
MEYRKNSMSRIADKVGRLPVGWRRPVLSMMFGKIVPFLSTAGLRFEDVGHDKLTVSIRNRKKVQNHIRGVHAAAMALLAETSTGFVVGMNMPDDKLMLLKSMKVNYVKRSQGDMRAVASLTPQQIQQMYEQDKGEVLVEVLVTDDSGESPIVCEMLWAWIPKKRPEASAA

SEQ ID NO: 7071 - protein, 271 aa, Chromobacterium substugae
MIDLQTLTVELNDKVALLRFNRADKANALNQQMWQDLRSALDWADAESGVRAVVLAGHGKHFCSGIDLSMLMGLQALIQDECEGRKRDKLRRVILDLQDCVTSLERCRKPVIAAIQGACLGGGLDIVLAADFRFAAESAMFGVREVDIGMVADVGSLQRLPRVVGEGVARELALTGRDMAAREALDVGLVNRVLADADAVLAAALQSARLIAGKSPLAVRGSKEVLNYSRDHSVADGLQFVAGWNAAMLISEDIQKAGMAAMLKQEASFRD

SEQ ID NO: 7072 - protein, 397 aa, Chromobacterium substugae
MNKYARLSLIATAAIAMVACSKQEQPASGQASSAPAQAAGGDAAVVKIGQVSPMSGPISHLGKDNEYGAKLAIEDLNAQGVEIGGKKVKFELVSEDDQGDPKIGTQVAQRLVDAGVAGVVGHLNSGTTIPASKIYSDAGIPQISPSATNPDYTKQGFKTTFRVIANDVQQGKALGEFAAGELKAKKIAIIDDRTAYGQGLADQFEGAVKAKGAEVVKREFTNNTATDFNAILTSIKSAKPDLVFYGGMDAQAGPLAKQMQRLGIKAKLMGGDGWQTPEFIKLAGDASDGQYASSCGVSRDKMPGFKAFDEKFKKEFNTDVQIYAPFEYDAVMVLVDAMKRAKSSDPKAYLPEVGKTDYSGVTGKIAFDDKGDIKNGAVTVYQVKNGKWEVVSTVGGN

SEQ ID NO: 7073 - protein, 364 aa, Chromobacterium substugae
MAMPRYLPEPAFRHDYAPKTGVLLINLGTPDAPTAQALRPYLKQFLSDPRVIEIPRLPWWLILNGVILNTRPKQSARKYASIWTKDGSPLLTHTRSQAKLLKGQLGEMGMTGLVVDYAMRYGNPSIESVIGKMREQGVEKLLLLPLYPQYAASSSATALDEAFRVLTRLRNMPEVRTVRHFHDNPGYIAALAAQVRKHWQYGQQPDKLVMSFHGVPRFTRDKGDPYHCECQKTGRLLAEALRLAPDQYVISFQSRFGRTEWLKPYTSEVLEQLGKAKTAKVDVICPGFVGDCLETLEEIAMEGKQTFLSSGGGEFRYIPCLNEDSQWIVSLATIVKDNLAGWLENPAEDGRARQARAREKGASS

SEQ ID NO: 7074 - protein, 766 aa, Chromobacterium substugae
MRFFKRKAVVKNNQTPLPPQLAALLREAWWLLMAVAAVYLVLVLASYSPQDPSWSHSSSDPTVRNYGGAFGAWLSDMLLYIFGLSAWWLVVFCLVAIGWGYRRMESLGFKFSPITMAAVGGFFLLLLSSASFEAIVLEGKAVTLPLEAGGMLGHFIGKGIAHGLGLSGAYLLLGVLSAIGFSLFTGLSWLDLMERIGAALEDGAIRLWNGWQAKKDREIGKETAQKREEKVSVAKKKIEETTPVRIEPPVLEVPVSAKAQKPVQQSLFADPKDAALPGLTLLDAAKEQQEPVSQDTVEYTSRLIERKLADFGVDVKVIAAYPGPVITRYEIEPAVGVKGAQIVNLMKDLARALSLVSIRVVETIPGKTYMGLELPNPKRQIVRLTEIIGSDSYQNMASKLTIAFGKDIAGQPVSADLAKMPHVLVAGTTGSGKSVAINAMILSLLYKATPKEVRLIMVDPKMLELSVYEGIPHLLAPVVTDMKQAANALNWCVGEMERRYKLMSKLGVRNLAGFNQKIKDADKSGEKIPNPFSLTPETPEPLDTLPLVVVVIDELADLMMVAGKKIEELIARLAQKARAAGIHLILATQRPSVDVITGLIKANIPTRIAFQVSSKIDSRTILDQMGAEALLGQGDMLFLPPGTGYPNRVHGAFVSDDEVHHVVEFLKTTGEPDYIEGILTGQADGDDGASSSGLDGESDAEADPLYDEAVAIVVKTRKASISSVQRHLRIGYNRAARLIEQMEAAGLVSAMESNGNRTVLAPARED

SEQ ID NO: 7075 - protein, 132 aa, Chromobacterium substugae
MAEIKQTFGGAGGALQGVNMSGSQVTFYWGDALVNITVGSTSYGGNTKGLQSLTVTMPNDGVVILKKMQARTNQGYMVVSYLEFDLSGSIKKVGNFNANSATLEAMDGCQITFTGISSGGLIDRLQYRILPS

SEQ ID NO: 7076 - protein, 367 aa, Chromobacterium substugae
MSELYIGMMSGTSLDGVDAVLARFDAEGRPELLAEHALPYPDEVKAEVLALQPRGDDELHRSARLANRLAEIYARAAAELLSRSGHAPADIRAIACHGQTIRHAPHAGYTIQLGNMSRLAELSGIDVIADFRSRDVAAGGHGAPLVPAFQQCVFSSERERRVILNIGGISNLARLHPGREAIGFDCGPGNMLMDAWCLRHTGQPYDDDGRWAASGRVDPPLLQSMLAEPYLREAPPKSTGRDLFDDDWLARQLARQPQTLAPADVQATLLAFSASCIADAILRHCPDNQAVYVCGGGARNGALLAELARLLAGQNIEPVEALGLPAQLIEAIAFAWLGWRFNQRQAGNLPAVTGAQGPRVLGALHPR

SEQ ID NO: 7077 - protein, 444 aa, Chromobacterium substugae
MDYRKLLHIPQKCASKLINHHLSWLGVAACLPMLGTATAFAVAVGAKETRGPEVVQQQVVERLALPKFQFADSQTRYWRDESIKRGDTVARVLNRVGVRDKEANAFLYTSPLAKDLLKLKVGATLTVQTNDAGELFGLRFLQDDDNGEQVLVALEKRDGKWQASADPVAAESVETVRSITLKRSAAAELTAARVPADIRNQLSEVFADQFELSSLKRGDRINLVYETMVYAGASIASGNLLAVSIERQGKLHQAFYFAHDSESGAYYDAAGRPVKKGFSRQPVAGARISSGFGLRMHPVLHALRMHSGIDYAASAGTPIVAPADGELVKVQRENGYGNMVMIRHNSKLSTLYAHMSAFGKGVRAGGKVKAGDILGYVGSTGRATGPHLHFEVRINDQPVDPATNALQAPDLGKTQLAQFGAKRAQLSARLQLLQNIPVNVAQVD

SEQ ID NO: 7078 - protein, 345 aa, Chromobacterium substugae
MVKMARIRNPSGKNMKLILLLPGLAWLDAHDGGEVSKALPLPALQQMLGKGRLERKERGLSACVEQLWGAPPAGLAALAAEQAGLAGDGEWLFADPVHLRVDRDRALLADVGVMQISLDEARGLTDALNRHFGEDGLAFHPQQAGRWLLNAPKPLTARFDPLWDVVGEDINRHLPQGEGGLAWSRMLNELQMLLYTQPLNDAREMRGDLPVNSVWLWGEGAPAPWKAPAPALLADDESLQLLAARSGMAVDAAPFAFDGLPLDGDCLLMLDALQAAAQYRDAWGWREALQRLEQDWFAPLQGAVRQGKISELTLIATGPAGFELTLKPADLWKFWKRALPLAALY

SEQ ID NO: 7079 - protein, 562 aa, Chromobacterium substugae
MSQIVTREVPVPLQQTLLQQGLTPLQARLYAARGIADSAELDYGLKGLLPFQNLKNAEAMAMRLADAIAARQRLLVVADYDADGATACAVAVKGLSALGATIDFIVPNRFEYGYGLTPEIVELAARQRPDIIITVDNGIASVAGVDAARARGIEVLVTDHHLPGDTLPDALIVNPNQPGCEFPSKNLAGVGVMFYVLMALRVEMRRRGVFDERSQPNLGELLDLVALGTVADVVRLDRNNRTLVENGLKRMRAGRMAPGIAALFKVAGRASYKANTFDLGFTLGPRLNAAGRLDDMSLGIACLLSGNEQQATALAQELDKLNRERRSIEHGMQDEALAALSGIDAGNRYTLTLFRDDWHQGVVGIVASRLKERFHRPTIVFAPGDEGEIKGSGRSIPGFHLRDALDLVYKRHPGLILKFGGHAMAAGLTLDEGRFGEFQQAFEAAAQQLLDEKQLTRTIETDGSLPARELSLQLAEQLAAEVWGQGFPVPYFHDQFLVVNQKLVGDKHLKLRLAREGQEFDAMLFNHADWLPDRIQAVYQLIANEWQGRKELQVYLQHWAEA

SEQ ID NO: 7080 - protein, 526 aa, Chromobacterium substugae
MESEMEMLIIGLLVGLMGGGAAWFAARARAARELAELKQQAAQLDAQCAGLREQLDEARRRESAAAQTAQEQSRQLADGQTQLGAYVARAQRVPELERQLDEREKQLEALRGELRAASSQLAAREEQGRVLEALEARSLQQGQDITRLTAREQELATLLESERRQNQEKLALLMDARQALSDQFKALAGDILEEKSKRFTEQNQQNLGALLNPLNERIQNFGKLVQDTYDKDSKERLSLEVELKRLQELNTRLGDDATALTNALTGASSKAQGTWGEMVLEKVLETSGLHKDREYRVQVSDVVQTEDGAKRYQPDVVIDLPEGKQLVVDSKVSLNAYVRYTAAEDDAAREAELKAHIAAIRAHIRTLSEKRYQDLYQLNTLDFVFMFIPVEPAYLLAVQHDMSLFNEAFERRIMIVGPSTLLATLRTVASIWRYEYQNQNAQEIARQGGAMYDKFAGFVANMEKLGKQLDSSRDTFGDAMRQLSSGRGNLMSSAERLRKLGIRNNKQLAAQLRLDDAGDGEEDGEA

SEQ ID NO: 7081 - protein, 370 aa, Chromobacterium substugae
MSKIRVGLIFGGQSSEHEVSLQSARNILEALDQDRFEALLIGIDKQGQWHVSQPADFLLNADDPARIALRQSGEGLALVPGQSERQLVAAADAHPLAQIDVAFPIVHGSLGEDGSLQGLLKMANIPFVGAGVLGSAVCMDKDVAKRLLRDAGLSVAPFVTLTRGKAEQADFAAISAKLGLPLFVKPANQGSSVGVGKARNEAEFRAALAEALRYDHKALVERAVVGREIECAVLGNDHPQASGCGEIVLNDEFYAYDTKYLNEGGARVAVPADIPDEACQRIRRIAIQAFQALECRGMARVDVFLTPDGEVVINELNTLPGFTNISMYPKLWQAAGLSYAELITALIELASEQGAMDAALCRSAGLPGSA

SEQ ID NO: 7082 - protein, 336 aa, Chromobacterium substugae
MKMTFAIKTAGCAVAAALLAGPVLAKDFNVAVVYDQAGKFDKSFNEAAYTGAERFKKEFKINYREGQPSNDAQKEQVLRNMARKGADLVVAVGFAYSQAIETVAKEFPNTKFTLVDSVAKGANVQSIAFKEQEGSFLVGMAAALKSKTGKVGYLGGMDVPLIRAFGCGYAQGARYVNPKAVVLQNMLGTTHTAFNDPSRGNELAKSQYDRGADVIFAAAALSNVGVIQAAKASGKFYIGVDSNQNYMQPGTVLTSMVKRVDNAVYETMRDAKDGQWKPSVKLMGLKENGVDWALDKYNRALITPEMEKKIVAARKDIIAGKIKVVDYRAGNSCPVN

SEQ ID NO: 7083 - protein, 451 aa, Chromobacterium substugae
MKDLTEGAITRHILTMAAPIAIGMIFQALYFLIDLYFIGELGANALAGVGAAGNAAFLVLALTQVLGVGTVALISQAVGRKDRAEANLVFNQSLMLALLVGLTVLLLGYAAAHAYMASVSSDPATIAAGRTYLHWYMPGLALQFALVSMGSALRGTGIVQPTLVVQLLSVIINAILAPVLIAGWLTGHPLGVAGAGLASTLSLVAAVAALWFYFHRLEHYVSVDRRLLAPRWREWGRILAIGLPAGGEYALMFLFSAVIYWAIRDFGAAAQAAFGAGSRLVQGLILPAMAVAFAAGPIIGQNFGAGRADRVRSCFGSALLLISALMAALAGWVYWQAESLIGYFAKDGEVVRYGVQFLQLISWNFIAQGVIFTCSSVFQGLGDTRPALLSSTVRLLAFVAPVMWLTAQGGFAIEQVWYFSIGSTFIQALVSLLLLRQQFSQRLRPAAAFAR

SEQ ID NO: 7084 - protein, 116 aa, Chromobacterium substugae
MKDPCDHYTFDLIGGVQKKPGRKPLGERAMTVAERKRRSREMRRNRLQELSVTVELSRDAQKSLDKMIEWWGVSKKEAINRALLIACQSQTGRTGTLFDFELPPQGKKPSRRKPQG

SEQ ID NO: 7085 - protein, 422 aa, Chromobacterium substugae
MTPQTAARACGIDFGTSNSTVGWLRPGQDTLLQLEDGKITLPSVVFFNYEEDHSRFGREALREYIDGYEGRLMRSLKSLLGSSLIDSQTEVQGKALPFRHLLTLFIKELKLRAEANAGRAFDEVVLGRPVYFVDDNPQADKLAEDTLADIARQVGFKEISFQLEPIAAAFDYEASVQKEELVLIVDIGGGTSDFTLIRLSPDRRAQAERRDDILATGGVHIGGTDFDRQLSLHGVMPLFGFKTRLRNNAEMPSSQYFNLATWHTINFAYTRKAWMDLQDVHRDAAEPNKLDRLFRLIQERAGHWLAMEVEAAKIALSDQAQHRMALDPIETGLSCELSREDFEAGIAQMLDRVATTVSKLLADAQLPAEAIDTVFFTGGSSGVPALRASIRALLPKAHHVEGNLFGSIGSGLAIEAMKRYGC

SEQ ID NO: 7086 - protein, 363 aa, Chromobacterium substugae
MLPDTPPQTSRNASPLLIQAQSDTQAVLAWLAEHTSSAATLASYRKESERLLLWLASRGQKLAQVRREDVLDYQRFLAAPHPAEQWIGPPRPRSHPHWKPFSKGLTPHSAAHSLTVLGAMFSYLNDAGYLNGNPFKLLRRRAPRQTAEVERFLDGECWRHIQATLDRLPRDTAKAVRHAERAQWLFTLLYLTGARRSEVAGAVAGDLARRHGNWWWNVVGKGGVRARIPLSDELMAAYGHYRQTLGLPADIGIGDDTPLVCRIGAKNRAGPLSDKAIYLICKEVFARALQHAPNDETRAQLARASTHWLRHTAASHQLEAGVPLLLVSQNLRHASIQTTRRYLHSEEDARHQASRLHRLKPED

SEQ ID NO: 7087 - protein, 486 aa, Chromobacterium substugae
MQESAAIRPARYLSDDDFKRYTPVHVVWEITLACDLKCLHCGSRAGHRRPDELNTEECLQVIDSLAALGTREITLIGGEAYLRKDWAQLIRAIRGHGMYCAVQTGGRNLNPARLQQALDAGLNGIGVSLDGLAPLHDKVRNVPGSFDKAVDALRRAKAAGLAVSVNTQIGAATMPDLPELMETIIDIGATHWQIQLTVAMGNAVDNDQLLLQPYQLQELMPLLARLYKSGLERGLLMNVGNNIGYYGPYEHLWRGFGDERVHWTGCAAGQTVMALEADGTVKGCPSLATVGFSGGNVRDMTLADIWQHSEGMHFGRLRSVDDLWGYCRGCYYNDVCRGGCTWTSHSLLGKPGNNPYCHYRVLDLQKKGLRERIVKLQDAAQASFAVGRFDLITEEIATGKVVSQISRNGQVIELTWKNQGKRAPEIGQPPATLSICRSCKQYIHPEEKTCPHCAADLAAAESAYRQEEANRRQIVDRLQRLLGIGA

SEQ ID NO: 7088 - protein, 202 aa, Chromobacterium substugae
MSAAGLFHTRLTVASPNLGAPVLTLDLVVDTVSKKVAGAAQIFQSTNPPVQFHANVWGHYTQAKLDKATEHHIVLSLEGSPSSPNSMIAETFNLQGILEQDWTKGYASYRFFYQGAWHSVVHAVVTEDKLAPGKQPHAGNHARHHPVMPLYAAALQQSRGSTDVAQLKALASQAEEQLKQHDNIQNALTQLKDEIIRLEKQQ

SEQ ID NO: 7089 - protein, 211 aa, Chromobacterium substugae
MSGNTQALEGLFPVSYIITTGAPGAQNLQLNLLVNSAGETVTGTAHITQATNPPLDLHSDVRGQFTYLTIMPPSEGRILITAQGNPGGPHSNAAVNFKIHLVLEHDWKKGVANYSYFNGQQWVEVENAPAKLNDKLQSRRHPEIPLEPGPVIPSGGRVIPLYGVPIQSAIASGDLTHMKTLANLAQQQLDSRPQLEAALAELKAEISKLGG

SEQ ID NO: 7090 - protein, 50 aa, Chromobacterium substugae
MPYGAAIQQAISEGSLSQMKQLHQQSEQYLNDLRAQLKELENEISRLERR

SEQ ID NO: 7091 - protein, 158 aa, Chromobacterium substugae
MISPLSAPSPYSAATPEPDAPVSLQQRLAAAASETPQTRPTGKWPDYDTDPKAMAFLAALQQLPPALSDAQADKQAQIDAIAKLLRDFQYPADSAAFVTLEEQSAILQRTLARLGETSPLHAPLMAVMLGTSNLQFQMKKWMQDVVLSDGTPPEFDEW

SEQ ID NO: 7092 - protein, 220 aa, Chromobacterium substugae
MLIRSQRLGQAARLGRLDGQARQHAQVLLREARREADAIRQQACQEGYRQGMQEALGQVAAHLADSRALAEQWRLRLGAEARAMLSAAVDHPDTLLLLLDEWLRAQDGARSDVLTLQLPSRAKALQPRLMALLAEHWPGAIRIDYHSEPRFVMRCADQAAEFEPEQYVESASRQLLQALDGLQEDCRRIAADSLAHLLRERERNPESESAPAAARQGDAE

SEQ ID NO: 7093 - protein, 192 aa, Chromobacterium substugae
MADTGLGSQACAILFDPLGYLHRERLSLPDEMRGGGQRAAVNDMLIAAYRLDTAWPAGPHSHATRQWLRHWARLPQAAYLMGCQLLRPSLARQGALLRLPPWARDFAAMPLAAPAAPALPRAPDHADLLAAGYGQLLAWSGQLPRALVQRLPLLFPPATVLAARPAALPDPLLLTLALQHAQRHPHSPSFLH

SEQ ID NO: 7094 - protein, 251 aa, Chromobacterium substugae
MMRASLKAALLALLLAGCQQKDLLKGLDQQQANEVVAVLQRHNIEADKTDRGKTGFSIAVAQPDFAAAVDWLRIYNLPSRPRVEVAQMFPADSLVSSPRAEKARLYSALEQRLEQSLQTMDGILSARVHVSYDLDGGEAGRTAQPMHISALAVYDSEADPAAMINNIKRFLKNSFAEVEYDNISVVLSRRGEAQQQPPGPRRDEGQSGAAWWLAGLAALLALAGAAGWFWHRRRPPAPATAPAPAAGESHG

SEQ ID NO: 7095 - protein, 100 aa, Chromobacterium substugae
MNPIGASQLHALAQSGDLARGEDRLVSLEERLIQAFSRSAVSAGMEKDAILQKLEQPEIITNPAELFELQQRTSNYNLEVSMISTLSRKTVGAVESLLRS

SEQ ID NO: 7096 - protein, 83 aa, Chromobacterium substugae
MAKIDFPWSGYLDETSAKFDEGVKNMHKQVEDALAALKDKPSDPELLAQYQSKLSEYNLYRNAQSNAVKAFKDIDAAIIQNFR

SEQ ID NO: 7097 - protein, 389 aa, Chromobacterium substugae
MAVEDTHTSASAAIVARLLNSPLRGCEFPLPAGRTLFVVGPEPMLDSAATLPELPADTLYVPLAQGGVNFELQAADGRASIRQLGEHAADAYPAELNRALKIGELELALRHPGQAWAEDILLHPQAAAPAAERPDRASRPAWPAALAIVLLAALAGGAYWLWDTPQRQAAQLSALLGRDAQRFQVLPGRDGAFYVAAADDRDAAWARQALLRGGGLARVINPRRENERIDRWLADSRPGLAYYRLQLDDPRRPQLWTSLQRSALSAADTAALSRQLAGQLPYAERVDIVPMDDAAAAREAEAGLTRQALPFSRNKHPDSVTFVIEGALDDGELQRARQFVDGYYRQWGSRYVQFATELKDDWLKGKSFKYGDQGYVKMETGHWYFPKPL

SEQ ID NO: 7098 - protein, 146 aa, Chromobacterium substugae
MSRAWLAGAALLCALPAHADCWEQAGRMFNIEPDLLYAIAEQESGLRPDAAGRNRDGSRDLGLMQINSLHLPRLRQLGVDEKRLLGDACLSVIVGASILSDMMKRYGYSWEAVGAYNAGVGPERRTLRMRYAHQVWQRYQRLRASR

SEQ ID NO: 7099 - protein, 561 aa, Chromobacterium substugae
MALHNDGFINRQFVFGDFVLRFDGALVHREQQLSIPPKELAVLTALLEAAGELVSKDSLLDRVWPDGDVNEESLTRCIYALRRILLEGKDNRYIDTVYGKGYRFCRPVAVVSRPTPNAEKCTMAVLPFRTDGQLDALELHAALVQCLSRYSPFGLIVLPATITRNCSDVADIMSLIDQLRPDYYLAGQVRRHGGASQLQIELVRADGHQLVHHESMELGPGQPIAALHSRLASLLPQRIPGLRWKQGNASELDSLDLAVAYLNSRHQLQRHTPSSLRQALTMLHQCVSGNPSHALPYCSLAECYLTLAQLGLFDQALALEEAQQAVNKAIALEAGHPQAMGLLALLSSMRAQIAVADALFEQARLLAPDSLDIHYYHAWHLFLSNRLEQAQQAVDACLARDPSRIAAGILKLWLTYCQHRVDDAVALGKSQLCQYGQDHPVLQSMLALMLAVQGQHAQAEELAAAVRASGEECGLLAANCCYVRHCSQGEAARPQLLDFLAKVDSRQVRSGLLPLILALHGREAALQLLGQLQAERYLWLRAWRHDPRLASLFQQPLPEAA

SEQ ID NO: 7100 - protein, 46 aa, Chromobacterium substugae
MARATVCDRRVPHPCRRPSVKLTQAARRDLHKTPFAPGRFSDFSHL

SEQ ID NO: 7101 - protein, 123 aa, Chromobacterium substugae
MVNGVSGAARPYPLAEARQASHGAAASGLAQRCRGCGMSPQARPQPAMAGSQVGGFQSCLDGLRRDLDGAGAMLRQLSGDAGLPSRQQAQAGQLAQRLDGLSQALERGNRLALAASLIGARGA

SEQ ID NO: 7102 - protein, 860 aa, Chromobacterium substugae
MLDAIGANGAATLRGFRALPDGEAAPAANLGRALRGAAGRPERRAAMPRGAEIKLADAELRLQRQGMREVLRAMTDEARRLAEPAPRPRWAATLRLGNASHRLTSDSVAILQNLRQALREGSGDALDIRECAKLSLQLEKLAEKLPADSPLGELSRRLALQGQAAWAQLARADVERQLLPQFLRFDQPGAASERHLGVSVGVGIGLGEGGLGAKATVGLGANLSRGMDNDDEGFVFQNRGHAVSVQAGVRAGVGAATLSGAAEGRRQVTRFTEFNSAKAFVHLRAEQLGHGSRRETLGVSARTVVGALIRLFRPGHGNELRHYHRLQQQAGDQQQRVAVLLGWLGRRDASAALPGARVPVLPGGESVAIRGAVSARAAAVGLSAGVGAALERIDIRADALTPFWQGVAAEAGAARDPVVAAQRLAGIEQKAQALFDQVGDKPGARPLSRLTGGLRLADCPPEALKSAVGRLAAEFEHFCAVARQLDAGIGRREGGAQVEKSILASWQGKSREDALANMALAHAALLLAAGRREGADDARAALLEAAPGLYAPPIRHDAAALAERVSFRDTLALQIRDRSYALDLGGGIGPLGVKAEASLTERERVHPNPARAGSYKDVRVTLSGSLGDAGALDKLKDALLAQLAPHGLADQLPAALAGAQSQLSAQTGAGVTLLLRFYQPQYQRQADFPAAAAGYRLQLARVSASVDGSAALSGGVPLQPGVSLELGLSAGASSSAVLHERWGDNSLSAPMMHYLHLQAVGEPERWPALRESQREALSGLFRQLADDGAAVHQEAGYFLARQPQDGFGERFFAAMRAFASGSGGFDAAGAALEALLQRQYPLWQADKLSFPGLVELPLPA

SEQ ID NO: 7103 - protein, 444 aa, Chromobacterium substugae
MHISSLQPSRPLSSSSAADQAQAVRSFAQVYDKADFKPVPNQIHMVWVGSQPGQTQQDYLRQWAAKNPGSEVNLWVDSKQFGAYAANREVRQQVDKLFPDAGAFQAEKLFRGLFSQLAATLGKEDGALGRAAQKQALSELNKELAAPGNEAWREALLPQGGKVTGDNAAAALDAFRQLVRGNDEKFLLADRLILDQTVKAWDRCAAGAERDVAALERLQAGFADAPNVKVRDLSHAGDIQLRNRDAYQHEIIGRNGAYPAASDIARYEILHNYGGVYADIDLECTQPLAGALSAHPDLMLVGLAEGKREASGSATPYFANALLASHPGSKMLDGFIDKIGRDYQQMKGAEFAGDRYFSRANKSTIEGTGPNALRGHVDAVLREAEGRPEAARGDAQSLAERIWSQDDTRNHDFWAAMDSHFRFPDGLVNFETEEQQQSATKGMA

SEQ ID NO: 7104 - protein, 255 aa, Chromobacterium substugae
MTDNDVLNPLETLGAAASRGVASQEAWLLQPREGRAARLALDWASGGEMLELPAGWRGLLLLDRLELTVLDGGVSFQPMRLEALTKLLSFVDEARDAEQQASECRCALLPLGEDEVWTDRRGCEYWFLRQVLAPSEPFQALLSLLRRSESYWLVRFLLAQSERGDKLQELGERYGVSYSHFRRLCRNALGGAAKTELRDWRMARSLLDVVEGRDSLTQVALKHGYASSSHFSNEIKGLIGVSPRGLSNIIQLATK

SEQ ID NO: 7105 - protein, 564 aa, Chromobacterium substugae
MLAACLGCALSLPPASALAAPPAERAGEDAGYVARKDSLRAFFDALSSRLKKPVIVSKLAARKQVSGDFDLSSPQALLEKMSQQLGLIWYHDGQAIYVYDASETRSAVLSLRNVTLSAFNDFLRKSGLYDKRYPLRGDGRSGTFYVSGPPVFVDLVSSAAAMMDKQSDGLDLGRQKIGVVKLNNTFVSDRNYELRDQKISIPGMATVIEKLLEGEQKPVRDVAAAPPARRGDIPPMPDFPGAADLKPPPYAAGLSLPEALKQEAAAGDIRVIAYPDTNSLLVKGTAEQVRFIESLAQALDVAKRHVELSLWIIDMQKDDLDQLGVNWSGSVSVGNKLGVAFNQSGSLSTLDGTRFIASVMALSRDNKANVVSRPVVLTQENVPAIFDNNRTFYAKLVGERSVDLQHVTYGTLVSVLPRFAADGQIEMSLNIEDGRETRAPDYSQDNKDAGLPEVGRTRISTVARVPQGKSLLIGGYTRDASDKEQAKVPLLGDLPLLGGLFRYQRSNQSNTVRVFLIQPREIDEPLMPDASDLSGGLPGGAGVDADPLQQWVRGYLDREQRNGG

SEQ ID NO: 7106 - protein, 372 aa, Chromobacterium substugae
MEINHRAVFSIGLRSPKQQARQEAQRDAVRQSEARQAEAQQAAEDASPAAELQRFAQSSDEMAAALTMFRNRRDYDKKQGGLADSFERVLDEEALPKSRQLLQVAKAHGLTAEELLRQARALFPDDSDLALVLRELLRRHQLDEVERKRLKALLKQVEEQAAPRPFKAGINCALKARLFGKALDLSPGLLRASYRQFLESDASEAEIYQDWVASYGCQRRAAVLDFIEGALLADIDAQDPSCSGLEFGHLLGRLSQLKSLRSADALFVGRMLANPLARRFNPAEADWLLLLLSLLQQPQDVDALLADTVGEAALLSRHADHSALLQTLYQACKALPPGLFADEAWQPALLEEFRRLAGVAYRRELAEKRRES

SEQ ID NO: 7107 - protein, 681 aa, Chromobacterium substugae
MLNSLLNGARTRPELLILLLMVMIIAMLIIPLPTYLVDFLIGLNIVLAVLVFMGSFYIDRILSFSTFPSVLLITTLFRLALSISTSRLILIEADAGEIIATFGQFVIGDSLAVGFVVFSIVTVVQFIVITKGSERVAEVAARFSLDGMPGKQMSIDADLKAGIIDADGARERRSVLERESQLYGSFDGAMKFIKGDAIAGIIIIFVNFIGGIAVGMSQHGMDLSTALSTYTMLTIGDGLVAQIPALLIAISAGFIVTRVNGDGDNMGRSIMSQLLGNPFVLAVTAVLALAVGMLPGFPLPVFLVLAAALGGLFYYKRRQARAAGGKPAPAASGGAEPTPAAREGGLGLIGNLDKVAAETVPLILLLPKSRLAALESAQLAERLRSQFFIDYGVRLPDMLLRGNDKLPDNRVAVLINEIRADEFAIHFDLQRVVNYSDEVETLGMQPLLADGQAWVAPADGDKLATLGYQLRAAPDELYHCLAALLARHVNEYFGVQETKHMLDQLEGKYPDLLKEVLRHATVQRIAEVLQRLLAERISVRNMKLIMEALALWAPREKDVINLVEHVRGALARYICHKFASGGELRAVMVSAEVEDLVRKGVRQTSAGAFLNLEPAASDELMDLFALGLDGLGVAHRDMVLLASVDVRRFIKKLVETRFRELEVVSFGEIADSVSVNVLKTI

SEQ ID NO: 7108 - protein, 135 aa, Chromobacterium substugae
MFALDIAQLVRSALRESGCDPAMLGELDNHSTIALDLHELPSIHVGAQDAEVWLWARLTEHGEAALAQRGGDLLQELLQGCDYARGGQLQLALNDGALELKALVNPEFLADGARFSEALNGFFDSLERFCEFTLR

SEQ ID NO: 7109 - protein, 429 aa, Chromobacterium substugae
MKPPRLLRRLANPQRLSGPILEAALPGVAIGELCDIRRGWQDREVVARAQVVGFQRERAVLSLIGAARGLSREAVLAPSGRAMSAWVGEAALGAVLDPTGRIVERFAPAEGAGGEERAIDADPPPYSQRVGIRQPLATGVRAIDGLLTCGVGQRVGIFAAAGCGKTMLMHMLIEQGDADVFVIGLIGERGREVTEFAESLRASPRRGRCVLVYATSDFSSVDRCNAALLATTVAEHFRDQGKKVMLFVDSMTRYARALRDVALAAGEPPARRGYPASVFDSLPRLLERPGATRGGSITAFYTVLLESDDEPDPMADEIRSILDGHIYLSRKLAGQGHYPAIDALRSASRVAGQVTDADHRRSAAAVRGLMARLEELQVFLDLGEYRPGENADNDRALAARAPLQRWLRQGVDESSPLADTLAGLHALAD

SEQ ID NO: 7110 - protein, 151 aa, Chromobacterium substugae
MRSPIEPGPLLSRCQAEQRRCDSELAQLAREDGQLEARQRDLDGQGEGLRRLLLAQRPAGAALDRGQLFALLRKQAVLRRQLQNLDLQREQAREQRLQLAERRERQAALRRQWLRKEEKYQRWMQLQRRRRRLLGLRQEEIEQEEMTTWQA

SEQ ID NO: 7111 - protein, 341 aa, Chromobacterium substugae
MASVMPTSAPAAMAPAQQAEAEGVAGAFARQAGRLARDETGGERDKDKDALPETGVFALLPPALPPLGLPAHGRRAADAQPVAAGMKAASGAVEKEARRDGGRASLEQALAAAAKAAAHAGAAAPQPGLKPRGKEASGPAAHGEGGLKEKAQPALPAAPLAEPWRLGPLSHEHLRAALPAAAGMPPSPPQSPLSDLPAVPSLGRLKDEPHKPVAAEASAQPASLPAAPRKEAEAGLPPRAETPRPQTPGMERQPPQPAAAGEPQAGLTYRFQRWGGEHSVNVQLPSGPGAAQLTLQPSDSLVQQRLSEQWQHGDPQRWELARDGGERQRRDGRQPEPEEDA

SEQ ID NO: 7112 - protein, 298 aa, Chromobacterium substugae
MLKLRRVEGETLALRQAAEIWAGQGWEAEIAYPPRHGRWLEVADEDGRWQGWLEPRAWLESMAPDLAVLASGAGAERQAGRLIAASPAPLHWPMPDLPRGRVRAGAERDGGELPQRPLLRVATPQGPVWLARVEAPRPAAMPARRFDWLSAPLAFGLGHSHISQALLRSVRGGDVLLVQQTASLVACHGRTVGRYQRSDEGIIMEWQMEEAAERDEPALADIEQLPVRLEFVLQQSRVTLAELRQLCQGRLLPLQAGAERQVEVRANGALLGRGELVQLDGQLGVEVAQWRDGPDDVE

SEQ ID NO: 7113 - protein, 219 aa, Chromobacterium substugae
MSNDISLIALLAFSTLLPFLIASGTCFIKFSIVFVMVRNALGLQQVPSNMTLNGIALMLSMFVMLPVAQQAYGYYQEERVSFTSVESVSNFVENGLDGYRAYLQKYSDPELTRFFEKAQVDRAERETGSAAADEQPSIFALLPAYALSEIKSAFKIGFYLYLPFVVVDLVISSILLALGMMMMSPVTISVPIKLVLFVALDGWTLLSKGLVLQYLDLAT

SEQ ID NO: 7114 - protein, 86 aa, Chromobacterium substugae
MNDLVFAGNKALYLVLLMSAWPIVVATVIGLLVGLFQTVTQLQEQTLPFGIKLFGVSLCLFLLSGWYGETLLAFGREVMRLALARG

SEQ ID NO: 7115 - protein, 257 aa, Chromobacterium substugae
MPFGLFFEIHGWVAAAALGFARVAPVFFILPFLNSNVLTGVVRTSVAMLVALGLWPHAPEALPAFDALSFAALIAREATVGLLLGCLLAWPFWVFHALGSIIDNQRGATLSSSIDPANGVDTSELANLFNLFAAAVYLQGGGMALMLDLFRESYRLCDPLGGGMPALAPLLGLLNQVVSKSVVLASPVMAALLLTEAVLGLLSRFAPQMNAFAVSLTVKSAVALLIMLLYFAPVLPDALARLSFQPGALSGWLPAGG

SEQ ID NO: 7116 - protein, 354 aa, Chromobacterium substugae
MSNKTEQPTRKRLRDSAKKGQSFKSRDLVVACLTLCGVAYLVSFGSLVELMGAFRQAIAGGFSLDMAGYAKTVAWLGLKLLLPIFLLCVAASALPALLQSGFVLASEALKLNLSALNPVNGFKKLFSLRTVKEAVKALLYLASFAAAVAVIWRKHKELLFSQLNGSPLDMAGVWRELLLSLVLTCLGCIVLVLLLDAITEYFLFMKDMKMDKQEVKREMKEQEGNPEIKSRRREAHMEILSEQVKSDIENSRLIIANPTHIAIGIYFRPEVVPIPFVSVLETNQRALAVRAYAEKVGVPVVRDVPLARRIFAGHRRYSFVSLEEVDEVLRLLVWLEQVENAGQPEPDDNPPNAG

SEQ ID NO: 7117 - protein, 167 aa, Chromobacterium substugae
MNANDNVSDDRFAEMVWEAVSGGATLKDVHGIPQDMMEGLYAHAYDFYNKGRLDDAETFFRFLCIYDFYNSDYIMGLAAVCQLKKQFQKAADLYAVAFALSKDDYRPVFFTGQCQLFLRKAAKARQCFELVCEQSADEALRAKAQVYLDTLQETENGQSREQEKEQA

SEQ ID NO: 7118 - protein, 580 aa, Chromobacterium substugae
MSDAGTIGSAYLRNPGLAGAAFDSVRKDGSFLDAADKALKAVLATRAGEGKPTVSERDLATPALSQPSPKAQRELDGSGKLTLLLGQLMTLLGNVSLSQLESRLATWRAMMESQQAMGNQLSQEFQQAVAESQAATEAFRGAEGEYETAKAAADAAQQKAAAAKAKLEAMQPDDPGYADAKAASQQAAAEAQLALQKAGQAGELAEKARLVAVDKAKRADELAGKVQGANVNTDAARKGAEDHLSNVGKLTMLMAMFSKLVGENSENSLKNDLALFEAMQEGRQKEMDKKSAEYQEEVRKAEELNRVMGCVGKILGALLTVVSVVAAAFTGGASLALAAVGVALMVADEVVKATTGVSFMEEALKPLMEKVLKPLMELIGKALSKALESMGVDKKTAEMVGAIAGAIIAAVAMVVVMVVVATVGKGAASKLGGALSKLMGDTIKKLVPKLLKELASNGGKLLSQGMQRLGNSLGLRTDELSKQLIRNTLNRVVVGGEVVNAASQAGGGVAQGVFMKNASEALADFSLARASMEQIEQWLKQAVEAFGSTQKITQELTAAMSAALQQNAEASRFVLRQSHA

SEQ ID NO: 7119 - protein, 417 aa, Chromobacterium substugae
MISLNHSSPLAISLPTGADSPKARAADGLISVATLLPALRASGETGRELAGALAGQPELAKPQGMLKPEDAGALHRWLSGKLDDRQFTAGIEQTMGKLELLIDKELKARGDEAKDPAFDISGMSTRMAALLAQAIVLMSALRTADSALSSKLSQVSFDATKSTAASMVREGLSNLSSSVAQGAIQFGVTGVGAKKQLSGLSAERGALKNNAPKLNKLGDEARNIQGALGRQGSVKLGADADSMKDIKLASPQAGNRQSLAEMNAQPGAGAGVADGMAAARDGAVPLQASNQRLASQHEAALGSVGDDIPVKTRAEQAALEDTRLKSQAKQTTGKAIMEASNAAGGIAGGSGRYAATLEQADQQISQASGRVASNASDEARERSRKADSIIQDLLKTLEGVSQSKSAAMGAIAGNIRA

SEQ ID NO: 7120 - protein, 346 aa, Chromobacterium substugae
MLDSLIRTPSIPLYSAARAQSEAPAAELQTAPPRGESAPLPPNAKLMQATLQSARQLDAALQSQQRDAAAGRPPAGETQDRKALALHQLDGNLRGLSAAGYRLAPEAVSAMAAENDAALDAAPQLLREQAPTLADHQMYPDSVLWDNIAKAIGGINDNYLGVYENVVGKYTAFYQAFSDILAKLGSLISSNDKGDKVTLEVGQLVTLLEKLKTDFSLPNSAAILFPKQGAKATEAQAKQWASELGLPDGCVKPLPGGGYGVVLDLGPITVMTTELNKLGSGKVELDNAKFQSWKAGFDAQEEKLKNTLQTLTQKYSNANSLFDNLVKVLSSTISSCLETAKSFLQI

SEQ ID NO: 7121 - protein, 722 aa, Chromobacterium substugae
MTITLQRSTSCPDLSAAAAREPGPQTPLAGRMRGAAAAPAVGLEGFKADFANRSLEALFGQSSQPERLRQLYQSSANAYAKLEIAEFAKVFHRLAQSPDLSEEARAALDGQARQYAAQILKDGLGERSAFGPWTPKTAKGYQLRARLEHQLAQFAALRLGGDAARLGADFMNREVLPFVRQYLEHQLAGKLDEACVRELTGVFDRAAHQAFEALRQGRDELVQLHGLGVGKLARDLDTVAVLPLLMRNVLAQLQPPAEGRADPASPAADDGAAKPEAAGGVHIRIGDIHIDNSRHIDNSRHIDNSRRGRGAPTPLSLALKLRRDPGGDGKARAEPAASGKPPPPAASLARDAAVQTHPAAAEPAPPNPAQADGHGQAAPFPAWRSYYPEAVLRSIGFQSRDDAHPAARALVADMRSALRLDAASEMDPHSPFAALARARDAALREAPGEARQPYEAPVDAAQWAVLKQGLNRHPQSEQLRGQVRRLARLTNLARGEWPQDSAVQRLLQWGLAAMPAAGPAPDLPPGPPPDAGPSISTQDGAPFAGIALRGAAPRLPAADYLRGYPFRSDPQAPALLLMSALREALEADPATPWPLRREFDRSRDELLPRAQLDQRRALQRFADGDAAVAPRLGQLLSLLDAHPRRQALVDLGRRLARETALLPRGEPANPLVAQLLAGLGLDAAEEARRREPATPASTVVLTVDGQHLDAAAIRERSRAARD

SEQ ID NO: 7122 - protein, 71 aa, Chromobacterium substugae
MLAVLGASLGAEVGRIQPASRLVDDLCADSLELLDMVMMLNDEFGIEIGVEDIVGIRTVADVEAAVARRLA

SEQ ID NO: 7123 - protein, 782 aa, Chromobacterium substugae
MKSTARLAAWLAAALLLDHGQSLASPFNPAERAWLARHPVVRYAIDPHGWPIEYLEQGEHKGLTQEYLQRIGDISGIRFQLVPVQNRFQAMTMMLQGKLDLLTATSPKLIPAPFNQQMLFTDPYFSGSTLLVTRPDKPIVFDPAKLSGKTVAVEQGDPYEYFLRQYYPDIRIVPTATPLAALDAVAEDRAYAAVGLDATLQAVIQRRYYGTLHIAGSVSEMPRLVSMAVNLRQPMLRDIIDKSLGQLTAEDTDAILYTWLRTTDYGMPSWGSIARYYAFELSALAAGLLALALLAQRARAAQRAAQRSEAEKSLFLAVMSHEIRTPMNAILASVELLRRAALPPREQELAALANASAVNLLELLDNVLDISKLDARKLALEPVATDMAALAGSVAAVYRPCAEKKGLKLTVQLSGLERPLLLDPVRMRQILSNLLSNAVKFTHQGEVLLRVDLRLAEGESGALLVTVQDTGIGIEPEQQYRLFSAFSQADDTTRRYGGSGLGLAICRQLVELMAGSITLSSLPGLGTTMTLRLPVDCLPQPAAKPADIDAAPPSQPASPSAAVLVVEDQPANRFVIAQQLRELGYRAEMAEDAPAALALLARGQRFAMVLLDCDLPGISGYELAQRLRAHPALQPPPHLPIVAISATTGIAHQQRCLESGMDSCLSKPLRLEQLRQILALWLETPAASPEEQADATASSDADLQRIFRSSCGEDAQLLEQALQARDWPVAIHHAHRLGGAALSTGHAELADAARQMEALLRQPQKDDAALREQLARLRQALG

SEQ ID NO: 7124 - protein, 233 aa, Chromobacterium substugae
MSDSKISIALPHPIRVALLDDHLMILHGLSGHLAGVAGLRVAGSFTASSQLMQALAGGLAAETDVVVIDYALRPDDIDGLNLIRALRIRFPRLRLLVMSAYYTPATVALALRGGAHGFIGKEQGLDELVAAIRALADGRDYLSPEMSRELHARLEASDAPQGASPTLLDHPDLSPREREVLRCCLHGLSVSDIAAKFSRSVKTISNQKQSALKKLGLRRDNELFQLQQRLEEK

SEQ ID NO: 7125 - protein, 876 aa, Chromobacterium substugae
MIWRACLLWLLLACCGWAGAAVPVDLAGAPEHVQPNEKLDIMREPGKRLTLTQALASPNWQAATLKRLTAGFSSDTYWLQGQLDNSGSQPVTRWLSVGSSRLEDIRFYRLPPHHVQVEQAILAGTRIPLAQHPVPALLSVFPITLAPGESIRFVLRIRSRSIISISPELWTQTAYRANQDRQLAMEMLLVGSMLTIALYTLAMGLARRDRISLLLAGMAFCVLMADLSFQGYHYYYLMQGGGDAVLRMTGVLPCLVVAFVLALMMRFIEAGGIALWRWLYRASMSGLAVCAAGTAFGDYSMFIYALNWLLVPCLILIFGSCLHRWRQGSREARLFFLAFCLYSSRAILKMAVGFGLLSESMIGGAEIIWGNLSIILLLLAVNIRRQRQLRLEKQQAQDALLDARLKEQERLQDAVDERTRELQGALIAAGEANRAKSDFLARVSHDLRTPLTSIIGFADLIQAGGHSDAERGGIIRRSATHMLQMINDLIDYAAGASPNAVKKEPVYIHALLQAIAQEHESLSMKKGNRFLLEAGAELPPVLELDGKRVRQLLGNLLDNANKFTQSGLIILAVDYRRHLAGQPGKLSLTVKDSGCGIAVEDQRRIFEPFLRLSQARSQPGIGLGLSIVKQWVERMGGALQIDSAPGAGTAVKITLTAPSLSEADMDSYCRPDALGVLPQIDGKGKTVWLAEDTPDIRRLLADELTGQGFAVDASENGLELIRKMQRLSSSPDLILTDHMMPGANGLAVLAEARQRLPGVPVVAISALPQPIGPQSYDASLLKPINLAELRNTLASLLQLGGPPFAETPPDASHAQRPDASQLEEARRLISLGAMTDLLDWAEHIAQDNLRCQDFIERLRQLVRQGELSSLQALCEE

SEQ ID NO: 7126 - protein, 239 aa, Chromobacterium substugae
MLLMDFLSRHGCRLYIGEDGRDGYHKAQAVQPDVILMDISMPRCDGLTACRLLKANQQTSTIPLLFLTASALPKERVEGLAAGAVDYVTKPFDFEEVRMRLCIHLRMTPPCSQPPAAPADKSKEPKAGGLDGVLYRSARKLLLAALDVTPELAGLAQAVGTNTRRLNQAFRSCAGMTVFDFLREARMKEARRLLVETDLPVQSIAQATGYGNPANFSTAFKDRFGCPPTSLRHAGDAGA

SEQ ID NO: 7127 - protein, 472 aa, Chromobacterium substugae
MKIFSLRTKAWLGLAIGGAALLSGVIGAEQAYSPENSAVAVAGKAANSCLPQEGWFPHRQTLEPNSGQFAADASNCAFHQWSWQMFLWLTQALPDPDHQGQTLPRFLTFPDPRILRGKSQSSADSFLPALNLKDDRPLDEYLQAGPDGMLVDQNGRLVYYSMYLNDVFANFVKEQGLNSAERIRDFNPGINYPVGTLTLKAAWKVLSSEEQKRNDVSHKFYTRTAEVYPLKKRGKGFELDRTYPQEVVLALVGLHVVGTTRHHEEMIWASFEHVDNAPDVDAGAIQDPKTPVSDRDWSFYAKNTPLSACNQNLASSGKLELDETRQTFTPVTQVCRMYPYGSGPDKQPANAANIKALNTAVRNKLEGPWNNYFEVGAIWFDTQKGKPLQANCNFQPGANQCGVVLAGSTRLSNAAIETFTQSQSSMDNCFACHQTMPHYGGPGQQTLPGKNLSISHIMNNLYFDLQSSKKSN

SEQ ID NO: 7128 - protein, 711 aa, Chromobacterium substugae
MSDYILRVHPAINIARVGSSDEFYIAPETPAGESLPDSDLLGGLPIKAGTENTPIDESDFRDAQGLVKRQAARFRIFAYLKGEHLNQYPMGPQAQPVEVVLGARLGAKIVKDIIWTVHVANKKLNNFAIGSDGLDGYDDPASVPLRNGYYPNLPPNFPLLPTTNGSPYWREILSNAKRCMDLVIDPGPRSISAFHDQGKTKAFSKRERACFADGKGNIQFLDYPQHFPDDAHPYLEQPLGPIASLGELRVDAQGRLLVTGGFGHTAGVKLSATGLPPSLANSTENGLWFDDTSDGPVNAVVVFDDGSCEAHGAWVVTGDPGYAPQIRNVVSAWDDIFDMWVRELDLMPSLYRGNAFNHGEYQPCFRHQVQPIFRAAMLQRWGTNLPNHVVNAHDGVGAIQPTTDPGAIIQDLEKLIRNPEGSPQEMQTGRPLMPLSLGDARKSFLTVTRSQYFFLQCWHKQQFSAEDAMPLSVGEKLDYAALANCLGGRYSPGIEVSFPVRDRNLYIQNWRERDCGPFRINQARIDYANIDSGEPVLRCGYVPRQIGAVEPGDLSKFMSVPWHTDYNSCAVHLPKPNPINVDGNGTPYPNNVLFWSWPAQRPVQVFPKSSCDYDPATGTWKLGNQVFSIRGVGTETEYPARAGSFREHADYMRQWNKTGFVIQGLQIPSAQGGSYGGKLFLEVSSQWGPEEGPPVQPFPTASVPPEPEGKV

SEQ ID NO: 7129 - protein, 254 aa, Chromobacterium substugae
MRGLARRDTGGWLLDLEREGQALLQRADFVLDASGAAAVVARRLGVMRNEIDCLNVSYAYLHCDDAMAFPARSWLEAVENGWWYAAGVPGGRIVAAYATDRKNPAKPQGPVAWMAALQSTRHLWPVMLRARPASMPGAVRVAAAPSAILSNVAGRDWLAVGDAACSYDPLTAHGILKALQDGEAAGRAVANDLGGNPQAMHDYQNGIFTRFSDYLRLRNRLYSEEARWRHMDFWARPLTQAARGAGGGPGAAVD

SEQ ID NO: 7130 - protein, 662 aa, Chromobacterium substugae
MSLPALSKSESGVFDKPEFLTPDTVDLDLEVAMLSGKIRNPSADKEGEAHFDRVLLRGYRPWCDPGENGKPCRASRVTKSFIAPLIQAHPGQTVRITLHNDLPPDPSCVSQGGSANKPHCFNGTNLHTHGLWINPAGNSDNVLLAIHPGVAFQYEYNIPLEHPAGTYWYHTHLHGSTALQVSSGMAGALIIRGNRQPQLDGNQANSSQKNSHVHGDLDTLLVSRDKDQFQEHTFVFQQIQYACRGKDRKIKTKNDEEGGPYRCDDGDIGQVDGYDLFGPGRWEKSGRYTSINGVVMGKLQNAKVGKVQRWRMIHGGVRDTIALEIRRREPISNESAQSISGLTAEQTQDYVNKECTGEPIPFTLVAADGLTMAQAMQKKRLVFQPGYRWDALMVFPQAGDYCLINKVGRSNIDLVQPYTRLLGMIHVNAANMPVVPDDIDGSIKRHLQNLLIKAAQDNYRSAVAKLVVADLRNDMKLTRFVPHADIQDSELTGQQRLAFNIDTQSVKGQSFYQIDGKPYDGGRIDRTLPLGGVDEWTLTSDFASHPFHIHVNPFQIVKIINPKGQDISGPMPQADDDDDQYHGMKGMWKDTLWIKSLFDGTSGGEKDAAAGRYTFIVRTRYQRYVGDFVLHCHILDHEDQGMMQNVRIVLPDAQGNLTAGHH

SEQ ID NO: 7131 - protein, 581 aa, Chromobacterium substugae
MSNLYLDTAIVGGGASGAYSAWRLQQAYGEERKIALFEYSNRIGGRLYTVTMPGLPNVKAEVGGMRYIPDQHYMVANLIGHLGLATKPFPMGEPAPVGSSCNIFYLRGKHFRLHELSDPEKVPYNLSWSERGLGPTNLQVQVMNYIYPNMQNLSLCQQMQVKAYGKHLWQYGFWDLMFRALSNEGYQFMKDAGGYDANVANANAVTQLPATEYSDSTIFLTLKDGYDQLPIRLAQAFNHELPGLAPKGERIYMNHCLTEIHENTGEYRYKLVFRPTKVQQHEGGLRSLLDHGADPIVVYAKHIVLAMPRRSLELIKSDFFFSDPWLKENLKSVLIQPAFKLFLAYERPWWRSLGLVAGRSVTDLPIRQVYYFGTESEQDGGQPWLNSLLMASYNDISTVPFWKGLEAGPAFNGYRPDCIEADSSNVVPQMEHVATEEMVFVANKQVAEVHAQQQIPSPYSAVYHDWSDDPYGGGWHEWKANYRLDQIMWQMLKPVDAHNIFIVGEAYSIGQGWVEGALCTAEQMLEKHFQLKRPGWLKEGYELMPVPEGGCGELCGCIPASAMGSTLEAITPNCLKCAQEG

SEQ ID NO: 7132 - protein, 561 aa, Chromobacterium substugae
MTASTPAYTVSNYILDRLRQLGVQHLFEVPGDYASIFLNTLDECPAIERIPNINESGVGYASDGYGRFKGAAACSVQYGVGTFSILNCFAGGFVERVPMALIGPSPSTQNRELARTEGILFHHSTGNLNADMRVMENVTAAAVAIHDGASAPALIDEALTAMLTHRRPVYIEVWQDIFGVECARPRGELRAVETASEPAALQAMLDLAWQTISDAALPVFWLGVEIQRYGLQELAQQLVDASGLFFTTTSLGKTVLDESQASFIGTYAGPASPALTREVMGSADCVVALGAIITDDYLGIMAQDYARMVEINDEAARIGCGHYQGVYLRDFMQGLLARFQRRASARRYRLPQVSPDPQPSLLPTDGLTYDRFYHVLGDWLIQEGHIRQAKLILGESTSLYVFGNLFGMPRDAFVAQAAWGSLGHETGCALGVELATGQRPLVVAGDGGFMMICQEISSLVRQRSNAVVFVMSNAGYAIEQAFVNLNAFTPQDNYAAFDLLPNWDYLALAKAFGARGHVVETVDQLRKLLKQLEHMDGVPNIVQVKIPLKDLPPQLRRLASG

SEQ ID NO: 7133 - protein, 351 aa, Chromobacterium substugae
MAADIYARIRQAAFELVGEGVWPTVVDVRTRLGSGSNTTINNTLKEWRQEFLGRVAASSRRPDWPPSLAEAFEQVWQKACDEAEQQLSAVRQEVEAEAAELRAALDASREQAQKTEAELQSLRHELELRAARQVELDSQLQRERLEVESLRRERQELRQTAESQRQALTVAHREAESRLLEMADRHEQQLREVQEEANRKEALAYERLEGLRVRLYQQVEDERQEMKGQQQKLEGALLQARQDAAKVENLWRERVLERERENGGLQARLDLQQQQGDSLRQEARQQEQAAEAARERLLGVTAELAGLQALHAMRREQWLERLGAALRAGALPAEPEAVQPWLAALLAEPVR

SEQ ID NO: 7134 - protein, 208 aa, Chromobacterium substugae
MQGYAVLYLAFIIVLFAALVWKTPVLRDRGPLAPGVADGQQTFSLARSQLLWWTLSVALVAGWLLIVTGNLLSPTPQVLALLGISAGTSGLASLVGQPDGGAQAAALGGSRGWVRDVLEDGQGISVHRYQALLANAGIGLVFIYKSLELKAFYAIDPMWLGVLGVSSVLYVGMKSRETAAVGAEALSAPALIQPQAVKPGNTPPALQV

SEQ ID NO: 7135 - protein, 242 aa, Chromobacterium substugae
MEPVRLSKRMAELGLCSRREADSYIEQGWVKVDGEVAVLGQKVLPHNQIEVDKKAQDAQSARVTILLNKPMGYVSGQAEDGYEPAVVLITPENHWAEDGSRKRFQASHLRGLAPAGRLDIDSVGLLVLTQDGRVAKHLIGENSSVEKEYLVRVEGQLNANGLALLNHGLELDGKKLLPAKVSWQNEDQLRFVLREGKKRQIRRMCEMVGLRVVGLKRISIGKVKLGNLPTGQWRYLRDDEQF

SEQ ID NO: 7136 - protein, 333 aa, Chromobacterium substugae
MFERLRRILGLDPEARREARALAGQVEQLIDACDKRLRLLPGYFDALAPGMRVSQAYLSTLTAQLPPVLELSLPGFARDPRLGLLFAGPSSLLAFLESSEVLRDFFLRAGNGDEAWALLTMQRSETNRFGVAMENGELRNDVAQVVVSFDGHRLMMPSPSQERFRLDSGAHALDVMVSVIARRLSLMEQARQQLEAEQARLQLRRLSLQSSNCVVVDCQSGDESLPETAAAVDARLAEINPQLDELRGHASLEGLLRTVREVLEQPADYFSLQTVTLRLSRMGVKVDGDAEDATELALEEVVLGRMLPIRRALVPVRIRRDDIAELRRQFGGD

SEQ ID NO: 7137 - protein, 232 aa, Chromobacterium substugae
MIDLHYWTTPNGHKITLFLEETGLPYRLLPVNISQGEQFQPDFLRISPNNRIPAIVDQAPADGGAAISLFESGAILLYLADKTGRFIPQDLRGRNDVLQWLFWQMGGLGPMAGQNHHFTQYAPEKLPYAIDRYVRETARLYRVLDTRLSDGRDYIAGEYSIADMACYPWIVPHEKQRQDLNDFPALKRWFDRIAARPAVQRAYKLAESVNTTPTLTEASRAILFGQDGKPRG

SEQ ID NO: 7138 - protein, 181 aa, Chromobacterium substugae
MSQTLDSHSRFISLVLRHQPQAIGLALDEQGWASLDELVAKARAAGRQLSREVVLDIVRNSDKQRFAISADGLRILANQGHSVRVDLDLTAQEAPPRLFHGTARRFLAAIRAEGLRPGQRHHVHLSNSAELAASVGARHGAPVVLTVDAAAMQRAGLAFYQSANGVWLADAVPPQFLAFPE

SEQ ID NO: 7139 - protein, 212 aa, Chromobacterium substugae
MCVNFLPPSRRQMRECFGAEIGDWQWRDEAWQDYLAPILTRDGVRLASYGFIPKRHQPLGARLSTMNARAETIGELRSYRDAWRRCQLCLVPMQAFFEPCYERGRAERYRIGLADGAPFAVAGLWREWREADGSISAAFTQITINADEHALMNRMHRPGEEKRSLVIIEPSQYDAWLNCRNPEAARAFLAAWPAQDMAAEAPDLPSQGSLFD

SEQ ID NO: 7140 - protein, 419 aa, Chromobacterium substugae
MSQYALVDGNNFYASCERVFRPDLAGKPIVVLSNNDGCVVAASAEAKALGLRMFGPFFEIAGLCKHHGVTVFSSNYTLYGDMSRRMMAILAGHAPGQEVYSIDECFLDLTGVADAEALARRMRGDVLRRIGIPACVGLGPSKTLAKLANHIAKKQPRWDGVFSWDWLSAADADAMMATLPAGKVWGVGPRLAGKLEVLGIHTALQLKQADPHQIRRQFSVTLERTVAELNGVNCLRLGEVAPARQQILSSRSFGEKPRDLNVLAAAISHHVSHAAEKLRQQNSVAGLVAVSIRTSPFLGAPYNGYVAMPLAQPSDDTITLARAALAGLRAVYRRGLLYQKAGVILMEISPRGIRQTDLFQQAPDPRRQKLMQTMDAINREYGRNSLRLGAEALTKNWEMRQDQRSPCYSTRLDQILRVK

SEQ ID NO: 7141 - protein, 142 aa, Chromobacterium substugae
MNTFPLSLRPSAAARPLPLALCPVRAGFPSPASDCMDASIDLQAYLVSDPPATFMVRVAGDSMRDAGILEDDLLVVDKGLPPVHGDIVVATMDGEFTVKRLHGKNGRWMLLAENPAYPAIVPAAGQELQIWGVVTACVRKFR

SEQ ID NO: 7142 - protein, 953 aa, Chromobacterium substugae
MEAVPKISLSIAEFRRQLLHRRHRLLICVASLALVLLGASVIAGWLAHSESILPDNVHMVISTAVCLVLYGLGLGLALWRPRWQAHRLLAALTLAIAVLVLLEHASGQTWWIDFPRLHAWKHDLVPHPGRMAPSTALALLALGAGLCLLPGHAGWRRAARACAAFALLLGVLGAAAYLISLELLYSWGTVARMALLTAAGVMIASLGLYSLTRLEPRRHLRSQDLANSASLTATALLVAISLATGLLVYRISSNAHEQSLRTVMLYSARQRAALLDAQFNISNDIARRLYQRPDMQALLEAASSGHVDAGAGAKLAALNHMNLNGIAIQDSAGRTLVQVGYFENRPRQSVALNSPAGALLLWNGHYLYRTVDTYRTSGGSARLLLEQRLDMFDRIVADTAPSRGLSGIYSLCGRDSRYLRCFSQSPQDKGSTIPLAGNIPRFTVWPAFSGQRGTLHTIDYSGRNVIGAYEPVGSTGLAFSYKIRVADLMEPIRQDLETSALIMLAMVTLGSLILRWRTHPLLHEVLQSNRMAELAAERFRNAAEANMDAFIIMEALRGAGGEVEDFHVVYINAEAERMWHLRRDEAIGRRLKRLMADYRIPNYFDSYKKVIETGNAISEEVPKVFDASHPAWIHHEIVRAGDSVSVSVRDITQRKLAELDLVLREALLKTVTDSIPALVAFVDREECYRYCNKAYMRLFGIGPEQIISMRMRDFLGEDAYAAVLPHVGKALAGEAVSFEQEMDVRGESRYVEGRYIPQQHADGSVSGFYVMIWDITQARAREIQLRSQVTQDAMTGLLNRSAFMELLGDEIKHHYMKRQALALLFLDIDHFKQVNDTLGHAAGDELIREFARRLRGNVRATDHVARFGGDEFVILLIGLDAERTAVSVVEKLLAAVRRDVELNRQTLRMSTSIGIAFALTPDITPERLLEIADESLYRAKDAGRDTYRLQRVG

SEQ ID NO: 7143 - protein, 468 aa, Chromobacterium substugae
MQASRQPQAGLIERRSIDFIPEDERHGRVFSQFTLWLAANLQITAVMTGALAVVLGGDVFWSIVGLLLGQALGGTVMALHGAQGPRLGLPQMVASRAQFGIKGAVLPLALACVMYLGFNATGMVLSGQALGQLLSISDRAGIVLFALTVLAAAALGYRAIHKLGRYASALGLLAFLYLFVRLAAGVDLPALALTHKHFDPAAFLTAVSLSASWQIAFAPYVSDYSRYLPSATSPFWTALAIGLGSGLGAQIAMSLGVLVAAVGGAAFRGHEVAYFVGLGASGAIASGLFFCVAFGKVTISTLNAYGGFMCCSAIASSLGGAQATIGQRRRWATVAAMVLASACIAILAQHGFLSLFKSFLLFLLAFFTPWSAINLVDFYLIAGGKADAAALADPQGRYAGCDWTGMGVYLAGILLQLPFIDCAFFTGPVAKLLGGADISWLVGWLAPAALYYWLRRPQRRHVVSGAMR

SEQ ID NO: 7144 - protein, 250 aa, Chromobacterium substugae
MAKPISVMTYNIHKGMSPLNRHLRVEDMADALAELAPDMLFLQEVQGKNLERALRHQRWPAQPQHHFLANRLSHRAVYGLNAAYDHGHHGNALLTRFAVREWCNRDISVNRFESRGVLQCVLQPDGWPQPVVALCGHFNLLAADRRKQYLGLASYVQQAIAEDLPLILAGDFNDWRGEASALLYRELGLEEAFLQTRGAHAQSFPARMPMLTLDRIYVRGLKVEAARVLSGRPWSGLSDHLPLCAEIRPC

SEQ ID NO: 7145 - protein, 245 aa, Chromobacterium substugae
MIHLQNVCKRFPSPEGGWFDAVAETSLTIHAGEVFGLIGFSGAGKSTLLRLINLLERPDAGAVIVDGQDLTSLSPKQLRAARQNIGMVFQQFNLLANRTVAGNVAFPLEIAGWSKADIEKRVAECLAIVGLEDRANHYPAQLSGGQKQRVGIARALAPRPHVILADEPTSALDPKTTQSILDCLKDINARFGVTVVIVTHEMHVVRSICHRAAVLDQGCVVEVVDVNNQEVAADSDLARSLLEAA

SEQ ID NO: 7146 - protein, 228 aa, Chromobacterium substugae
MDAATLNEALQNLQSMAPEIWQASQETGVMLGLGLAAAILFGGPLGVVLYLSQQGQMFANRFVNGVLSWLVNLVRSFPFIILMVSLVPLTRLIVGSTIGPVAASVPLAFAAIPYFARLVEQTLREIPRGVVEAAEAMGASPAQIIFKVLVNEARSGLISSLTILTISFLSYTAVAGVVGGGGIGDLAIRYGYYRFQTDVMVAMVLMLVVLVQIIQLLGNRLAAKLDKR

SEQ ID NO: 7147 - protein, 269 aa, Chromobacterium substugae
MRRFVIKAVAASVVGLALAGNALAADPAKKEIVIGTTVGDFGDMVKQSIKPQLEKQGYSVKLVEFTDYVRPNLALQEGSLDVNVFQHKPYLDNFAKEHKLSLKEAFQVPTAPLGIYPGKLKSLKDAKPGVTLAAPNDPSNFARALVMLNDLGWVKLKPGVNPLTASERDIAVNIKKVKIVQLEAAQLPRSRSDVDFSVINGNYATSSGIKLTEAVYQEKSYAYVNWGVVRAADAAKPWAKDVIAAYNSPAFKAYTKQKFAGYKLPQGWN

SEQ ID NO: 7148 - protein, 897 aa, Chromobacterium substugae
MTDNLFAKETIPISLEEEMRRSYLDYAMSVIVGRALPDVRDGLKPVHRRVLYAMHELSNDWNRAYKKSARIVGDVIGKYHPHGDTAVYDTIVRMAQDFSLRYPLVDGQGNFGSVDGDNAAAMRYTEIRMARIAHELLADIEKETVDFGPNYDGSEHEPLILPAKVPNLLVNGASGIAVGMATNIPPHNLNEVVDACLALLGNSELTIDELIDIIPAPDFPTAGIIYGTAGVKEGYRTGRGRVIMRARTHTEPIGKGDREAIIVDEIPYQVNKARLLERISELVRDKQIEGISDLRDESDKSGMRVVIELKRGEMPEVVLNHLYKMTQLQDSFGMNMVALVDGQPRLLNLKQILVEFLRHRREVVTRRTIFELKKARERGHILEGLAVALSNVDEIIALIKASDAPPQAKAALMARAWRSSLVEDMLSRVEGDKARPENIDPAFGLKDDGYHLSDVQAQAILDMRLQRLTGLEQDKIVGEYREIMDVILDLLDILAKPERISQIIGDELTAIKLQFGDARRSEIEPYGGDINIEDLITPQDMVVTISHSGYIKAQPIDDYSAQRRGGRGKQAAATKDDDFIETLFVANTHDYVLCFSSRGRCYWRKVYDLPQGGRQSRGKPMVNVLPLEDGEKINALLPISEFRDDQYVFMATADGTVKKTPLRAFSKPRAAGIIAINLDEGNYLVGVALTCGKSVAGQGDEEDEVASEDDTIIEGELIEDAQSIEGDQVMLFSDAGKSVRFSESQVRPMGRTSRGVRGMKLGEGQKLISLLVTNSADQMVLTASDGGYGKRTRVSDFRLTSRGTQGVIAMDLTDKTGFKLVAASLVEESDDIMLITTGGVLIRTKVAEVRETGRSAQGVRLINLDDGEKLIGLEIVAEAECADAEGEGDAAPEQGEA

SEQ ID NO: 7149 - protein, 156 aa, Chromobacterium substugae
MIPTPANPQVLEAMSQLFVSFPHCATLGFEYVGTEGRKPTLKLSWREDLVGNPATGILHGGVITSLVDTCSAIAVTAQLPGAETIATLDLRIDYLKSATPGKAIHCTAGCYRLASQIAFTRAVCYHDNPTDPIAHGVATFMRESSRTPMLPEEGRE

SEQ ID NO: 7150 - protein, 146 aa, Chromobacterium substugae
MSEFMQRFAEWRERKAYAEIVDALPYVKLMGVQLREDEQGELRFDLPFAERNVGNTTLPALHGGLIGGFMESAAMIHLMWNRESLEAPKIVDFSLDYLRPGRPQTLSAQCEITKQGKRVAHVLIEAWQDDRRKPVAVARAHFLLSN

SEQ ID NO: 7151 - protein, 362 aa, Chromobacterium substugae
MAKVYNFSAGPAVLPHQVLAEAQSELLDWHGSGMSVMEMSHRGKEFMSIIHDAEHDLRELMRIPANYKVLFLQGGASLQFAMAPLNLLGDKDSVDIVNTGHWSKLAIKEAKRYAKVNVVASSEDRDFSLVPEEASWQRDPNAAYLHYTSNETIGGLQFPYVPGSLPGVPLICDMSSDFLSREVDVSRFGMIYAGAQKNIGPSGLTVLVIREDLLGKARADIPTMMNYQVHADADSMYNTPGTYPIYIAGLVFKWLKEQGGVKGIATRNEEKAGLLYHAIDSSEGFYSSHIEAPFRSRMNVVFKLKDEALDEIFLLEARKNGLAQLKGHRAVGGMRASIYNAMPIEGVKSLVNFMQDFARQHS

SEQ ID NO: 7152 - protein, 146 aa, Chromobacterium substugae
MITLTGRKDLALNPNVTLPKLAMAIAGGFKKDCPDSFSAQALRQGKLDGYDAFTMLMQCGTSPATGGRTSESALITVIKGARDYYTVQWAERSSPSSAPLPIDTDKWTARYQLLVEPIRLCNRTPGEAPPYPSCTNDKQGKNPPPP

SEQ ID NO: 7153 - protein, 127 aa, Chromobacterium substugae
MRDNHGHRIHIEQPGRPRLYQLDDLPGYEVVGVITLAGRSGALVRKYSNGVYSMVNSSMLRPLDQRQVKKALGIGSNAGAPLKMQGGARRNVYLDAQSIDIALALGDGNISRGIRLALQASAEPKAR

SEQ ID NO: 7154 - protein, 814 aa, Chromobacterium substugae
MARNHQPLAGLVLAGLLSPCLAAESGYQTPPSELAAIVDAPRTPSQSLNPQRDTILQIHRPGLPGIADVSQPELRLAGLRLNPRMHAGSRFEFGTALTLLTLADGKSRPVSGLPASPRIADSQWSPDGKRVALSLWGDKGVELWLLDVSQARAHRLGSFHLNASSGAGFSWLGSQLLAKLRPAEQGPAPEKPTIPAGPNIQQSLGGKLSQTRTYPDLLKTPYDADLLDYELTSQLALVDLNGKANRIGKPDRYLAVRPSPDRQYLLSVRLQRPYSTLVPISRFPQRIEVLDMKGRSVHLVTQRPLLERLPSGNDAVETGPREVEWRADAPASLFWAEAQDGGDPAAAAKVRDALYLQAAPFTKPPLKLQELASRFADIQWGRDDLALVSEYWWKTRDIKTWRIQPGRPGQAAELLNSRKSEDRYADPGVPAMISNGRGQSLLQTSADGDSLYLLGDGASPEGDRPFIDAFSLKTKQSSRLWRSQAPWFEQPLAVLSSGKALLSREQVEQPANLYIKTLGQNDGLRQLTFFTHPTPQLKGVQKRQLRYKRADGVDLTATLYLPPGYDAKRDGPLPMLMWAYPAEFKSAEAASQVTDSPYRFNRIGYWGPEPLLARGYAVLDDPTMPIVGEGSKEPNDSYLPQLKMDAQAAVDEVVRLGVADRDRIAIGGHSYGSFMTANLLAHTRLFRAGIARSGAFNRTLTPFGFQSEERNFWQAKDVYQTMSPFNYADQIKDALLMIHGEADNNPGTFPIQSERMYQALQGLGGTARLVMLPAESHGYRARESILHMLWEEDRWLDQYVKHAKPREADSAAKP

SEQ ID NO: 7155 - protein, 331 aa, Chromobacterium substugae
MPDQNALPTRVANTRLYLTACSGIVPPKQRQLALPRLAQAGFQLENTAALERSHQRFAGTDAQRLSDLQTLLTEPQLPPLVLAARGGYGAMRLLPHLDFSRLGARLKESRSSLVGYSDFCAIQLAVLAKSGVGSFAGPMLGDFGAPSPSPYAINEFFSAITTPQRSLRIAAAQPQPQGRGEGIFWGGNLSVLSSLAGTPYLPEIQGGLLFLEDVGEQPYRVERMLQQLHLAGVLSRQKAIFLGDFSMQKHVDVYDPHYNFDAVVAELRRISGVPVFTGVPFGHIANKTTLPLGYPARFHSDGGGLSLQFFDYPTLSPAGLQPDAMLGTQLA

SEQ ID NO: 7156 - protein, 463 aa, Chromobacterium substugae
MSASSISSNVGPLDVQSIVSQLVAADSQPLTQSQQRVSNYQSELSTLGQVSSALSALQTAATTLSSGTFLQQFAATSSDSTVANVSTTSGGTAGSYVLNVTQLAQARQLVFDQNSNGSPITNENAALSGAPSSLTFNIGGTSSTVNLSNGGSPVTLSSIASSINGAGIGVNASIVQYNNNYSLVLNSAQAGPSNAFTITAGGTDSNGTSGNTLAGLQQSSTAATESTNAQNALMTVNGVNVSSSSNAVSNVITGATVNLEKLGQVTVNMSQNTANITSTLQTFVSAYNQVVSATNSATTSSKTVGSTPANTDISSDLTGLQEQLAGILGTPVAGADPVNSFAYLAQVGITQNADGTLALNSTTFNSALSSNPGAVTNLFGNAQNTGIGNVFNTAINNLLGPTGLVTIDQNNLNSQVTSEQQLQSQLQSQLSNEQSSLLTEYSNLNSELAQMEQASTSMANLVG

SEQ ID NO: 7157 - protein, 308 aa, Chromobacterium substugae
MDIDQARLTHLQQLEAESIHIIREVAAEFENPVMLYSIGKDSAVMLHLAKKAFYPGKPPFPLMHVDTTWKFRDMIALRDKQAKENGWDLIIHVNQDGVDAGINPFTAGSAKHTDVMKTEGLKQALNKHKFDAAFGGARRDEEKSRAKERVYSFRDKNHRWDPKNQRPELWNIYNGKIDKGESIRVFPLSNWTELDIWQYIYLENIEIVPLYFAAERPVVERDGMLIMIDDDRILEYLTPEEKARIETRKVRFRTLGCYPLTGAVESAAASLPEVIQEMLLTRTSERQGRLIDHDSAGSMEKKKMEGYF

SEQ ID NO: 7158 - protein, 478 aa, Chromobacterium substugae
MSHQSELISGDILEYLRQHENKDMLRFITCGSVDDGKSTLIGRLLHDSKLIFEDQLAAIERDSKKYNTTDQNIDLALLVDGLQAEREQGITIDVAYRYFSTDKRKFIIADCPGHEQYTRNMATGASTSNLAIILIDARRGVQTQTRRHSYIVSLLGIRHVIVAVNKMDLVDYDESVFNRIRDDYLTFAEHLDIPDIHFVPLSALRGDNVVSRSEAAPWYQGPTLMHLLETIQVSHDVALDAFRLPVQYVNRPNLDFRGFCGTVASGSIHPGDRVVALPSGKQSRVKEIVTYGGQLPRASSGQAITLTLEDEIDISRGDMLVRADEAAPHVSQSFDAHLVAMGETPLRPGKEYGFKLAGKYVTGRIESILHRTDVNTLQNGPAEALALNEIGLCRISLNSLAVFDSYRSCRGSGSLILIDRLSNGTVAAGMIGQTVESAVDSQSPWQRFEQELSQLLRKHYPDMTLAQLAQRLAERAGD

SEQ ID NO: 7159 - protein, 107 aa, Chromobacterium substugae
MSEVAAAPAPQKQALGPNQCVVLGRIKERRSHNGYIFTTIIQPAADEYSMPGIVEVRSKKSLGQVGDDVRHLCQCSGYTNKPFESRDKETGEVVIRRTVSNVFIAIE

SEQ ID NO: 7160 - protein, 81 aa, Chromobacterium substugae
MKFRSVAKKFAPRINVKHAVFALAAAPLAAFADGTGAPDVSTVVAAIVAGGVAIALIGNAKSGVQAVMALWGMIKGAIGRG

SEQ ID NO: 7161 - protein, 444 aa, Chromobacterium substugae
MWRATSLFWLCAVLLGFCSGSARADSTYPAHVTYTWYGQTFGSMDAVAAACANTLLNGQGGVWSGYSCIFGGVSLFPSTSYSCDSDDSLDANGQCHKAGPPPPPQCPSPDVMAITCMAIKGTHQKSGMITPTSGPGCDTGGGSPDMQRCGAGCSMTTQTVVTPTASYMDHVYNGAACTPGGGVSNPGGFVPTPPTNQVCGNNQVYGEINGTPTCVDNAQKPGTQPPETTSPDSCPQGSVALISPTTGKPIACIDPHDSSTPCPSGQYSVSQGGSTICMGSPSNPTPSSPAGTGSSSGHSGSSSGSSGSSGSSGSSGSTGSNGGKPGDGSKPPDSSAPQPETCDDKFPDGLKWICGLGAGLSGPDGSDKLTTQSGGDVSGMLDTSDMFGGGSCPAVNHLVVPVGDSNFTWDIDYGPFCHFVLMMKPGIIAIAMLSALFIIFKRGG

SEQ ID NO: 7162 - protein, 385 aa, Chromobacterium substugae
MIYLVTAVPGSGKSLYTLDWLRKKSDNESRQVYYNNIPLSKTGLDLLQWIEFPDPTKWMHLPPGAIFVMDECQFSFPVRKSGKDTPEHIEKFSTHRHLGIDIVLITQHPGLLDSFIRRLVGTHIHLVRQFGAERSTVLTWQEGCQENPNSKSAQKACLDRRTFVFPKEVYSWYKSAEAHTHKFQMPLRLKQMIMWLIAVVFLIAASVWYLYHNMIAKPREEAERLQNKTNASQPVSQTPSPQQSQNAGQGGNSNQRIIKTAQTFLQDRQPRVDGIPESAPAYDELTTPKTFPKVTACVASNSKCSCYNQQGGLIQMDDYRCRYYVDKGWFDPYMDKGEMQDRQIMASRQNASAPAAIARQKPARPEVLAMSSSNIFPRIDQRKGN

SEQ ID NO: 7163 - protein, 61 aa, Chromobacterium substugae
MNNQPTITLSQAIGHLKASGFQANGMQVLAYIASFNAAMEFYRQQVGERQSMDVATQDASQ

SEQ ID NO: 7164 - protein, 434 aa, Chromobacterium substugae
MPELYQPFKALQASCASIAQSERLDVDHWHAAAIRCQSLDSGGQPLPLKLDYLTLIADSLDSDSVQEQLTLHRLHLTPRKAKFGYQRGVSVHLQEFCLDDPVFEVFWGGDSQRGTMMFDRSGPLSALAAGILCRIFGAEQFRLSRADVALDLQYPDCYREVKSFLDQQFSDWHIGGRGGQKPAYREISDCGTGKGCTTYLGSGDVHMLRAYEKGKQLQRLDALDWVRVEVQLRPGKRPAQFLAWSAVAAGRFFQIWQMTPYVRFSDYFLCQQAGRIMAEQPSRDSALEAKAKHLVTQYYGVMQQLVGLHAHGDWSELGNIIQRVKGALDAGSGSTWHVEQALLDQSTGQTLVEFSDSDGSHNLYYVKLTIRIKTTKTAPATTKSPARRGSIICGAHAMKRRVFSPRTNFAWTNGTGSVVMFTSDDKATARRIRA

SEQ ID NO: 7165 - protein, 166 aa, Chromobacterium substugae
MLISADAAAQETSNSINPFGNTQMENRIKDFPKLKVTADIASISDIHQACGMTRWIWVIGAFMQGCTSFDQDMQWAHIRIAKFAATRDLRHEVAHTCGEYHGDAMPRYVENWKHRVNWQPRTDNRCSPQYEAETYQHLYQALKQAGWQPCDEEHERLAQDRTRRGG

SEQ ID NO: 7166 - protein, 615 aa, Chromobacterium substugae
MNDSRLLHDSHEAPKAWHALAAEHWLAPWISLAGPGYGQTADAVDSAWSNTFDQMLHAQMSRATLGISPASLALAFYDWATHFAISPGKWAHLAENGTGKWAKLTHYLPRACLDSACAPCIAPHEQDKRFSDEAWQRWPFNLYSQAFLLQQQWWLNATTSIRGVSPHHEQVVSFVARQLLDMISPVNFLATNPLVQEATFLEGGQNLLRGWRNLQEDWERRRAGLPPCGAEQFIPGETVAATPGKVVFRNHLMELIQYSPCTPRVRTQPVLFIPAWIMKYYILDLSPRNSLVRYLVGKGYTVFMISWRNPGAEDRNLGMDDYLRLGILDALDVIGRILPDCRVNAIGYCLGGTLLAITAAYLARENHSVIQSITLLAAQVDFTEAGELTLFIDESQIAFLEDIMWDHGYLDAKQMASAFQLLRSNDLIWSQMVQEYLLGKREPLTDLMAWNADSTRMPCRMHSEYLRRLFLDNDLFEGRYQVDGRPVVLHDIRAPVFVVATEKDHVAPWRSVHKIKLALDTDSQFLLASGGHNAGIVSEPGHPGRYFRLSACRSEDRYIDPDTWLQTTAPQNGSWWEAWEEWLGKQSGTLSAVPALGCAQYPPLEPAPGRYVLER

SEQ ID NO: 7167 - protein, 391 aa, Chromobacterium substugae
MQLNLLDLHWWGAGLAMLGLTHATIASVTIFLHRHQAHQSLRLHPLASHFFRFWLWLTTGMITREWVAIHRKHHAATDTLDDPHSPQCLGIWRVLLEGSELYRRAAGDQAMLDQYGGGTPDDWLERRLYARHSRLGVSLMLVIDLLLFGPVGLSVWAAQMLWIPIFAAGVINGVGHYWGYRSFATNDSSRNILPLGLLIGGEELHNNHHAYATSAKLSIRWWEFDVGWLYIRLLACLGLAMVRQPLAPLRLNPRKLHCDEGTLSAVIAHRYLVLSRFDHALRRVAAAELRRLRFRLEALQPAAGVEAIRRWLRHAAREPLPDCELLERTLPLSMALNTIYTMRAELASLWERSANSTEQLSGQLEDWCKRAENSGIDGLSEFSRQLRKYDF

SEQ ID NO: 7168 - protein, 240 aa, Chromobacterium substugae
MSGNDDPRRNGVLADLPELEWQRLAPQLEPVEMPLGKVLYEPGCTLSHIYFPTTAIVSLLYVMEDGASAEIAVVGHEGIVGIALFMGGETTPSRAVVQSAGTGYRLKAQILKDEFNRAGAMMHLLLRYTQALITQMGQTAVCNRHHSLDQQLCRWLLLSLDRLPGNELVMTQELIANMLGVRREGVTEAALKLQKAGLIHYARGHITIVDRDGLERRTCECYDVVRKEYQRLLTVPLARR

SEQ ID NO: 7169 - protein, 893 aa, Chromobacterium substugae
MPLSAEDSLRKFPLASGRQACFHSLPALAELGVGDVSRLPVSLRIVLESLLRNLDGRRITEEHVRQLASWQPRAARSEEIPFVVARIVLQDFTGVPLLCDLAAMRGVAERFGKPAKLIEPLVPVDLVVDHSVQVDHYREGNALDLNMQLEFRRNAERYRFIKWGMQAFETFRVVPPGIGIVHQVNLEYLARGVLRKDEVYYPDTLVGTDSHTTMINALGVVGWGVGGIEAEAGMLGQPVYLLTPDVVGVHLTGRLREGVTATDLVLAVTERLRQAQVVGKFVEFFGAGAASLTLPDRATLANMAPEYGATMGFFPPDEQAAAYLAATGRSEEEVDAFRRYFQAQGLFGMPQAGAIDYSQTLELDLAGIVPSVAGPKRPQDRIALPALKSRFHELLAQPASSGGYGKAGAAPASDGALGHGAVLIAAITSCTNTSNPGVMLAAGLLAQKAAARGLKVAPRIKTSLAPGSRVVTDYLDKAGLLPSLQQLGFRVVAYGCTTCIGNSGPLEPALEAEIAAKDLICAAVLSGNRNFEARIHPAIKANFLMSPPLVVAFALAGRVDIDLDSEPLGVDSAGRPVWLREIWPSGQEVAAALAQATDPATYRRLYQDFVDSNPLWSGIAAPTGQVYGWEDSSYIAEPPFFQDFALQPAAVPQVQGARALAIFGDSVTTDHISPAGSIKASSPAGQYLQQRGIAPLEFNSYGSRRGHHEVMMRGTFANVRIRNLMLPLDADGKPVEGGLTLSQPDGAQRFLYDAAMEYQRTGTPTLIFAGEEYGTGSSRDWAAKGTRLLGVKAVIARSFERIHRSNLVGMGVLPLQFTGSDSAAGLKGDEVFDLSGLEQGIQPRQAVTLTARSPDGQTRQLSLLLRIDTPVEVEYYRHGGILPYVLRQLLGAR

SEQ ID NO: 7170 - protein, 862 aa, Chromobacterium substugae
MLQAYRQHVAERAALGIPPLPLSAKQVEELVELLKNPPKGEESTLVDLITHRVPPGVDDAAKVKASFLAAVAEGSVQSPLVSRELATELLGTMLGGYNIKPLIDLLDDAAVAKIAAAGLKKTLLMFDSFHDVKEKMDKGNAVAKEVVESWANAEWFTSRPEVAEKITVTVFKVPGETNTDDLSPAPDAWSRPDIPLHYLAMLKNPRPDAKFVPEEEGKRGPMQFIDDLKAKGNLVAYVGDVVGTGSSRKSATNSVVWATGQDIPYVPNKRFGGVTLGGKIAPIFFNTQEDSGSLPIEVDVSKLEMGDVIDIYPYSGKIEKNGATVAEFKLKSEVILDEVRAGGRINLIIGRGLTSKAREALDLPASTAFRLPKSPVDSGKGFTLGQKMVGRACGLPEGKGVRPGTYCEPKMTTVGSQDTTGPMTRDELKDLACLGFSADLVMQSFCHTAAYPKPVDVKMHKELPSFISTRGGVSLRPGDGVIHSWLNRLLLPDTVGTGGDSHTRFPIGISFPAGSGLVAFAAATGVMPLDMPESVLVRFKGKLQPGVTLRDLVNAIPLYAIKQGLLTVAKAGKKNIFSGRILEIEGLPDLKVEQAFELTDASAERSAAGCAVHLNKEPIVEYMRSNITLMKAMIADGYQDARTLERRIKAMEEWIAKGQLLKADADAEYAAVIEIDLADVKEPIVACPNDPDDVKFMSEVAGTKIDEVFIGSCMTNIGHFRAASKLLEGKADIPVKLWVAPPTKMDAKQLTEEGHYGVLGRAGARMEMPGCSLCMGNQAQVREGATVMSTSTRNFPNRLGKNSNVFLGSAELAAICSKLGKIPTVEEYQANIGIINEKGAEVYQYLNFDQIEEYQELAASKA

SEQ ID NO: 7171 - protein, 287 aa, Chromobacterium substugae
MNSLRIFEAAARLESFSAAAGELFVTHGAVSKQIKQLEDWLGILLFERSGGRVKLTDAGWRYLVQVQDGLDLIANATSQLLQPNNQRRLSINSTPTFASYWLLPRLGGFRARFPDLELHLATSDRDISRLDAPFDLAIRRGPGDWPGHIAKPFLKEWELPLCSPALLARIPLHSPADLTAHTLLHADTRPTAWPRWLTLAGVPELKPASSMHFDKFSLALQAATDGLGVVLGPMPMGQAQIDAGFLVSPLPEPVVTVRDYCWVVPRMAAEDPTVSAFCRWLESEAGA

SEQ ID NO: 7172 - protein, 260 aa, Chromobacterium substugae
MLSRTIALLLFSLAAWSAPAPALTIYTEDWPPITFQRNGVADGMAVEVVREIQSRIHDNSQIEVVPWARGYKELLTNPGVMLFTVGRNEARERQMSLLGPIAVSQTVLLARKGEAAKLLALGAGIYQRPVGAYRGSIFADAASAAGFVEVDLAPTPQVTTQKLLLGRYDMWVEGGFVVSSVLKDIHQPSDSVELVRVLESLELYLAFSRGTPADEVKRWQDGFTAIKKDGAYKRIYNKWLPRDAAPMDVRLIGVPPGPVR

SEQ ID NO: 7173 - protein, 335 aa, Chromobacterium substugae
MSRITLSRFLIEQQRKAGTLPPELRLLIETVGRACKAISYSVNKGALAGVLGEAGTGNVQGEAQKKLDVIANDFLLDANEWGGSLAAMASEEMELPYHIPGEYPKGEYLLMFDPLDGSSNIDVNISVGTIFSILRCPEGVTQPSEADFLQPGTRQVAAGYTVYGPQTMLVLTFGSGVHGFTLDREHGSFVLTHPDMQVPERTGEFAINMSNMRHWEAPVRRYVDELLAGSTGPRGRDFNMRWVASMVAEVHRIITRGGIFMYPKDARDPGKAGKLRLMYEGNPMAFVIEQAGGAATNGLQRIMDIQPQKLHERVAVFLGSKEEVELVSRYHLEQK

SEQ ID NO: 7174 - protein, 216 aa, Chromobacterium substugae
MISPHAVPVDLLLAYSSYLLGTASPGPSNLAIMSAAMHAGPRPALMLALGVVCGSLFWGCLAALGLSAVLADSAMALLAIKMAGGLYLFWLAYRSGRTAIAGLRVPAGMPGGEAGRKMFLRGAAMHLTNPKAIFVWLSIVALAMPAGGSLRDGLWMVAGYWAIGLLVFGGYAAVFSLPRVREGFLRVSRLFDGALSVSFAYAGWRMLASALKPAQA

SEQ ID NO: 7175 - protein, 265 aa, Chromobacterium substugae
MAIQLKDAQDIEKMRIAGRLASEVLDFITPHIQPGITTEAIDKLCHDYMVREQGTIPAPLNYAPDGHIPYPKSICTSVNHVICHGIPNDKPLKNGDIVNLDITVIKDGYHGDTSRMFYVGEVSPHARRLCKITYECMWKGIEKVKPGVKLGDIGYAIQQHAEAAGYSVVQEFCGHGIGKKFHEEPQILHYGRPGTGLEIQAGMIFTIEPMINQGKRHLRMLADGWTVVTKDRSLSAQWEHTVLVTETGYEILTQSAGTPEKPSFK

SEQ ID NO: 7176 - protein, 281 aa, Chromobacterium substugae
MSLTINSNLASLAGQTQLSKTQKSIQQSLAELGSGQASVNAANQAISQQLQAQINGNNQALNNTNDGVSLVQTADSALGQLQSNTQQIQTLAIQAGDGALSGSNRQALQQQVDQLTQANSQIVQSAQYNGTPLLTGGNATTFQVGPNGTSSNQLTVPGINLSAAPASGGLNSYNANLAATNTIDITTQANALTAQQSAQNDLNAIGAQRTTLGAVNNSFNSVVDNLQTSNISTQAANSRISDADYAAASAQLASQQILGQSAALAQRQANIAPQAALSLLG

SEQ ID NO: 7177 - protein, 134 aa, Chromobacterium substugae
MSITPAITVSSLDYERLAALLETCEQGHPVAGRLEAELERAEVVEPEAMPANVITMNSRARIRLGDGQEKLLTLVYPREADSEQGRISVLAPIGAALLGLSIGQDMQWPTPSGTTRLTVLEIVYQPEAAGEYHR

SEQ ID NO: 7178 - protein, 366 aa, Chromobacterium substugae
MNTSELRRQTVLIVDDTPENLTQLYGLLKDHYRTQIANSGERALQIVAGDVLPDLVLLDVMMPGIGGLEVCRRLKSDPRTMGIPVIFLTAMSENEDEQAGFDAGAVDYIIKPISPPIVMARVTTHLRLKAASDFLEDKAAFLQSEVERRTREVQVIQDVTIMALASLAETRDHETGNHLRRTQNYVRALAMELRNHPKYRKGLDDETIMMLYKSAPLHDIGKVGIPDHILLKPGPLTPQEFEIMKTHTTLGRDTIAAAEKMLDTPSNFLRLAREIAHSHQEKWDGSGYPEGLAGDAIPVSARLMALADVYDALISRRTYKPPFPHSQAVDMIREGSGRHFDPEMVKAFLQIADEFHAIALRYADNS

SEQ ID NO: 7179 - protein, 1030 aa, Chromobacterium substugae
MQQSDSANLQSPEFLSTLPPTRGQSALAYSAMLISALVFVITVPFAKIPLAKVWAFIPVYQSALAINDLVTAVLLFGQFAILRLRSLQLLAIGYLYTALMAMAHSLTFPGLFAEHGLLGSGAQTTAWMYMFWHGGFPAVVVVYAWMADRPLLEPSPARVGRSILASVLLTLVLVLTFLALATSGHGFLPVIMQGNRYSPLLWVVVSSVWGMSLLALVAVGLRRPRSLLDLWLMVVLFAWLCDVALSAMLNAGRFDLGFYVGRVYGLMAASFVLIVLLLENGKLYAKLAASSAELRDAKQAAEAATQAKSMFLANMSHEIRTPMNAIIGMSYLALKTELTEQQRNYVGKIHNAGTSLLGIINDILDFSKVEAGKLDLESEPFWLDDVLESISSLVAQKAADKNLELLFEMGKEVPQGLVGDALRLGQILTNLVNNAIKFTEKGQVAIIITLADRIGDKVQLRFCVHDTGIGMTEEQVAKLFQAFSQADGSTTRRFGGTGLGLAISRRLVELMGGTIQVESAPDWGSSFIFSSWLGLSRAVDARLDSLPHNIKGMRILVVDDNATARDILSEQLRALDFVVSTCTLGSEAIPLVRQAALNQPYDAVFIDWMMPEMDGIETIRRIREITRTAHIILVTAFGRDDVRADAKAAGSDAFLVKPVSQSSLFDVLVEVFGGGARTESPRKNDDFTSLNGLHLLLAEDNAINQQIAVELLEGAGATVTVAGNGQLALDKLETYGPEGFDAVLMDVQMPVMDGIEATRRIRADARFAALPIIAMTADALVEEREGCLSAGMVDHIAKPIDPHLMLSTLKRWTRPVESPPARKQEPNQEERVIPLIEGLDSAAGLRRVAGNRELYLHLLRQFVAEEAGAAARLDEALEDGDYPLAERIAHTLKGTTGSIGLAGLPETAAKLEQAIRSRTECKEGVATLMRQMERAVAALKGGLDALAPAPDQGVAQGGKLLLELSRLLAASDGEALGYFLSHAAEVRETFPGGDYAAFEKALTNFDFATALTSLRTAATQHGIALPEDAS

SEQ ID NO: 7180 - protein, 191 aa, Chromobacterium substugae
MQDIVDFVLEIDKLKQVTRKTRVLNSDRYENSAEHSWQIALLAASLQPYAAEPVDIAKVVAMLLVHDIGEIETGDTIVYAEGGWEERKAQELACVTRIFGMLPPEQGGRFLALWQEFEAGESAEARFAHAADRAMPVLLNLANKGQSWRENGIRHEQVVSRIGPPVRQGCPAMWEYLEGRLEKARDSGWLK

SEQ ID NO: 7181 - protein, 202 aa, Chromobacterium substugae
MLKAMNKVGIAGPAGMLDTIVVDAQGEATGVAVICHPNPLQGGTHTNKVVQTAAKALSQLGYVCYCPNLRGVGDSEGEHDYGNGEVDDAIAVVDHAKSQYPGLPLALAGFSFGGFVAARTRARIDADKLLLMGVAVGKYPIPTPEVPADTLVIHGEEDEVIPLAAVMEWARPQSLPVLVFPGAGHFFHGRLVQLAQMIQRCW

SEQ ID NO: 7182 - protein, 102 aa, Chromobacterium substugae
MSYFDKHVFVCCNQRANGEGCCNNLGASELHAYMKEQIKAKGLSGKGKIRVNKAGCLDRCNEGPVLVVYPEETWYTFVDKDDIDEIINEHMVNGRVVERLKI

SEQ ID NO: 7183 - protein, 469 aa, Chromobacterium substugae
MTEQYENFDGEMAAIRTPPHSIEAEQSVIGGLLLDNSAWDKIADVVSEADFYRHDHRLIYKHVAKLVELGRPADVVTVAESLDKNDQLGNIGGLAYLATLAQNTPSAANIRRYAEIVRERSVMRQLALVGTEIAEAAYSPMGRDASQLLDEAEGKVFQIAESTAKSKQGFLEMPGLLKEVVERIDMLYSRDNPDEVTGIPTGFVDLDAKTSGLQPGDLIIVAGRPSMGKTAFSMNIAEHVAVETHLPVAVFSMEMGGAQLVMRMLGSVGRLDQHTLRTGKLGDDDWQKLTYAIGKLSEAPMYIDETPALTALEVRARARRLARQHGGKLGLIVIDYLQLMSGSGRGDNRTAELGEISRGLKGLAKELQVPVIALSQLSRAVEQRPNKRPMMSDLRESGAIEQDADLIVFMYREEYYSPDNQEVKGLAEAIIGKHRNGPTGAVRLAFVGKYAKFDNAATVGVSGWADSDS

SEQ ID NO: 7184 - protein, 390 aa, Chromobacterium substugae
MQFDVIVIGAGAAGLMCAATAGQRGRKVLLLDHAAKLAEKIRISGGGRCNFTNLYAKFDCYLSDNPHFCRSALAQYTPQDFIAMVERHGIAYHEKKLGQLFCDDGSERIIAMLDEECRQAGVERRMETTISQVARVESGYALQTSMGELRAESLVVATGGLSIPQIGATPFGYQLAEQFGLPLTPLTPALVPLTFHVEDADTFSPLAGVSLDVEARAGKGKFRENVLFTHKGVSGPAILQISSYWQPGMELTLNLLPDADAEAWLEERAGSEQLISNALGEFHWPKRFAEAWLDREGFNKRLKDLGLKQRKQLAESLHRWRVKPNGTQGYKKAEVTLGGVSTKALSSKTMMAADVPGLFFIGEVVDVTGWLGGYNFQWAWSSGYVAGMNC

SEQ ID NO: 7185 - protein, 193 aa, Chromobacterium substugae
MEHKLPELPYALDALAPHISKETLEFHYGKHHQTYITNLNNLIKGTEFENASLEEIVKKSSGGIFNNAAQVWNHTFYWFGLAPNAGGEPTGALADAIKAKWGSFEEFKKAFTQTAVGTFGSGWAWLVKNSDGSLDLVSTSNAATPLTTDKKPLLTCDVWEHAYYIDYRNSRPNYLDSFWKLVNWDFASKNFAA

SEQ ID NO: 7186 - protein, 399 aa, Chromobacterium substugae
MTHLEKWLGRSAMVVDDSPSQRMVAAGLLREFGFAVVHEAENGLDALGQLAVLASVDLVVTDLNMPGMDGVKLLESIAKTCKGKVKFVAVMSGVPRDVLDTVQGVVDASELDLLAVFPKPLSLAEVRRVLDGCDPDWHLSGAVISNLKLSQEEVALALGLGQLVPYFQPKISIGDGRLFGMEALVRWEHPQFGVLQPAVFVHHLEQGPLALRFFYQFLRQVCLELNRFLAVQPDLHASINLPVPLLNDANLVDEMTCIVQSCGLTCHAIVVEVTETSLMSNLAASLGTLARLRLNGFGLAMDDYGTGYSSMKQLSRSPFTELKIDREFVHDASSSPKKLAILTAAIAMCQRLRLSSVAEGVENEEDWRQLSALGCDVAQGYYSSRPLSAEMFLQWMAER

SEQ ID NO: 7187 - protein, 363 aa, Chromobacterium substugae
MSIAVLIVDDSAVVREVLGQMLATAPDIEVIGASPDPIFAMNRMKLRWPDVILLDIEMPRMDGLTFLRKIMEERPTPVIICSSLTEKGARITLDAMSAGAVAIITKPTINLKSFLQEAAKELIQEVRDAAGARMGVFKRIASSAANPRGGEQGPAPKLTADVVLDAPSGLEKYHATEKIIAIGTSTGGTQALEYLLPRLPATCPGVAVVQHMPEKFTASFADRLNRLCKVEVREARSGDRLISGVALIAPGGKHLLIKRSGAQYMAEVKDGPLVSRHRPSVDVLFRSVAVNAGKNAVGVIMTGMGDDGARGMREMHDAGARTLAQDEESCVVFGMPNEAISHGGVDEVMSLERITHTLAGIRG

SEQ ID NO: 7188 - protein, 276 aa, Chromobacterium substugae
MLSDEEFAFFRQFIFREAGIDLPPGKRSLVQSRLSKRIRHLGLASYSAYWQLLRSPSAHAERQRAINLLSTNETYFFREPQHFHWLEREAQHLRDIRPGMLRVWSAACSTGEEPYTIAMVLAEALGLSGNWKIYATDINTKVLAAAKRAVYPIERARRTPPHFWQKYFLRGHDEYEGMVKVAPELARRVDFANLNLLHCDKFHHGEFDIVFLRNVLIYFNETTKLSVLSNLCTRMKQGGHLLIGHSESLHKLALPLVQEEPSRYRLDASRMRGGGK

SEQ ID NO: 7189 - protein, 179 aa, Chromobacterium substugae
MTERANPGAAHGSGKFHCVTFILGEDLFGIQINFIREIIELDGITHVPMMPSFVRGIINLRGSVVPVIDLSIRFGRGLTELKPSTCVAILSLPGLDNGYNEVGILLDAVCEVLEIPETDIDPSPTFGVSIRGDFIQGIATINERFAILLNVQQALSVTELSAMAESVAQQHFNDDAEVA

SEQ ID NO: 7190 - protein, 560 aa, Chromobacterium substugae
MNWFHNLQVRTKLLLSFGVLLALLLTMGIVGYQASARVNAGLEDLFTNQFSPLIGISNARVAAMTHNRALYRYLAETDKAKMDDAAAHMDQYDKELFQQMKLELGSTMEPEEADANRRWQTQWPIYLSASKEAMKLAYEDPGTGEGRKRAMEIVRSKARPAFDIVEQSLTLVKEVNERVAEKTHTLGQETYASTTRVVITLSIISLLICGALSLLVTRSILRQLGGDPSYAMQVVARVADGDLSVPIKLNGNDSSSLLYSIKGMAHRLSDTLAEVSSMSESIGAASEQVSSTASSLAQTASELASSVEETSASVEEMASTVTQNADNARVTEGIASKSADSATESGKAVGDMVHAMKEIASRITVINDIANKTDLLAINAAIEAARAGEHGKGFATVAVEVRKLAERSQVAAKEIGDLAGRSVSVAERAGVLLQEMLPGIDQTATLVQEISAASREQRTGIDQINTAVSQISTGMQSSASSAEELSSTSEELSSAAMQLQDLMQQFKLRSSRHARKGISLHMSGHGAGGARKTASAPPHSMQADDDDFDEGVDDDKFSKY

SEQ ID NO: 7191 - protein, 722 aa, Chromobacterium substugae
MDLSKAKAVFFEESRELCDGLETALLDPVAYPPNAETYNLLFRTAHTIKGSAGIFGLDALVRFAHVVENVLERLRSGQVALSDDLIGLLLSCNDHLRRLLDSASISDDMARQDLPEGEPLLLSLRRYQDGEAVETDAQTEGAAPPAAAASESVATQTPYWQLSLRFHADTFRHGFDPLSFLRYLAGCGTVLQAEPVWRNWPPLPLFDATECFMGLDLSLESAESPERIAGTFEFIAEDSLIGILPPHASLADFLALAERLGEPLDEQLARWLRRGALTEAEAARIERGDLGQPEPESETAAVLEGPAPASTAAQPAGGAPSKPGRGDGQYIRIEAGKLDRLINRVGELVIASSGTKLIAQARGDAELLESVAVINTLVESIRDDALTLRMVPVDEIFSRFPRMVREVSKQLGKTIHLEIKGGDTEIDKSMVEKLTDPLMHIVRNAVDHGLESADKRLAAGKPPEGTVTLNAYHDAGSVVVEVKDDGGGINREKVLAKAVERGLVAEGRVLSDQETLQLIFLPGFSTAEAVSDLSGRGVGMDVVKRNIESLRGEIEIQSQPGLGSTFRLRLPLTLAIIDGFRVEVNESALVMPLDMMIECVDMPPGAMSQRARQVNLRGDWLPFVSLRELFGLPPSGQPEYIVIVHYGEHRAGIVVDRLMGEVQAVIKPLGEIFKSLRGISGSTILGNGKPALVLDIPQLIHHACRRERRLIKQGTEAATHWD

SEQ ID NO: 7192 - protein, 110 aa, Chromobacterium substugae
MPIQVTQDGEAMRAAIDGELTIFTIEMLQDELLGLLNHPSVRLDLSAVTELDGCGAQLLCVLLAEARRMERDVSIAGSNALVDEVGNWLGFAAETGAARMESAGEGEHGS

SEQ ID NO: 7193 - protein, 122 aa, Chromobacterium substugae
MGKSILIVDDAASIRATVSIALKGAGYEVIEACDGNDALAKLNGARVNLIISDVNMPGMDGITLLKRLKEGAATRFLPVIMLTTEGSDDKKMQGKEAGAKAWIVKPFDPLKLLDAVSKLIQP

SEQ ID NO: 7194 - protein, 383 aa, Chromobacterium substugae
MPNRNRFLIAYLILCALAALALVWLSPWLGWLMAGSGGAAACLLAGKQESPISPREEPASASHAGQGPADENLALLEAVIQRWMGNLQLVLEQSTSGSNQVAATLSAIAGSLHATIEASRSAATDIGADSLDKMVSDAGMLSREISHVLSEIVSHRQLLIDEVSKLTTFSVELRAMAEEVGNISNQTNLLALNASIEAARVGEFGRGFAVVADEVRKLSQQSAQTGIKMSEKVETINAALEQTRQSTTSLGAQDADKGNGALGLLDASVQDFSAAAGRLAEINQKMQSDGSQVERELNASLVALQYQDRVSQIIQHVASDLERMLEHLRQTREARKTGCEPPAISSQEWMKRLESTYTTLEQAALHQGAGAKAQASQGDVDFF

SEQ ID NO: 7195 - protein, 247 aa, Chromobacterium substugae
MSRIALAGLLFALCCGTPARAAPALELVTLQYPPYQYQENGEVKGFAADLVREAFRRLNLAVHISVYPWGRSIAMVTDGRADAIFTLYRTPEREALLDYSNETLAQQEVSLFVRKDSPISSGGRLDALSAYRFGVVRAVSYGVVFDQAVKSGQIKVGEVAASGEQNMDMLLAQRFDILVSNRLGARDILRRRHEEALVRELSPPLEAIPSYMAFARKRSLAGLRQRFDAALAAMKRDGSYARLSAAP

SEQ ID NO: 7196 - protein, 510 aa, Chromobacterium substugae
MCGILGVVGQSPVNQLLYDGLQVLQHRGQDAAGIVTANGKTFHMHKGSGMVRDVFRTRNMRSLLGAAGIAHVRYPTAGSASCLAEAQPFYVNSPFGIVLAHNGNLTNTEELKADMFRHDLRHINTNSDSEVLLNVFAHELAQRVKGHDLSVDAVFGAIEAVHRRVRGAYAVVAMIAGYGLVAFRDPNGIRPLVIGVNDSLPKTEYMLASESVALDCSGFTLLRDVQPGEGVFISFDGEFHSRPCAKHTRHAPCLFEYVYFARPDSVIDGVSVYQSRLNMGETLAEKIRRDLPELDIDVVIPIPDSSRQSALQLANALGLPYREGFIKNRYIGRTFIMPGQAVRKKSVRQKLNPVPLEFAGRNVLLVDDSIVRGTTSKEIVQMARDSGARKVYFASAAPAVRFPNVYGIDMPTRAELLATGRDEAEIAREIGADAVIYQDLEALKDAVRSANRELHDFESSCFDGEYITGDITAAYLDAIECARLDLKQQDQAGSEQMIDLNLNVAEQNLI

SEQ ID NO: 7197 - protein, 170 aa, Chromobacterium substugae
MTVFDYIAIAVIGGSVLVALMRGLIAEVLSLGSWLIAFWCAKQFSPLAAGFLPESLPGEGIRLVAGFVLVFFLVWLASALLRVTLTGLLDSVGLGLINRLLGGVFGFARGVVLVTALVLIGGLSSLPQKPMWRNAVLSVPFESLALSLRPWLPPILADNLHYTTGQAPDS

SEQ ID NO: 7198 - protein, 244 aa, Chromobacterium substugae
MALSSHDELILLRKRARRRLVGALVLVSIATVVLWNVVGHLPEQQMKPESIEIMGAASAPVPASAPLGSKHTASGSAAEAAAAPATELPANLSTITAPLPAEKETVKPQAAPAKPAVAQAAEPKPREAKAEAKPKTEPKAESKPRKADPAAILEGRFDPEPRPAKAETHGKSIIQLAALSDPAKVDALRAKLSGIGVSAHFSKVETSKGEVTRVRVGPFASQAEAQSTLQKLAKSGINGIIINK

SEQ ID NO: 7199 - protein, 422 aa, Chromobacterium substugae
MTARKTLDDWLRWQEGLHLSAVDMGLARVEKVRQAMDLAPNCPVIMVAGTNGKGSTCAMLSSIFRAAGFKVGTYTSPHILRYNERIAINLQPASDERIVASFAAIDAARGETSLTYFEFGTLAAVHSFIAEKVDVIILEVGLGGRLDAVNIFEPAVSVVVSVDLDHQAILGNNREDIGFEKAGIYRAGKPAICADPNPPQRLLDHAAAIGADLKLYDRDFGFTRMDNQWSFRCGGHQRHALPIPALRGAYQMVNACAALAALDALKETLPVGIGAIKQGLVEVEWPGRFQVLPGRPAVVLDVGHNPHAVKAMLAALRQLPYAETRYAVFSMLADKDLAAVAELARGEFDHWLTAGLDMPRGQSGETIAAALRQAGLANVESFGSVADAWSAALSRAGDNDRIVVFGSFHTVAEVMEARRHPV

SEQ ID NO: 7200 - protein, 152 aa, Chromobacterium substugae
MRDRPLLQPFAVAMRPSRLWLALVLASWLAYALLLSRYLPPAYLLSLPAAGYFAWRALRAGGWRRNGAWQRLEVDPQGRLSLCAAAESREAQVLDDCFVTPLLTVLNLRLEGRRVSLMLWPDSADAESRRQLRVYLLWFHPPQPSDTTETTP

SEQ ID NO: 7201 - protein, 118 aa, Chromobacterium substugae
MYFVDRAVAVIKPKQPFLDWLNQLPDTDMIDLTLDSLRSDCTAILLPEFVEPEEGVAHIDEISEQLFKMELASWDEDEAKWPKDLSLKAFWEWFDVEIHSMVMDSVDADITNHPANDL

SEQ ID NO: 7202 - protein, 642 aa, Chromobacterium substugae
MALITVEKACLAFGHHALLDNVDFSLEPGEVIGLIGRNGAGKSSLLKSIAGAVQLDDGRINIKGDVKVAYVPQEPEFNLEHTVFEAVAEGLGDLKALLTDYHHITHQLTQADADHEQALARMESIQQQLEARDGWQFDALISSVLSHLELNPDVRIGALSGGWKKRVALARALASKPDVLLLDEPTNHLDVAAIEWLEGLIKNFAGSVLLITHDRRFLDNVASRIVELDRGLLRSYPGSFSAYQTRKAEEMAVEEEQNRIFDKFHAQEEVWIRKGIEARRTRNEGRVRRLEAIRRERSSRRERVGQVNFQLDAGERSGKLVAELEHVSKGFGDKQLIRDFTSRILRGDKIGLIGPNGAGKTTLLKLILGELQPDAGVVKQGSKLEIAYFDQFREQLDEDMSVADVISQGNDFVEIGGAKKHVMSYLEDFLFSPQRARSPVKSLSGGERNRLLLARLFTRPANVLVLDEPTNDLDIDTLELLEDVIAQYSGTVFLVSHDRAFLDNVVTQVIAFEGAGRLEEYPGGYQDWQDTRQRMAALGAADKPKEAAPAAAAAPARQDKPKAARGKLSYNEGRELAALPDQISALEAEQAELNQRLLDPNCYRDTPREAVAWQQRIEEIDELLLEKLARWEELEAAQQRTR

SEQ ID NO: 7203 - protein, 265 aa, Chromobacterium substugae
MGFTLAGWQGRRVRAWRLAAWLALAAAAAHGAPLRACASDIDFPPFVLTSGFAEGAQSTGLAINVLQRALRRAGREPAVVERLPWRRCRETVAYGQRDIAIGVPTRELDPRRFRATQAFASVHLLYFYSAKRHPEAPPLRTLADLRRYTVCGLLGSRLDAFGIAPEHQDTGSKNERSAIVKVIEGRCDLFIEVSEVIDSLSAHDAELRDLFNASAIRRAALPGNTPTGLHFEFSRALKDAPALQRSFDATIQDLIRNGEMTRMTP

SEQ ID NO: 7204 - protein, 330 aa, Chromobacterium substugae
MSGKAARCARGSAWLAKLAALALSIGLAAAPAMAAEIVYIAAKADLPFWDTVGKGVRAAAESGGYTFSMLDSKLSADAQLANVRQAIERRAAGIVISPTNSKSAEDALRLAKKANTPIAIADIGSNGGDYVSFVKSDNYRGAYDVGSELAAALKSRGWTGASYGMITIELTRKNGQDRTDGFRDAMKDAGFASEAALRQMKDYSAEESYRYVREILAARPKMRGFFIETDQPVEGAMRAIREAGKSGQVLLVSFDAMPEVARLLKSGDLIAVGMQQPYLMGSTAAGALLSSLRGHQPAKEILVPILVATGRNVDQLMPIAARTVFGRAGK

SEQ ID NO: 7205 - protein, 216 aa, Chromobacterium substugae
MPVHAAAPPDRAEIAKRRMNLTGVQASMKEDLPIETGPSRRRLLQSAALAGLAALLAACGTTPPQKTSQRPPYRPGKPGGDVSLSNLQADGNGREILLYTIGLLDGGYQFGGNNPEAGLDCSGMVSYIYQNAVGIKLPHNAAKIAGLARPIPDSQMQVGDLVFFNTMSRPFSHMGIFIGDGKFVHAPRTNSTIRVARLDNVYFAPRYEGARTVLRT

SEQ ID NO: 7206 - protein, 276 aa, Chromobacterium substugae
MKLKFSKMHGLGNDFMVIDGVRQAVALTPERIRQLGDRQMGIGFDQLLLVEAPREVGHDFRYRIFNNDGGEVEQCGNGSRCFVKFVCDEGLSDKSGIAVETARGVIRPEYLGDGMARVDMGVPRFAPVDIPFIAEQEALSYPLELEDGPCVVSVASMGNPHAVQLVDDVDTAPVAAIGPQVESHPRFPERVNAGFMQIVSRGEVRLRVYERGAGETLACGTGACAAVVSGIRLGLLDARVLVHARGGDMVIEWAGAGCPVIMTGPAVTVFQGEIEL

SEQ ID NO: 7207 - protein, 216 aa, Chromobacterium substugae
MHSEQVLAFLDEHPDFLQQHAARLNLQAAPQNGERVVSFVERQLLELKDQNRQLEAQLQQLVERAQTNERTVARLHRLTLGLLASRELKPQIEALKRSLHQEFQLDRVALRLWHPAAESEAGHYNAQNDVQGLARNLTTPYCGPYVNDEVMSWFPATPVLQSFAQVALRGSDGQAFGLLVLASDDAQRFTFDMHTQYLSQIGEVLSAALLGALEAK

SEQ ID NO: 7208 - protein, 189 aa, Chromobacterium substugae
MTATPVGVSLLLVVLLFFLHASWRLIASRSGSAIACFLAAYVMLAALLNCHPEPISLTPLLLPFIYAYAWLGIAAALWAAVMMRVTRKALLFPGQDKRLAALFSSQLALHVGVFGLSPWLDWRPLAAYAMAPPLLAFVSYFAYRAQLLAMRRREDCGASWVSWGAMCLLLPLILMWLAQWLTPAILDLT

SEQ ID NO: 7209 - protein, 315 aa, Chromobacterium substugae
MSARSTSRNAYLLLVLTMLMWSTNFVIARALHSQVGPFTLAFSRWGIALCCLLPFALPRLRGNLAKLRAQWPLLLLLGVFGIGLTNTFVYWAVQTTSATNAVILNSATPVMVLLLGSLYFRQRLSRRQWGGMAVALSGALLIVLRGDPAALSSFHFGGGDLLVLAGGLSWAIYTLGLRKLKPGIDSLVLMSVLLAVGEMLLLPLFAAEAAGRGLPALDGPALASLIYLGVLPSVAAYLMYNRAIGMVGTAKAASFLYLMPAFGALQSIWFLGEELHRYHAAGLAAIFSGIALSSLTRSRAATDTQATVRRQEPQT

SEQ ID NO: 7210 - protein, 266 aa, Chromobacterium substugae
MAGAMAMTPVHTWLGALLACLFVLPARACDGAPAPDSAAAVDAPDLQGIAVYLPKVLESSDSGPFADLLKVVGRHYPAGRIRFSIEPVKRVYLDTSDKSVDFRFPIMKIREGADRGTPFQFSHEMLGKVSFVIYSNKEKPFGKADLLRMATLPKYEVAIHAPPASWDFPASRVINLELSLKQLNLGRIDAVIWAQEDADYLVRKDGLGHIHREHLDDYPDVLFFSCNKRGDFVNQAMSAAIRAARDSGELQKAYAKVHQPYQDWQP

SEQ ID NO: 7211 - protein, 203 aa, Chromobacterium substugae
MSLRRWSGAGMLLLALAGCASPQARFYSLESASAASGEPAQFGKRVMLGPVSLPAALDRPQLVLDDGGGRLRLQEFDRWSAPLDRLLAQSLTLAVSRRSGVASVYAYPQPTMDGGDLRYALDVRRLSLQPGRQAALEVVWQLQGVSDGKLLAAGSFSRSIPLAAPGVDAALAGLQSLLDALSGEMAQPLRQHPEWWQPPAGRS

SEQ ID NO: 7212 - protein, 541 aa, Chromobacterium substugae
MSSEEPVEPQGQEPQLPQAVVLKRRRWAPSLVWLIPVVAALIGGWLAAHAIMSRGPTITISFQNAEGIEAGKTRIKYKDVEIGEVTAVALSADRQSILATAELSKQANDYLAADSRFWVVRPRVSGGGVSGLGTVLSGSYIGMDVGKSLARKTEFVGLETPPIINADLPGQTFFLRADNLGSLNTGSPVYFRRVPVGQVVGYELDQKGSFVRVSVFINAPYDRFVNANSRFWHASGVDVSLSANGLNVNTQSLAAIALGGIAFETPLSDNAAIPLSDRNFILHDTRDKALQNPDREMQAFRLRFRQSLRGLAIGAPVDFRGIIIGEVTAIGVEYVPERKDFDMTVDIRTYPSRLDSLSHGSRISRKLSSQQLVANGMRAQLRSGSLITGQLYVALDFFRDAPPAKLVVRGGIAELPTIPGDLEELQRVLQRIAKKLDAVPFDSIGQEMDASLKSLHQTLDSMRKLSDGINGEMLPQTLKTLEQLQQTLDATRQTMKADSPLQQDVRSAAQEVKETARSFRALADYLDRHPEALVRGKEAQP

SEQ ID NO: 7213 - protein, 211 aa, Chromobacterium substugae
MPGYGMKSAAARNLALCHGCGLLCRLEAGAAGVCPRCRAPLHLRRPAALQRCWALLLAAIISYLPANLLPIMETTALTGVQRDTILSGVVYLWNNDSWPLALVVFTASVLVPLLKILALLLLLCSVQWRWSWAPRQRTGLYRLIELIGPWSMLDIFVVALMVALVQWQSLASIKAGAGAVAFGAVVVLTMLAAMSFDPRMIWDPVEEEDEQ

SEQ ID NO: 7214 - protein, 211 aa, Chromobacterium substugae
MAAVTPPRGPLAACHDCDLLLRLPAAAADRACIHCPRCGALLHEQADGALHAGAALAVAGAVAFVIANSYPVLVLEIAGNRNAATLWQTALALQGQGMAEVALLVLFTGIVMPALELASMLYLLLPLQYGRAPPGFAAVMRLRQLARPWCMVEVFLLGVLVSLVKLVHLAAVHPGIGLWAFFGLIVLMAACASRFKPVQLWERYQACQATE

SEQ ID NO: 7215 - protein, 79 aa, Chromobacterium substugae
MPNVGPRAAADLERLGIQEPGQLRGRDPHQLYLELCDRTGQRHDPCVLDVMLSICHYMDTGEARSWWSFTAERKRRWPQ

SEQ ID NO: 7216 - protein, 254 aa, Chromobacterium substugae
MLLSLSFLCVIAFFAGLVDAAVGGGGLIQIPGLFSALPNVAPATLFGTNKLASAVGTLSAARSYLRRVRLPWRLVLPCAAMAFVFSFAGAQVVALIPKDVIRPLVLTLLLIMAAYTLWKKDFGKLHKPVAIGRRELLMGMAIGGAIGFYDGLFGPGTGSFLMFLFIRFFAFDFLHASAAAKVVNLTTNVAALLSFAIGGHILLAYALPMAAANMAGAMVGTRLAMKKGAGFVRILFLMLTSVLICKLGWDILRG

SEQ ID NO: 7217 - protein, 304 aa, Chromobacterium substugae
MKPLWGVRIFCAVVERRSFVAAARQLGTSPSSATRALQALEEEMGAALLARSSKQVELTMAGEAYYPIARQMLDLQQQAEEELNQQVAAPRGLLRFSAPETLGRGILPRVLARLAEENPDLRFDVLYSDATLEPIREKLDFAIRGAFPASSELIGYPLWDYRRHLYASPAYLARHGAPASPRELPEHRVIIHTAPRVLKAWNFVSAGSQISLNLSAWHRSNSGNGVLEAIRAGMGIGRLGDWLAEPLAANGELVRLCPEFRIVSSHGDDPQMHAVFPSRNIPRKARVLLDALRQEGRAAAIPAP

SEQ ID NO: 7218 - protein, 613 aa, Chromobacterium substugae
MFEFVQNNKTVIQVILGAVALTFVGFGVSSYSDVTADPYLVKVGSVKISKRDLDRALEGKPSDPATRQAALEEMIRNKLVLADARDHGAAISPDQLRKVIASIPLFQDNGQFSPQRYEEFLKNRYRSAADFEAEISEDMLIRNQLTAVAGTQFVSNTVVTRMAALLGEGRVLQPLTLKPSDFAAEVKTDDAAVKAYYDANAKRFRTPESVKLDYVVLSQDALAQSVKVSDADVQKYFDQHKSDLASEQRRASHILLTVPKGAKPEQKAKIKAEAEAILKEVRANPGKFAEIAKAKSQDPGSAEKGGDLGLNARGMMVKPFDDAVFSMKPGQISDLVETDYGFHIIRLDAIKTQGLEEARAAIVDKLQKQKASALFREQADKLNEVAYQQADSLKGVVDALKLEVKHSDWLQRNQPGKDELLGNDKLLAAVFSDDVLKKKHNSEVVDVGGGRLVVARVAEHQPERQRPVADVREDIRRELVEREGAKLADKKGQALLAELKAGKGVDAQKWGAEQTVSRRASGGLPMADARVVFSVAAAKLPGFAGVRHDTGEYVIYRVNKVIAAPAVSEADRAQLGGVLGEISANNQLGSYLQALRQKYPVTAGKQSLNDNSQ

SEQ ID NO: 7219 - protein, 89 aa, Chromobacterium substugae
MNKSELIDAIAAEADISKAAAAKALDGMVAAVTDALKKGDTVTLVGFGTFYVGERAERSGRNPKTGETIKIPAARSPKFRAGKALKDAL

SEQ ID NO: 7220 - protein, 435 aa, Chromobacterium substugae
MQVQLETLSNLERRMDIALPMAAIDSQITERLKRVARSAKIQGFRPGKAPLKIVEMNYGAQVREEVMGEQVQQGFYKAVTEQKLRVAGYPRFEPVAAGDDKENFKFAATFEVYPEVKVGELAGKEIEKPAVTVGDAEIEKTIDILRKQRTRYNRVEREAAVGDRVIIDFKGAIDGVAFEGGSSENFPFVLGQGQMLAEFEAGIVGAKEGDIKSVEVSFPADYHGKDVAGKTAVFEILVKNVAEAILPEVNEEFAKMLGIAEGDVEKMRGEIRKNVEREVKRRLQARTKENVMQALIDVTEIELPKALVGLEIGRLVEQARRDMQQRGMNVKDMPFPPELFTAQAERRVKLGLILSEVVEANKLEAKPEQVRSMIVEFADSYEEPEDVLAWYYESADRLEGPTSMVLEDNVVEFVLSQANVVEKALSFDELMGSQA

SEQ ID NO: 7221 - protein, 108 aa, Chromobacterium substugae
MVRIGFRAGVGCRACHSERIFFLSWLAIRMMRNHSRWLAGPGAARRNCPAISNGKRKAGAAPGRQGRSGRAGGARRWRVGRPARGQTSARCVIYCAFRWVRGVTPRSA

SEQ ID NO: 7222 - protein, 1912 aa, Chromobacterium substugae
MTRPTADSRPKPDPHHGDAMKTPLRPGLIAAWLLLPGLCAAAGVTTFSPQGEVKEVTQVRATFNSSMIALGNSAAPAPFAWSCGLKGKGHWVDDKTWTLDVRETPPANTDCRFTPKPGLKDLQGNAVASGQSYRFYTGQPIIAASWPSDGRIEEDQAFVLRFNASGVKPAALYCQSSSLPERIPVRTLAAADRAALLKHLKLEKQAANVLTVRCDQRLAPDSKLTLVHLRGASAPDKQQYQVRPAFAASMSCQRENAKGACIPFKPITLNFSSPVPAKLAQAIRLSGGGAERAPQAEQRNKGEPVDNVSFAPPFPPLATLTLALPKDFRDEVGRQPVNAGRFPLSIKLADYPPLAKFAAAPFGIIESGADAALPITLRSVEGDLNIKSVQLGGQALRLSRDADMMAWLAKVERYHESNLPAGKDKTVESRRVSLLNKNRDAVPLKLPAKPDGNGKWPFEVVGIPLPKPGLYVVEVSSRLLGKSLLAANKPMYVRTAALVTNLAVHLKKSGENAAVWVTTLDKGKPVPNARINIYDCKGNALWSGTTNAQGSALAKSALPAGDCSDEELSGLFVTARAKDAQGNEDVSFVRSSWNRGIESWRFPFPTQGGDGPAIIAHSILDRALFRAGETVSMKHLLRVQAGKGLAQLKPGQLPQQLRIVHDGSGDEVSLPLTWRKGRYAESSYALPKEAKLGEYTLYLERKGTRGPADQGKPSSPELDGYSLQSGSFRVEEFRLPAMTGRIATAKNAGIAPAQVPLNVSLSWGNGGPAKGWPVEVSAMLADGYQRLKAYDDFSFSPPQRSRENSEASLDGKVVLDKAAIQLDGNGNGKAIVDKLPKLDRRYDLVTEAAYRDPNGETQTLTRRIALWPSAVQVGISVDSWITAGRALQMKAVALDTAGKPLAGKDIKVTLREHRYLSSRKRLVGGFYAWDHNEETDDKGKVCSGTTDGRGLIYCELSLKDAGDMELIAEAKDEQGNVARSSQSVWVSQHDELWFDVDNNDRIDVLPEKTSYAPGETARFQVRMPFRKATAWVAIEREGILETRVVELEGKNPSIELKIAPDWTPNVYVSVLAVRGRIRDVPWYSFFTWGWKSPSEWWDAYWNEGGDYAPPTAMVDLSRPAFKYGIAEIQVGDAAKRLSVEVTPAKKTYGIRETADVAIKVKLPNGKPAPAGTEVAFAAVDEALLELQPNHSWELMQAMYQRHSYGVETATAQLEVVGKRHYGRKSLPPGGGGGKAPTRELLDTLLTWQPRVTLDANGSARVKVPINDALTRFRLVAVADLGNDQFGTGEAGFNVTQDLQLTSGIPPLAREGDQFQAGVTVRNGGDKTLNIKVQAGAPGLPALPARQLALPVGESRLVSWPVTVPSDIKELKWTFSAQQVDGKAADKLAISQRIDPAVPVTVEQATLQRVSPELSIPVALPPGALPGRGGIRVSLQAKLGNSLPGVRRWFEDYPYACLEQRSSIALGLSDRKRWDQLMSELPLYLDGNGLAAYFPLGEGAPDRGSDVLTSYLLAVAGEAGMEIPESPRGKMLDGLSAFVEGRLKRDLPINRQDADARRLAAMDALSRYGRFRPAMLDVLDLNPQKMSTSMLADWLSLLNRAADIPQRAARISEASNLLRARLTYQGTRMGFSTESGDNAWWLMGNGDVNAAKLLLAVRKLPDWQADMPRLLTGLLARQQRGHWDTTTANMWGSLAVAQFSRQFENAPVSGQTRALLGKSSLSLAWPQEGVKQLGLLPWPAGGASLQLKHAGSGAPWATIQAEAAIPLKTARYAGYSIKKTLTPVSQKVGGQYQPGDVVKVTLEIRAQNDMSWVVVDDPIPAGAAIQGSGLGRDSAIDAKSGNGGDYADYIERRFAGYRAYYSYVPRGEFKVEYTMRLNNPGAFKLPPTRVEAMYAPEVFGMAPNGVFRVMDGQ

SEQ ID NO: 7223 - protein, 231 aa, Chromobacterium substugae
MDIEQIKTLLAKPIAKLTAGGFRPTYQETESWLGKVSLFAPGEAIPLDDAGKPMLPLAQLCIPALPVISPRLADTRLLTVFISATLPEPFEAMGANWLVREYGHGDLLIRQDFLPQGPSLKAFPLQAERIDEDYPLWDSGDIPLELESEILRQERAGKIAGYYDLTCHTYTHKIGGYPSYYQSGVGLGEGFEFVFQIASDSKIHLNIIDNGCLMFWKHKTTGQWALYYDFY

SEQ ID NO: 7224 - protein, 737 aa, Chromobacterium substugae
MPLNDSSHHIAPARKLAPAPSARRRPKLSLVLLALLSAPVCAQPTFKEVKAAWQPSDVTLLDRHGQVLQRLRVDKQARRQDWVGLADTSPAFRQALVLSEDKRFYQHSGVDWSGAAAAAWANLWNTRTRGASTLTMQLAGLLDDDLKAGKGGRSLWQKMGQTWSAAWLERHWSKAEILEAYLNLVGFRGELVGLSSLSSTLFGKLPAGLNLEESAIAVALIRAPNAAPDKVAGRACRILQDMGRKPDCGVVAVHTAQALAKSRAANPLAEQDAPHFAQKLLQRQKLAAGSRVATTLDLPLQRYASAALRRHLAALSQRNVQDGALVVLDNQSGDILAWVGSSGRGLSNAAQVDGVTSLRQAGSSLKPFLYQMALQQRYLTAASLLDDSPLDLQTGAGLYAPQNYSKDFKGLVPVRTALASSLNIPAVRTIEMVTPNAFRDRLVQLGFASLTEDGDYYGYSLALGAADIRLLDLANAYRTLANQGLASPPRWTLADAKAKPTRLLDAASSFIIADILSDRTARALTFGLESALSTRYWSAVKTGTSKDMRDNWAVGFSRRYTVAAWVGNAGGEPMWDVSGMHGAAPMWQTVLDRAQQSAPPSQPPAPPPGLARQRVRYQGDVAAPRTEWFLAGTQRALIVPQKGSAADLTPGIAAPVDGSIFALDPDIPPANQRMVLRARGVAKPQWWLDGKKLGNGAELAWFPWPGRHRLELRAGDGKSVEKVKFEVRGAAAKPKPR

SEQ ID NO: 7225 - protein, 186 aa, Chromobacterium substugae
MAAAAPADGFSFAVGGNPAVQGQAAPPPETPAERQRKQQLRKLGYQIEARYYQMSLAQLRELAKQGNVQALTHLAERYLFQLDGHPGEPGYEAGFRYRDEAREALQQAYALGNMHAAAMISESYLLEKQPLEAAAWNQVARRSGDALSADWFLKTKDYQALTDQQKAGAAQRADQLMQSLARRKPA

SEQ ID NO: 7226 - protein, 183 aa, Chromobacterium substugae
MTRKIFNAAALAVAIAGQAAGALAMPVSNAYIQSSANEIRGQLGSYSRPTVYVDQSACGEGQASAMACGPYTISVGVGFLQQQESSYGNYVAKFILAHEWGHTIQFTRGINRQPPMQELQADCVGGTFAKYAETNLRYPSFIENAVASARDAADYAEHGTPSQRDYYSRYGYANGLNTCLNRI

SEQ ID NO: 7227 - protein, 273 aa, Chromobacterium substugae
MPGRDFYHFSEPHCDEYTPAIKNTSYFSMESPIMTKALIVITGASSGIGAAAAKLFSQQGHPLLLLARRIDRLQALDLPDTLCRQVDVTDRAAMLAAVAEAEARFGPADAIVNNAGVMLLGALARQDPDEWQAMLDVNVKGLLNGIHAVLAGMQARGRGSIINISSIAGRKTFPSHAAYCGTKFAVHAISENLREEVAGSGVRVITIAPGAVETELLGHTTDEAIKAGYQEWKQGIGGVLEAQDVAEAIAYAYGQPQRVCIREIVLAATGQAA

SEQ ID NO: 7228 - protein, 285 aa, Chromobacterium substugae
MDIRQLKAFIAVFEERSITLAAQRLFVTQPTLSVTIRQLEEALGAQLFERLPRGVEVSEEARLLYPQARRLVAQAEALARMFRQPHDCLPLTLGVDADVGPGQLEAFLAMAARASPAILLSVEEGCVGDARLAAEDSRCEDELFVPLWEESFVLAVTARHALAERRQVEMSELAGADWVTCPAHASHQRLLDLHGAVAPELALAAQAGSLRLAARMAAAGLGLALLPASLLAGADGLAPIPLAGATLTRRVGLCHAAQAQELPALQALLACLPAQDHSGSGADKP

SEQ ID NO: 7229 - protein, 211 aa, Chromobacterium substugae
MFNFSVFLSALGISFSQIVGIGPQNAYVLRQGIGRSHVVPIILICIVADILLIASGVLGMGKVVAGIPGFVGVVAWGGAAFILWLGFKSFRSAFSAGAMSLEGSVERDRKRAIRTILAVTLLNPYVWLDTVVLIGGVSSVYGEHGALSFLLGSLCASVLWFGAIGLFAGKLAPLFQKPSSWKVLDCVIGLVMLFTAAMLIGNYGLSAPLPL

SEQ ID NO: 7230 - protein, 792 aa, Chromobacterium substugae
MQTDNMALLAGMCRFIGIRTEHLAALSLQADACLARSELLAKELYWHLLKSPQEAEPLQRHYGEAMEALAARLLREWEALLRDPLDEGGARKLAEQGELYCQLGVSLGWLFGLYERCQTHLLASLAALPGAAGQEALSRLLRKRILLDQMLKIHGYQRFLHGEAARRRGHFQTMSSLYATLSGVSLALAESPDRRALLQAVCDVCVREAKFGMAWIGMLDPTRRHVQVAALSNCGMTPLTNAPNVSGDPDNPYGLGPSGRAIRSRVVQVVNHARRDASLQPWQSELRRHGINSLLVAPLLVRGEVVGTLSLYSRETAYFDQAKLALFDVMAREIGRALERLDALERSHRAETELAFLARHDALTGLPNRSQMQELIARLLQARFNDGQVAVMAIAVEGFHDINARLGYDGGDAVLCEMARRLRQAIYPFGYVGRVGASRFIACSERIDQLQSLADAVLQSLPRPVDAMGVAVEMRCSVGAAVSSPGPCDAAALLRRADLALTRAKAQGGGHFRHYDAAMDEEIHKLHALRSAFALAIARGELMLYYQPKINLQNHRIEGAEALVRWTRDGQLIAPGEFFPAIENTDQMRELDWWVLREAVRQACEWRQQGLPMPVSVNLSAATIKHDDFLRTLEALLEANPLPAGFLELEVLESVTQQEAEQITSKLERCRDLGLSIALDDFGTGASSLVHLQQLPFDTIKIDQRFVRLLLEMPGNEAIIRSMVSFAHYTGRKLVVEGVESRAIWSRLLEIGCHDGQGYGISPPLAAAELPAWTRNWLRKGATADINNSYVS

SEQ ID NO: 7231 - protein, 309 aa, Chromobacterium substugae
MLDPRQLQTLAAVAETGGFDKAAKKLFLTQSAVSQRIRQLEEQLGQPVLTRTSPAEPTEAGRQLLQHHQQLMLMENQLLRQLSPAPRQREFTTLAVGVNADSLATWYLQAVAPALEENDLLLDIVVDDQDHTHELMRTGHVIGCVSTRPVPIQSGIQHYLGAMRYRCLATPAFAERHFPDGVSHAALARAPSIIFSRKDAVHGQFLLQAAGYQGHFPCMTVPTAQGFVELTRQGLAYCLLPELMLDDDLASGRLVDLFPGQWLDIPLYWHHWRVESRLSQALTEAMLAYCGRHLRQDKDAAPAAGGECR

SEQ ID NO: 7232 - protein, 145 aa, Chromobacterium substugae
MTSNQQAPSKAQWAELETAARQAASQAYAPYSKFSVGAAILDGAGKIHIGCNVENASYSLGNCAERTAVYSARVNHGMREVVAVCIYTPTATPTPPCGACRQVLNEFGPTMRVRAICDGGDVIDATLDALLPGAFGPKNLQDAAG

SEQ ID NO: 7233 - protein, 281 aa, Chromobacterium substugae
MSRPALLDSQTWLLTAMTAGGALEQGLALARSRCGLGEDLVAEPPRGKRRDRIGVYQHGYWARLLECLRADYPMLLVLLGQPLFDLLARGYIASRPSRSPSLHDLGADFADFLAASQPDPDAAECRLPVELARLERAHAEIGRAEGVEGASPPPFDDWLVLLGAESPLAGMALPDSVRLLKTSLPLLACWHELQRGQRLAVPALAEGRLALARRQWRVSAHELEPWQFELLQAMARLGGGEKALSEAAEQAGVEAAWLRARAAAWLPTAQDLGLVRRREAV

SEQ ID NO: 7234 - protein, 294 aa, Chromobacterium substugae
MTLPRLGLPNLGFGVGLRNVHFQHLAEHGAGVDWFEIISENFIGHRGYARHMLDQLRQQVPIVMHGVSLSIGGSDPLNRGYLEQLRRLADELRPAWLSDHLCWTGVASVNSHDLLPMPLTEESYRHVRDRVLQVQDFLGRPLVLENPSSYLQFSHSTMPEWAFLSRLAEACGCGLLLDVNNVYVSGYNHGFDPEHYIRQLPADHIVQIHLAGPSDCGDCLIDTHDHPVPERVWQLYLLAQRLCGGVSTLLEWDADIPPYPELLAELDKARRLLAEYAPQALPGGKESHEPACLA

SEQ ID NO: 7235 - protein, 677 aa, Chromobacterium substugae
MEIPVLGASLNRITDRSLNELESDKSAARAIIQAAVSVELFTIPLYMTTMYSIQGTHQINSKNLDYYRGRQWPGSAPVSQPRNSNERAFNVIFSVFIQEMLHLQMAANLATAMGVQPDFTPPGLVDQRLGWICYGPQQSMLPHIIDLRDTSTYNKVRVNLEALNENQIELFRAIEQPEGAARAELARQPPPVQAKYFPKVPFAGWKPDMGVQNLPLFGTIGWMYECLAQYVSIEYASGKSLWDYLTSADQPGVTAGANSVQQDLFNAQGGGHPMREFPQLSTLFVPEDFSGKDRSFNKAIDMMAAITDQGEGAQTSLSRYRRGGMLQEVKEPYREDRKALEVDYPSYDGAGKPVPSADAAARCDSAAWTHYERFAELYALLRQVETWEQWHAKGNRWTADMLKNPAYDPAIAPKNIPSPSQVADALNTLKQDPSMFRVLSFVSAGAIAGVTTVLNTYWQKQQTTFPYPSMVGSGDRVSLCWAALGKAPNLALGVGQREAGKLYHACQGMNLDGSSGETCAAIEVYHTCRGSNSCKAEGGCGFVQSDKGGGSCSAMRRAAPNLNAAAGAQCCMPPEPTPPTDAFSAPSDNKCASFGGCAVPISASQLFPSQGTMLLYKFVGPMHASEPLPKTLDFAVGESVYDKAWQAYREVMAASGGKPAGDPPTPTPLRVALPPST

SEQ ID NO: 7236 - protein, 534 aa, Chromobacterium substugae
MLRISELKLPLDHSPEELAAAVAGFLKIAAGDVRGFTVFKRSYDARKGVMSLVYIIDVDAVDEDKLFSRFKGDRRVMPTPDTDYYYAGQAPAELKQRPLVVGFGPCGIFAALILAQMGFKPIVLERGKEVRQRTKDTWGLWRKSELNTESNVQYGEGGAGTFSDGKLYSQIKDPRHLGRKVLTEFVKAGAPEEILYLARPHIGTFRLVSMVENMRAEIIALGGEIRFEQRVDDLILDGDRVRGVKLADGGEIFSDHVVLALGHSARDTFQMLEQRGVYMEAKPFSIGVRIEHPQSLIDAARWGKYAGHPILGAADYKLVHHASNGRAVYSFCMCPGGTVVAATSEEKRVVTNGMSQYSRNERNANSGFVVSISPEVDYPGGPLAGLDFQRELESKAYELGGGDYFAPAQLLGDFMAGKASTKLGEVEPSYKPGVTMTDLARILPDFCVEAMREAIPHFARQIRGYDLNDAVLTGLETRTSSPLRITRGEDLQSLNIKGLFPAGEGAGYAGGILSAGVDGIKIAEAVAQAILAGR

SEQ ID NO: 7237 - protein, 114 aa, Chromobacterium substugae
MAQPAIAIHPRLGYSVLWLHVGRGAACLAPAASPFAAGAVTWPSKPHGSRQCRLDIKLQVIGPLRFCRARRGGNKATSPCARPLPERSRRAGSFAPRRTSWIWTCSPSRWCGWR

SEQ ID NO: 7238 - protein, 106 aa, Chromobacterium substugae
MDLDMLTQPVVRLAIEALQQGNEIIWLEQFVPDATLTDDGLPANFHKFSEHAMGHERFTRIDRVENQGLDIYGAFHSDRWGDFDACFKFRLDANGKICQLDIGQAA

SEQ ID NO: 7239 - protein, 401 aa, Chromobacterium substugae
MHQILIVDDDAVSQQFLLMVLRRLGHDNIAVANDGIDALIQLDAGDRLFDVIFCDLDMPRMDGIEFVRHLGERGYQGKLLISSGFDERVLESVAELARLYDLWLAGLLPKPINHQHLQALLSQPPPSIRRPGNISHPSEDDLRTGIEKGEFRPFFQPQVEMASGVVRSVEVLARWQHPRLGLTSPLQFIELAETSGLITDLTKRLLDDAAQIVAKLPPDPPLHMSINLSMASLSETSLVAEFEAILRNNGFPMSRLTVEVTESGLMANPTRALEVLSRLRLKGAGLSIDDFGTGFASMDRLSRIPFTELKIDKGFVIDALQNPTNMSILRASAELGRQLGLKVVAEGVASFAEWQLCRDLDVEMVQGSYISPPVDAESFRRWLLKHQGSFPLPPAADAGPA

SEQ ID NO: 7240 - protein, 170 aa, Chromobacterium substugae
MRTLRVLLISIPLLFSAAPRAQGEAMLEKPAGKVVLTISGQISNKNHDNDAVFDMSMLGKLPQHTIATHTPWLPGVSRFTGPYLEDVLALVGARGKMLKAIALNDYKTDIPLEDASRFNIVLALLLNGKPMPVRDKGPLFIVYPYDSQPELRSELYYSRSAWQLKTLQVE

SEQ ID NO: 7241 - protein, 732 aa, Chromobacterium substugae
MSVLKRQRLDWRMLIAIGATLICVFIGVAYIQFRQSEMLAGALRDQNDNVTWAYFQLETEGLRLQAALQKAQRRRVDPEELQQRYDIFVSRVGIIRSGLYQSLLQDQPEYRTMQPRLDRFIRQGDALLSRPGALQDPAALERLASQLASLADGLHDMSLSANQAMAERSDLRNRAMEQHIAIGNWLMGFEWALALGFGFTVIRQLRQLEKRRQTLEILTARLEEARKQAEAGSLAKSVFLANMSHEIRTPLNGVLGMLSLLASEAPSPVQAGYIRTAEESAKHLLLLLNDVLDASKLESGKLELAPVTCNLSYLLRQLAKLMSAQAQAKGLMLSLDMATAIPEWVEVDPTRLRQILLNLLSNAVKFTERGGVAIHASCTPGARADQCNLQLIVTDTGVGMSKETLSRLFRRFSQGDSSTARQYGGSGLGLEISQSLAALMGGEISVTSVLGQGSCFQLSLPLKIIQAPQLPEEAASPPLRLDDGSPRRVLVVDDNEVNRKYIQAMLERMNQQPTMAGTGPEALEIARKQPFDLVLMDLHMPGMDGIETSRRLREEALTPRMAIVALTADAFPETRQTTLRQGLDGFLAKPVDGDQLLAALRRHLPPAAPVAALDDAPELDEKTIAGFIELLSPAKYRELATQFFSNHESTLRLLEANRQAPDRDQLFHLAHSLKGGALTLGFSGLARRCQELEQEAQQDVCAPEQIIGQLAAQFRATREACVRQGYLACAAG

SEQ ID NO: 7242 - protein, 71 aa, Chromobacterium substugae
MSRYCIWFVTADDSVMRRAEVAINGVIHCHQVLEEIEAQLALDCGLSQVMIVDWKRFEVPEADGGRLARVA

SEQ ID NO: 7243 - protein, 153 aa, Chromobacterium substugae
MVDANTRVLILGSLPGDASLAASQYYAHPRNQFWRLLGALLGRELHALPYPDKLSALQGAGIGLWDVVAEASRKGSLDADLRDVRRNDLSRLLDSLPGLRAVAFNGATAAKAAPQLAGRKEAWLALPSSSPAHTLAFEAKLAVWRQLDRYLHS

SEQ ID NO: 7244 - protein, 195 aa, Chromobacterium substugae
MPLICGVDEAGRGPLAGAVFAAAVILDPAKPIAGLADSKVLSEAKRDALAAWIKRDALAWCIASASVEEIDKLNILHATMLAMTRAVEGLSTRPDLAQIDGNRVPKHLPVPGEAIVKGDAKVAAISAASILAKTARDAELVALDARHPQYGFARHKGYPTAEHLAAIERHGVLAEHRKTFGPVRSWLASHQGQLF

SEQ ID NO: 7245 - protein, 390 aa, Chromobacterium substugae
MSDHLFKRKGALKVAMVAGEASGDLLAAHLMDALRAHRSDIEFAGIGGPRMEARGFHSMVPQEKLAVRGYSEVIKSLPELLRIRRQLRDRLLAERPDVFIGVDAPDFNLALEGALKKGGIPTVHYVSPSVWAWRPERVQKIGKSVNHVLCLFPMEPPLYRQAGVPVTYVGHPLASEIPLDPDKDAMREQLGVPLQVPVFTLMPGSRKSELEYMVPVYLDTARLLLRQYPDAQFLVPLATRATLDLFEQMLYRYKARDLPIRKLFGHAQMATIASDVVLVTSGTATLEVALTKRPMVISYKLSAFTYRLVKRKIKLPYVGLPNILCGRFVVPELLQGQATPQKLAEEMQRLYTDSAARADMEKAFTELHLALRQDTATRAARAVLEVARCH

SEQ ID NO: 7246 - protein, 258 aa, Chromobacterium substugae
MTIHPTAIVDPKAQIADDVEIGAYSIIGPNVSIGAGSWIGPHVVIEGHTSIGKNNRVFQFCSLGAIPQDLKYAGEPTRLEIGDNNTIREFCTFNTGTVQDGGITRIGSDNWIMAYVHIAHDCQVGNHIILANNATLAGHVHLGDWVFLGGFTSVHQFVIVGEHAMTAFASAVAQDIPAYVTAHGNRAVPSGINAEGMKRRGFTPEQIRRVRSAYKTLYRQGLSYDEAKAAILAEAAEGHVELEAFTRFFGQSARGIIR

SEQ ID NO: 7247 - protein, 150 aa, Chromobacterium substugae
MSEHAVSIDVREIMRCLPHRYPFLLVDRVTELEANVRIKALKNVTINEPFFVGHFEQYPVMPGVLIIEALAQAAGILAIKSQGERSENELYFFVGIDNARFKRQVVPGDQLVFEVTQMTVKRGIGKYAARALVDGQVACEAEIMCARREV

SEQ ID NO: 7248 - protein, 351 aa, Chromobacterium substugae
MFLMSYTLAYIVEQLGGELRGDDLAVVRLAPLERAGSDEIAFVAHAKLRRQMLASGAGALIVTEALAAELQGRSLIVAADPYLYFARLASLFHPQAQPRAGIHPRAVVGEGARIAASSEIAANVTIGDRVVIGERCRLLPGVVVGDDCVIGDDVTLHPNVTVYHGCVIGNRVGVHSGSVIGADGFGLAWDKDHWFKIPQTGRAVLEDDVEIGANTTVDRGAMADTVIRKGAKIDNLVQIAHNVEIGEHTAIAGCVGIAGSAKIGARCTVGGAAMFVGHIEVADRTHIGGGTLVSKSIKEAGNYASSYPLQSMKDWLSNAVHVRHLDDFAKRVKQLERELETLKKSKEEPHE

SEQ ID NO: 7249 - protein, 161 aa, Chromobacterium substugae
MKALKWWLAVLSVAALPVHAADFKLGYINVERIYREAGASIAIYKKLDKEFADRREAMKQMEARAKELETLLGKNSLQQEDRKRYEREYASLDRDYRAKTRELAEDYNQRRNEEFAGVTERANRLVKEIAAREQYDLILQDAVYINPKFDLTPQVLKELDK

SEQ ID NO: 7250 - protein, 760 aa, Chromobacterium substugae
MGLSMASVAMAADPFVIKDIRVEGLQRTEPGTVFNYLPVKVGDTFTDAKAQESIKALFNTGFFNDVRVESRGDTLIVTVAERPVITQLNINGAKEFSKDQLKKALKDNGFAESLIFDQALLDGAVQELKRQYYSRGKYSVEITPSVTKLERNRVSVTLDINEGVTARIKEIRIVGANAFAQSKLLDEFSLTTGGWLSWITKDDQYSKQKLTGDLEKLKAFYQNQGYMEFAIDSSQVSISPDKQEMYLVINVHEGKKFTVSDVRLAGDLKVPEAELRKLVLIKSGDTFDNEKVTESVKAISDRLGVAGYAFANVNVLPDIDHDKQTAAFTFFVDPGRKTYVRRVNVAGNSKTRDEVIRRELRQLEGAPYNAADVKRSKERLELLGYFEDVNVETPAVSDAPDQVDMNISLKERSTGSISGSLGYVQGEGLVLGASISQSNIFGSGKYMSLSMSTGQVNKNYSLSFTDPYFTPDGVSLGYDIYDRVYNPDATSISAYKTSTVGADVRFGVPITEYDRINFTLGAEKTDITTYANSPSQYIDFVNKYGNSNYTVLGTVGWARDTRDSALWPTRGASIKVNADAGLPGGSMQYYRLTHQQTWFFPLSKDFTLMLNGELGYADGYGKTKQLPFFQNFYMGGLGSVRGYDTSSIGPVDGSGNFIGGNRKVVANAEILFPFPGMKDNKSLRTSLFFDAGTLWNTSWTPGPNDPQTASNASNGLRYSAGLALTWLSPMGPMKFSIANPLKKEPNDKIQRFQFQLGASF

SEQ ID NO: 7251 - protein, 447 aa, Chromobacterium substugae
MLTLLAFLLAIGLLVTFHELGHYWVAKLCGVKVLRFSLGFGSPLLRFRPRETEWVVCPIPLGGYVKMLDEREGFVAPSERGRAFNNQHVLKRMAIVAAGPAANLLLAVLLYWGVIAQGVPQLKPLIGTVIGQTPAAAAGFQEGERILSVAGQRVSSWQDVRLALVDAAMSGGAVPVVVQNASGASRERRIDAQRFGDKAAQALQQGDPGLSPARFLPVLGALEENSVAARAGLKTGDKLLAVNGVMLRSWEEWVQIVRNSPGKDLALRIERKGQDMEVKLRPMAVTQDDEVVGRIGVGPMPDRAWNDKLGFTLHYDAMGALLAAATKTGDTAWMSVKFLGNMLIGHASLDNLSGPLTIANVAGQTAREGLTPYLEFLALISVSIGILNLLPIPVLDGGHLMYYVAELVRGKPVSERVQLLGQKIGFILLASLMAFAILNDFSRLFGG

SEQ ID NO: 7252 - protein, 394 aa, Chromobacterium substugae
MTKPQGIAVLGATGSVGCSTLDVIARHPERYRVVALSGHRQLDKLFEQASRFRPDYLVVADADAAAQLALRLEQAGLPGEVLHGPQALEEIVRLPEVDAVMAAIVGAAGLPSALAAAGAGKRILLANKESLVVAGRLFMDAVRRSGAGLLPVDSEHSAIFQSLPADYAGQPALAGIRKIILTASGGPFRGKSAAELLDVTPADACRHPNWSMGRKISVDSASLMNKGLEVIEAHWLFGVPPEQIEVVVHPQSVIHSMVQYRDGSVIAQLGSPDMRTPIACALAWPERIDAGVEPLDFFSLSSLSFEKPDLANFPCLRLAFDALAMGGDAPAVLNAANEVAVDAFLNGRLRFVDIPKVVSETLSGVDLAASASLDALLARDEDARRFARGRVAAC

SEQ ID NO: 7253 - protein, 268 aa, Chromobacterium substugae
MLKTRILTALALLPLMLAALFFFPAPIWAGFSWLIVGLALWEYSRMAGMGRPQQACYLVLSSLLAAVCWAMGWKAGPLLHGVVLAFWLALMPCWLARRWTIPGGAPAWLLGWVLMLPAWFAFLEWRPQPSRHDALALLAVMGLVWVADIAAYFSGKAFGKRKLAPAISPGKSWEGVYGAVICVAVYVALVDHFGWLDIKLPLWGLLLLALPLTAVSVCGDLLESWFKRAAGVKDSSRLLPGHGGVYDRIDSLIAVLAVSNALRALGGM

SEQ ID NO: 7254 - protein, 243 aa, Chromobacterium substugae
MPEGRQPPRHVAIIMDGNGRWAKKRFLPRVAGHKRGLDAVREVVGACKEMGVGYLTLFAFSTENWRRPQEEVTFLMDLFLRALEHEVSKLHSNNIRLQVLGSRERFSAELSERIARAEAKTADNDGLVLTIAADYGGRWDIVNAVNQLVAEGVAPITEEALTKRLAMSWAPEPDLFIRTGGEQRISNFLLWQLAYSELYFTDLLWPDFDRAALEQAISSYWQRERRFGRTSEQLPEHLRRDTP

SEQ ID NO: 7255 - protein, 200 aa, Chromobacterium substugae
MAVFALSFEVLMGVDMINDVKKSAEQKMQKTLESFKNDLSKVRTGRAHTGILDHVMVDYYGSDVPVNQVANVTLIDARTIGVQAWEKPMVAKIEKAIRDSDLGLNPASMGEIIRVPMPMLTEERRKDLIKVVRAEAEGARVAVRNVRRDSNTEFKNLLKDKSITEDDERRGQDEIQKLTDKYTAEIDKALAAKEADLLAV

SEQ ID NO: 7256 - protein, 255 aa, Chromobacterium substugae
MPFCKLKTTNRQSEDIMSQVPAYKRILLKLSGEALMGDDSYGINRTTIEQIVGQVKEVVELGIEVGIVIGGGNIFRGVAPAAAGMDRATADYMGMMATVMNALALKDAMTKVGLIARVQSALTMQQIAEPYVRGKAMQYLEEGKVVIFAAGTGNPFFTTDTAAALRGMEMNVDIMLKATKVDGVYTDDPKKNPDAVRYQSVTFDEAISRNLKVMDATAFALCRDQHLNIKVFSIFKNGALKRVVLGEDEGTLVHC

SEQ ID NO: 7257 - protein, 281 aa, Chromobacterium substugae
MVSDLRVATGLGMMECKKALVEADGDAAKAEEILRIKSGTKASKMAGRLAAEGIIGSHVEGGVGALVEVNCETDFVAKDPTFLALAAAAAKAAVIANPADVEALSAVEIDGVSVEEIRKAAIAKLGENMTIRRFVRYSTEGAIATYLHGAKIGVIVDYAGAESVGKDVAMHIAASKPICVSKDQVSAETLEQERKIYTAQAAESGKPADIVAKMVEGRINKFLAEVTLLGQPFVKNPDLTVEKLLAEQKASVKAFAMFVVGEGIEKKVVDYAAEVAAAAKL

SEQ ID NO: 7258 - protein, 243 aa, Chromobacterium substugae
MSTNVTMRQMLEAGVHFGHQTRFWNPKMAKYIFGSRNKIHIINLEKTLPLFVESQEYVRRLAANKGTVMFVGTKRQAREIVREEAARCGMPFVDHRWLGGMLTNYKTVKQSIKRLEEKRAILEGSGDTGYNKKELLDLQREVDKLERSLGGIKDMKGLPDAIFVIDTGYQKGTIVEAKKLGIPVIGVVDTNNSPDGIDYVIPGNDDSSRAIRLYARGIADAVLEGRAHSLQEIVAAAEPAQAE

SEQ ID NO: 7259 - protein, 63 aa, Chromobacterium substugae
MTLIIVLMGWLYVVLMLALTQGSVAGGLAVAFFLGVLPTWFVAWATRNKLRRRRAAEKDAGKA

SEQ ID NO: 7260 - protein, 343 aa, Chromobacterium substugae
MQTAITRLFDIRHPLICPGMSYIATPELVAAVGNAGGLGILASGPLSADATRAAIRRIRELSDRPFGIGATLMMPGAADNARVALEEQVPVINYSLGKGDWIAEAAHRYGGKVVATVTTEKHAVSAEKSGADALLVTGHEAAAHGGSATSLVLIPAIRKASRLPIIAAGGFADGSSLVAALALGADAAAMGSRLAMTRESPVHAKTKDMIRERGVADTLYSKNFDGLWCRMMDTPNARAACRKPLGLLPAAFRASRMARRMGMPVLKVALGGMISQPQALRQLALFGAATESIRLAIQDGDHDKGVQLIGQAQGLIDDVPTVAELFERIMQEAQACRQRLAGY

SEQ ID NO: 7261 - protein, 399 aa, Chromobacterium substugae
MAWTKEQRQTVFACYLGWTLDAFDFFLMVFVLKDIAREFGTDVEAVSWATMLTLAARPIGALIFGRLADRYGRRPVLMANIVMYSVLGFASAFSPNLMVLLILRTLFGVAMGGEWGVGSSLTMESIPRESRGFVSGLLQAGYPSGYLLATLAFGQLFEHIGWRGMFMLSLLPALLTLYIRRNVPESPSWEAARGQEKPGLLQAIAAQWRLSLYAIVLMTCFNFFSHGTQDMYPTFLRVQHKFDPHTVQTIAICLNVGAIVGGLAIGGLSERIGRRNAITLAALFALPVLPLWAFSSTPLMLAAGAFLMQIAVQGAWGVIPAHLNEISPTAVRATFPGLVYQLGNLLASVNSPMQAHMAKMNGGDYGLAMATVAGIVAIAIAVLIRFSRERRGEDMRVSG

SEQ ID NO: 7262 - protein, 257 aa, Chromobacterium substugae
MRCLAWIACGLCLAGAAARAWALDEVVLANGEWAPYQSAKLPHQGFASHVVSEAFRLAGIQVIYRFYPWARAEAMVRGGGVAGSLVWSETPQRRAFAWFSDPVIVDDEVVFHLATRKMKTERIEDFYGLTMATFNGSRLGAWQEAIDAGRIRSYVVKDIEAGMRQLLIGRLDFIPLIRSVGFSVLRQHFTPREQAAIVAEPHVFVRAEYGVMFSRKQPGGEALLRRFNAGLAKLKASAEYRQMARDFAAGKYDPQPY

SEQ ID NO: 7263 - protein, 161 aa, Chromobacterium substugae
MNYDRYYTCDLVNGEGVRVTLFVTGCAHACEGCHNRSTWDRKSGRPFTAQVREALLAHCAGHDGLSLSGGDPLLPANRDEILSLCRAFKQRYPGKSIWLWTGYDYEEVRELEILRFVDVLIDGRYRRDLPTSKPWRGSDNQRLFRLAPARGRPLLPVTQLT

SEQ ID NO: 7264 - protein, 711 aa, Chromobacterium substugae
MQVSKRDGAVTQFDIGKIANACQRAAAAAGHAAPAALALAIAAAVERRCRERSAQGRISIAAIQRLVEDELMREYPEVARVYIQYRHDRDSVRARGSELHAKLMGLVHRTDEEAATENANKDANVFPVMRDLMAGIVSKQFAGNFLPKDILAAHNSGDIHFHDLDYSPFLPFTNCCLVDLKGMLEQGFRLGNAQIESPRSIGVACAVTAQIIAQVASHQYGGTTIPNIDQVLAPYVLKSYRKNLEVAREYGITEPERYARERAEKETYDGIQACEYEINTLFSSNGQQPFVTFSFGMGLGWEARIIQQSILRVRIKGLGKEGVTPVFPKLVMFIDQGVNLRPADPNYDIKQLALECASKRMYPDIISAELSRRITGSSVPVSPMGCRSFLPAWRDEAGREVLDGRNNLGVVSLNLPRIAIEARGDAQAFWALLEGRLGLCLRALMLRIERLRGVKANVAPILYTEGAFGARLKPDQDIMALFQGGRASISLGYIGLHEVGVLLFGAHPADSEPAQVFLRRVVARLSEAAAQWKRETGFGFSLYSTPSESLCNRFCKLDRERFGDIAEVTDKGYYTNSFHLDVFRKVNPFEKIDFETGYAELASGGHISYVELPNMKHNLQALERIWDYALERVPYFGSNTPVDSCGACGFMGEALAAADGFSCPQCGNRDSASLSVTRRVCGYLGSPNARPFNAGKQKEMMRRVKHFGGEH

SEQ ID NO: 7265 - protein, 184 aa, Chromobacterium substugae
MHSPLPALLLTLPLASYAHAAEQVQGQGGRILHYSSTQTRSDLDHEEQNRYRNHRDHQFNGASLAAVLQAAQSALHQHGYGQIEAEPDYHVIRALRHEQLVSRGRQVLRGILKLKLPMPGKPDHQSTELLLMLRPGSQPQQVLARARLETTVWDSNGNSHTKLDSDPDDYRQLYGHIDAALRGR

SEQ ID NO: 7266 - protein, 605 aa, Chromobacterium substugae
MTRQIRNIAIIAHVDHGKTTLVDQLLRQSGTFRENQQVDERVMDSNDLEKERGITILAKNTAIEYEGVHINIVDTPGHADFGGEVERVLGMVDGVLLLVDAVEGPMPQTRFVTKKALALGLRPIVVINKVDRPGARPDWVVDQTFDLFDKLGATDEQLDFPIIYASGLNGFAKLELEETSDNMRPLFETVLKHVPTPPGDADAPLQLQISALDYSTYTGRLGVGRVLNGRIKPGQQVVVMNHEEQVASGRINQVLGYQGLDRVPVEGAEAGDIIIISGLDDIGIGVTICDKEQPVGLPVLGVDEPTLTMDFMVNTSPLAGTEGKFVTSRQIRDRLTKELLTNVALRVEDTEDSDIFRVSGRGELHLTILLENMRREGFEMAVAKPRVVYKEIDGQKCEPYENLSIDLEDDHQGGVMEEIGRRRGELTNMESDGMGRTRLEYHIPARGLIGFQSDFMTMTRGTGLMSHVFDDYAPVKPDMPGRHNGVLISQENGEAVAYALWKLEDRGRMFVSPGEKLYEGMIIGIHSRDNDLVVNPVKGKQLTNVRASGTDEAVRLTTPIKLTLESAVEFIDDDELVEITPKSIRIRKRYLQENERRRMSKAESN

SEQ ID NO: 7267 - protein, 290 aa, Chromobacterium substugae
MYDWNALWHEREAYRTGYDIHHGDANMLAEPLKAKLIHAAETPDQVAVYEDAHRYILAGHADGLQLLEVFKHGLFDITLRFVGEDEGQDAAVPYIELHVDNLATEEQAVWRGEAQLDEEGRVWIGKRTLDEDVLPAMPFDELSFTDQAVFRDELARVWHEDLPQLRPLIEAWFRHDELAAPQDEPAHYGDQERVMQICDRYAEIVRREQAALSRLFSDDELRLMAGVIGSVHFDSAASCRGVWLAVEARIIEDELDQQFQLDGEALLAKMKGLSYAQEVALIEALSPLKS

SEQ ID NO: 7268 - protein, 57 aa, Chromobacterium substugae
MRQVSQGNRLSHIAFSMVGFRRRSAPCLEAFGPAARRARWRPRRDIRFSVIARNPAA

SEQ ID NO: 7269 - protein, 438 aa, Chromobacterium substugae
MAQPIALRNLPQSNIFRPGDVFVLFGELFGRGYANGLVNQARQAGMEIIGITVGRRDDDNRLRPLNDEELAAAEANLGGKIINVPLMAGFELDAPAGEATPTELLGGLTLKGWQDDKLDWAHIEKCRQVGVKRFQDGVAEVMAKLDGMIADGRNVFFAHTMAGGIPKVKVFLAIANRIYKGRGDRFLSSQALLDSDLGKLILQNFDEVTANTFQHLIAGSAALRRRLEASGGQVRYTAYGYHGTEILIDGRYQWQTYTNYTQGYAKMRLEKVAQAAWEQGVKATVFNCPEIRTNSSDIFVGVELPLFALLRALKKEAPGAWTDSQWRDCASLLKDGHALETLLEKIDALNDGAVMQGFRRFDAWPMPNSPELAEVMIGTSDELTDMHLDRKALITDRLSALVIEAAGPLMFGEASQPSGPVLWLNHDIIASQLKQLHG

SEQ ID NO: 7270 - protein, 331 aa, Chromobacterium substugae
MKMQAVVQQGPGGAETMELAEWDRPQLAPGKLLVRVMAAGVNRADMMQREGRYAPPPGASPLLGLEVAGWVEEAAEGSAFQPGDAVFGLVEGGGYAEYALLDEALAIAKPDALSWVEAASLPEAWMTAWFNLAEKAGVAAGDNVLVHAGASGVGVAAIQVAGLLGARAFASAGSAEKLAFCRELGAAQVFNYRETPAFSELVKSWGGADAVLDPVGAAYLAENLQALNPDGRLVNIGLMGGLKAELDFGRLLMKRISLIGSTLRPQPPAAKARLAAALRERILPGILDGRLRTVVDCSFPWTQVRDAHRYVEENRNLGKVVLTMFSTQAAG

SEQ ID NO: 7271 - protein, 38 aa, Chromobacterium substugae
MRPAAAYLKSMREIFEYGDICHELDQAMATGFDYNAPS

SEQ ID NO: 7272 - protein, 811 aa, Chromobacterium substugae
MSENCFHCGLPVPPGADFPIRYRQRDEAACCAGCQAVAATIINSGLSDYYQHRTEGAARAEALPQNLLEQIRLYDSDELQRGFVHIDRDQVREAALMLEGITCAACIWLNEQHLRRLPGVVGVDINYSTQRARVRWDNSRVKLSAILEAVAAIGYRAHPYDAERQEKLQQKERKQALSRLWVAGLSMMQVMMYAVPVYLAPDGDIAPDLLWLLHWASFILTLPVLLYSALPFYRATWRDLKSGRVGMDTPVTIGILTAFCASFWALIHKFEHGIYFDSVSMFVFLLLGGRYLESIARRKAGAASESLVKLVPAFAHRLDNWPASRDSHEATVASLRRGDVILVRPGETIPADGVVLDGQSASDEALLTGESRPIPKTAGDAVIAGSVNTSSPLLLRVEESGESTRLAGIVRLLDRALAEKPRLAVLADRFASWFVALLLLAAAASYLAWHFLDPGRALWIMVAVLVISCPCALSLATPAALTAAGGSLASLGVLATRGHALETLAKVTDVVFDKTGTLTHGSMKLLDVAIEGSLAPEQALALAAALEHGSEHPLAQALRQAAEGLAAPRVESPLNHPGHGVAGVMAGREWRLGSAPFIAAWLRQPQQDVADWHAGSTQVLLANSDGVQARFAIGDAVRADAAELVARLRRRGLAVHLLSGDGEQAVCALARELGLERARARATPEDKLAYVGALQDAGRRVLMVGDGVNDAPVLARADVSIAMGGGTDVARTSGDMVLIADQLGLIDASLDISRRTLTVIRQNLCWAAGYNLVALPLAVTGHVTPWLASLGMALSSLLVAGNALRLVKRKN

SEQ ID NO: 7273 - protein, 55 aa, Chromobacterium substugae
MESLYLLIPLSLVLAFVIGAIFWWATRSGQFDDMEGPAHRILMDDDTPRREDDQQ

SEQ ID NO: 7274 - protein, 41 aa, Chromobacterium substugae
MDGIHGCPSGVKQRQGRDGRSGAPGGAAVAGKLFAKKRAII

SEQ ID NO: 7275 - protein, 424 aa, Chromobacterium substugae
MLLLVGVAYAFSTRRDAVNWRTVLIGLAIQSGLFLLINYIPAIHHGFAAFGAGFAKVLSFAGEGAGFVFGDLAKPGGKLGFLFAFTVLPVIIFFSAFSALLYHFGILQRVVAALAWAMKRSMRISGPESVVAAANIFLGQTEAPLLVRPYIRHMTRSELACIMIAGMSTLSGGVLAAYVAFLGGPDAAEQARFATYLLTASCMNAAGAVVFCKIMFPETAPGELSSTKLQASKEKSGGNFVSAVVTGALDGMKMAAAVATILLAIVALIALANFLVKDGLGQMLGVNAAIQASTHGMFDGLTLQYLAGQAFRVFAFLMGIGWDETLGVGSLLGQKIVLNEFIAYLDLAKMKAAGTLSAPTVMISTFALASFSNLSSVGICVAGIGALAPERQQELAQIGMRALLASILTGFMTASSAGLWLSLF

SEQ ID NO: 7276 - protein, 438 aa, Chromobacterium substugae
MKADFSFFATRRFLPLFGTQFLGAFNDNMLKTAIVVLISFHGLTLAGLPPEMLVNLAAGIFILPFFLFSASAGKLSERYDKARIARLIKLAEIAIMLLAGAGFLWQSAGLLLSALFLMGTHSAFFGPMKYSVLPQYLREDELVGGTGLIEMGTFLAILLGQLLGSVLTHNGSLLIIAALLVTAVLGYFSSTAMPAVAPGAPHLKLSWNFLGDSVQLVGKAWRIHDVRCSILGISWFWLMGAVYTTQLPTFTRMHLGGDADVYTLLLALFSIGIGIGSVICAKLSHGKLQLGIVLLGSAGMTVFGGDLALGAMPHYHGPLATLAEFMARASSWRSIADVALLGFFGGFFTVPLYTWLQTGSPDEFRSQAVAANNIINGFYMVAAAIGSVLMLKWFDSISMLLLAVAALNILATAHLAWCAPDIWRQRFSWIAPLFAGKA

SEQ ID NO: 7277 - protein, 763 aa, Chromobacterium substugae
MSQGWPAKSAALAGVLWRWPRARAGAARCRRMVARREVQGLILLAPLLLTVILSRHFDRAERAATESNFRHDAGAAAEQLASAIQQDVDALDSLALFMGNAPNIRQDDFYRFARPLVASRPLFQGIGWAPLVPQAGRPAYEAKYGKVREKRADGRIVAAGIRPEYYPVTYIAPKEDNPKVWGFDLWSEPRRREAIRRALASGQARISEPLILAQFNDDSGKGVSMIIPVPGVRGGVVVGGINAARLAARALPALAEKGISLQLDDVGGGGTVSLVAPTQRASPGSPWLSRKLAIGGRVWKVTLRALPRYLEASGSHAALLVLPAGMGFTLLLGIYLNLLHRRREVAEELASRSARALRQGEERFRMFASIASDWLWELDAEGRLSYCSEHFSELTGVPLGKLLGRHWREWRPVRANRDQAERLSRLFAGRQEVRDFELSYRRRAEERWIAINACPLLSADGELCGYRGVGRDITERKRSEQELYGHRNHLQELVAQRTADLLQAKEEAERANQAKSEFLANMSHELRTPLHGILSFAEIGGDKVGQAPPERIKRYFDNIHASGARLLVLLNDLLDLAKLESGRMALHREDVDLCELVRLMTQAEEGRMAEAGIGLKLELPPLPLLAWVDRKSMQQILANLLSNAIKFSPHGGRIRIGLQHFGSIVTLSVADQGPGVPEAELERIFDKFVQSSATANGSGGTGLGLAICRQIALAHAGSIYAENLPAGGICFFVSLPDAENSKTMERLSLLLGEKEAAAHGAGE

SEQ ID NO: 7278 - protein, 467 aa, Chromobacterium substugae
MKTIHIDVAVIGAGTAGLAAYRAAKAGGASAIVIEGGPYGTTCARVGCMPSKLLIAAAEAAHHASHADMFGVHVDGEVRIDGREVMARVKSERDRFVGFVVRSVDGIPTEDKLRGYARFIDNTTLQVDEHTLVQAKRVVIATGSSPVIPPPFQAFGDRLIINDDVFDWEDLPQSVAVFGPGVIGLELGQALSRLGVKVKVFGARGGVGPLSDPAVRDYARQALGNEFYLDPDAKVLEMANDGDAARIRYVSLDGAEVEERFDYVLAATGRAPNVRGLGLENTSVLLDARGVPMFDPETLLCVGAPVFIAGDANDILPLLHEAADEGATAGGNAASYPQLTAGLRRSPIAVVFSDPQMMMVGRRFADLADEGFVAGEVSFEDQGRSRVMGINKGLLHVYADKETGRFLGAEMIGPRAENLAHLLAWSHQQQLTVAQMLQMPFYHPVIEEGLRTALRDAKAKLDAIALA

SEQ ID NO: 7279 - protein, 300 aa, Chromobacterium substugae
MPDAGILTSRAAGCPARGGVIEKDNQKSCNNQLDLFGAGYQNAFIDSKQPTPHKELTMLQNREGQRVPNVTFRIRENNEWKNVSTAELFDGKTIALFSLPGAFTPTCSSTHLPRFNELAPAFYANGVDAILCVSVNDTFVMNEWAKDQEAANIVMIPDGNGDFTEGMGMLVDKADLGFGKRSWRYAMLVKDGVVQKMFIEPQEPGDPFKVSDADTMLNYINPNAKKPDQVVVFTKVGCPHCARAKAVLAENGYDFVEVPLDNKIRGKALGAVSGKMTAPQVFINGELIGSADEVEKRFAK

SEQ ID NO: 7280 - protein, 135 aa, Chromobacterium substugae
MHISGLHHLAIIASDYARSRDFYHRVLALPIVAENWRADRQSWKLDLALPDGSQIELFSFPQTPARPTRPEACGLRHLAFACPDIDAARAHLLAQGVEAEAIRLDEYTGSRFFFCADPDRLPIEFYQAAHADRPT

SEQ ID NO: 7281 - protein, 43 aa, Chromobacterium substugae
MRGGRGAEGDQQACQEGRRVRDIHKHSVFGWIAAGAALAPAVR

SEQ ID NO: 7282 - protein, 617 aa, Chromobacterium substugae
MLVALGTAASAHAGADDTLLAARDAFRANELGRLASLGGSLPDSYPLKDYPSYWLAWKALEKNDDAQVTRFLEQVPEGLMPERIRNEWVKKLGMRENWTAFAAEWKKLPEEGRDEESSCYGQLMGLYQGQKPDNLDRFLEGKPVPDGCNRLIEGAYARGLINQDWLWRRARLLLAGNFVSQARQLAADTQLPLDNAALNKPANANLSTPGGQEAALLEIERKAKTDLDGAAASLSRLEGNIDADRSGFGWGQLALLSARKQLSAQALQWFDKADPRQLTADQWEWWARSALRLEQWTQLDGIIRRMPAAVAARPAWRYWLGRSLQQQGKPALAAPLFSQASVGHNYYALLSLEELGNSLSASTNKTMPSADDVARMKQDPAIRRSLALLSVAEIYTKPEFRTDAQREWRWAMRGRNDMELLAAAEIARKEGFYDMAIYSAERTKEEHDFSLRYLTPYRDITQKYARQLDIDDAWVYGLIRQESRFITMARSGVGASGLMQLMPATAKWAAKKIGLTHFAVNDIDTNVQLGTWYLRYVLDNLSGNQVMATAAYNAGPSRARNWQTNRALDGTIYAETIPFSETRDYVQKVMASAAYYSSTFGHANISLKNRMGMIPPR

SEQ ID NO: 7283 - protein, 319 aa, Chromobacterium substugae
MNQTIAPLPQKICLIGGSGFIGRHLAARLAGDGHRITVASRKTALPEFLVLPSARLVNADIHDPAQLEALISGHDAVVSMVGILHGSRAQFEKNHARLPEAIVEACRRQRVPRLVHVSALGAAQDAPSDYLQTKALGELAVEGSGLDWTILRPSVVFGRDDAFLNLFAALQKRLPLLPLAGAASKMAPVWVEDVARAVCASLGRPQTLRRKLDLAGPEIYTLAELARLAGRCSGHSRPVIGLPDSLAMLQAGLMERLPGPTLMSRDNVRSLRWDNISEHPFPSGPLGFAPTPLSALAPAWLSGRDGNHIVSRYREKAAR

SEQ ID NO: 7284 - protein, 407 aa, Chromobacterium substugae
MDIYIVGGAVRDRLLGLPVKDRDWVVVGATPQQMLDQGFRPVGKDFPVFLHPQTQEEYALARTERKIAKGYHGFVFHTDSGVTLEQDLARRDLTINAIAEAGDGSLIDPYDGQADLKAGILRHVSDAFAEDPVRILRLARFAARFDFAVAPETMALMRQMVDSGEADALVAERVWQELAKGLMEDKPSRMLLTLRECGALARVLPEVDALFGVPQRADYHPEIDCGDHTMRVLDYAAAAGYPLAVRFAALGHDLGKALTPPEVLPRHIGHEINGTRPLAELCRRLRVPSDCRDLAHITMVNHTKVHQAQELRPATVLRLFKDSDALRRPDRFRQMLDACLADARGRLHFETAAYPQKDYLERLLAATLQIDAGAIAAGCSDKAAIPATLDAARTAVIADCKEQWEDR

SEQ ID NO: 7285 - protein, 370 aa, Chromobacterium substugae
MDALYRLPAMLMRGGTSKGLFIRADSLPEDTEQWEAMLLRALGSPDPYGLQMDGLGTGLASSSKVMILSPSRRDDCDIDCLFGHASIADARIDWSGNCGNLSAAAPLFAMLENMARPADGVATIAIWQANVGKRILAELEVFDGQPVWQGDFFIDGVSFPGAPIRLRFLDPCGVSSGELFPSGRLMDELKLPDGSHIEATLVDAGNPTVFVRARDFGLSGREPAGPMPLATLRRLELARATAAVAMGLAEDIFAAERERPAFPRISFLSAAADAECQLNARLLSMDRVHHAYSGTGAIALACACAVDGTLPAELAGGAVRGMPLTFSHASGKQTLEAVLGRAELGWSVSEVVMTRTARPLMRGEVYIPPA

SEQ ID NO: 7286 - protein, 225 aa, Chromobacterium substugae
MSSALHFTIDSLISWPPAPDVDGQTSHPPLEPVPAMQRRRMSPLCKAAMHGAFGLGDGGDDIPLVFASRFGDMSRSIELLQQLSQGESLSPTQFSLSVHNAIGALHGILSGHAGQYTAIAAAEETVEAACCEALAMLVDGAPAVRLVVYDAPLPAPYQDAAPAQPPLIAWACRLRLADSGPRFSLESAPASGDADSQGLWPFLNSAARQHTHHCGQRDWHWARHG

SEQ ID NO: 7287 - protein, 249 aa, Chromobacterium substugae
MATAIAFSVFGLGGVLFSLIVFPLLMLLVRRPARRIALSRRVVQISFAAFIQLMRALGILRYRIVGAEKLRRPGLLILANHPTLIDVVFLISLLPNADCIVKSSLARNPFTRGPVRASGYICNDSSEGLIEDCIHSVHDGNNLVIFPEGTRTPLDGRFTLQRGAANIAVRGRRAITPVSIRCEPRSLAKGVPWWRIPPRPMHFTIEVLDDLPVAPFLEGQSEAMAARKLTRFLHDFYLTTSSLHANPGT

SEQ ID NO: 7288 - protein, 86 aa, Chromobacterium substugae
MQTLELEIKNLLITSLNLEDITPDDIVADAPLFGDGLGLDSIDALELGLALQKRYGITLSPDGEETRRHFASIASLAGFVASARKL

SEQ ID NO: 7289 - protein, 83 aa, Chromobacterium substugae
MTKDELFARLSAVLQDTFEIEADAIHPEARLREDLDIDSIDAVDLIVQFRPLVGKRLQPDVFKSVRTLQDVVDALHGLMQEND

SEQ ID NO: 7290 - protein, 182 aa, Chromobacterium substugae
MPATALASLLTLSYPFLIYFGQGRVEPRLLAGVLVGIALLRALSTRQAVWYWAAAATLLLAAFSMLGNGLLPLKLYPLLVNAVLLAMFAGSLRFGPPLIERLARLTEPELDARAIRYTRAVTQVWCGFFIVNGSLSLATALWADNAVWTAYNGCISYLLMGALFGGEWLVRQRVKSRNTTHG

SEQ ID NO: 7291 - protein, 555 aa, Chromobacterium substugae
MADFIPLSRLLAVGRGAGHPVARDGQRHYSFADFRQRAARWRAGLLRTRQHVVAIHLDDSFEFAAALFGAWHAGKTVCLPADDLPATRAALAERGMLLDAQPADADDYADFGELSEDGCRLQLFTSGSTGEPQAIDKGLRQLAAETAILSRLWDDALPAGCLVEATVSHQHIYGLLFRVLWPLAVGRPFACRRQTFPENLLQALANEPCLLVSSPAHLKRLPASLDWTSAAGKLAAAFSSGGPLDDAALANSLATLGQAPCEIFGSTETGGIAWRRRQTDAAQPWQPLPGVQVRLDDGLLAIRSPHLDDDGWHQTRDKAAPQGEGFVLLGRADRIIKLEEKRVSLDSVEAALLASGLFDAVRLVLLPGSRDTLGVAAVPNAAGWERLAALGRREFAARLITELKRSVIPEGLPRRWRYGFRLPVNAQGKTTQAQLLSWFEARRPHITLLRRDAGYALLSIEAAAALPDFAGHFPGFPLLPGVTQLDWSVRLARELFDLTGFSGMDNLKFQRIIAPDSTVRLELRYDSDKRSVSFAYDSDGEPHASGKLRFGAPAC

SEQ ID NO: 7292 - protein, 244 aa, Chromobacterium substugae
MLICAVVPVYNHGGAVGSVVASLRAQALPCVLVDDGSDADCAAVLDALAAADEHVRLVRLPENRGKGGAMIAGLRAARELGYSHALQIDADGQHDSRDIPRFLELARAQPQALICGCPLYDENAPKSRRYGRYATHVWVWINTLSLQIADAMCGFRVYPLAATVPLFDQARLGLRMDFDVEVLVRLSWRGMRIVNLPTRVSYPLDGVSHFQLWRDNLRISRMHAKLFFGMLPRLPLLLARKAAR

SEQ ID NO: 7293 - protein, 310 aa, Chromobacterium substugae
MKPARHWAGIGENTFVAGIVLLFWVHRLLGRRLFRLCLLPVVACYWLACAPARAASLQYLRRLERHCGTLGRQPGARDTFRHLLRFADTMLDKLLATAGHYPADRVAISGADVIIDGLRQRRGVLIVTAHLGCLELCRALADRSPDVVVNVLVHTRHAQRFNALLDRLNPQQSVRLLEVTEVNAATAVLLEQRIAAGEVVAIAGDRVPVSGDRTVSVPFLGEPAPFPCGPYLLAHLLRCPLYLMACLRQGAGYHLQFVPLAESIRLPRQNREAAIGEYAARFSGELARLLAASPYDWFNFFPFWDQKSKS

SEQ ID NO: 7294 - protein, 513 aa, Chromobacterium substugae
MTPKHQDSVIFDGSWLSLDDIHAIAIGAKQARLSDDPAFCERIEKGSRFIDQLLAEDGVVYGVTTGYGDSCTVEIPPALVQELPHHLYTYHGCGAGRFLDAVETRAVLATRLASLCRGVSGVSLALLRQLAALLKHDILPLIPAEGSVGASGDLTPLSYVAAALCGEREVTHRGERCAAADALKAAGLAPLRLRPKEGLAIMNGTAVMTALACLAWPRADYASRLCSRLTAMNVAAAAGNAHHFDEALFAVKPHPGQQRIAARIRADLEAPRPSRNDSRLQDRYSLRCAPHVIGVLEDALPFLRGLIENELNSANDNPIIDADEERVLHGGHFYGGHIAFAMDSLKNAVANLADLMDRQMALLVDTRYNNGLPRNLSGASPERAPINHGLKALQISVSAWTAEALKQTMPASVFSRSTECHNQDKVSMGTIAARDALRVLELTEQVLAALLITARQGVELRGEIAELSLSPALERMQRDLAARIPRIAEDRALDRELQQLLAAIRAQAWSLYA

SEQ ID NO: 7295 - protein, 138 aa, Chromobacterium substugae
MPDLSHAIALDPAFHDLDPMDVVWHGNYVKYLEIARCALLEKYGYNYPQMRDSGYIWPIVDMRLKYVQSIRFGQKVSIEARIVEWECRLKIEYLIRDAATGHKINKAYTVQVAVDIASQEMLYLCPPVLWEKLGVPAP

SEQ ID NO: 7296 - protein, 201 aa, Chromobacterium substugae
MKKLVLLAGLALLPLTAAAGDLIADITRKLAQPAVLRGAFEQSKEIAGFAKPLRSSGAFLVSREKGVLWDTRQPFASKLRLTRGEIVATQNGSVSFQLSAAKEPTVRTINELMFALLGGNLKALDGYFRIDGKLSGRAWQLTLTPRQSALARVMQKVELSGDQYVRAIRMDEANGDVTRIVFSGQNPMPAKLSGEEEARFD

SEQ ID NO: 7297 - protein, 777 aa, Chromobacterium substugae
MTEHLGSSRPQRWLAAVWLAILLAVAGHNGWLWLGGHARLETDILAMLPQNRQDQAAQDATRQLADAAARRVVVLVGARDWADARRAGDAYAAAIRASGQPLAPRYRVGAQESDNWLDFYAAYRGQLLGDDTRRQLRQTAPAALAEQAAAALFQPVGMPRLGRWQDDPLNVYGQWLGERAAQSRVRVRDERLSLSGADMQYALIMLEQQGPAFSVAAQQAMLPALRQAEAAARQAVPHAQIIQGGVPLFAAFAASAAEREVHTIGLGSLLGILLLTVLAFSGIRPRILVTLSIAAGLGCAISLTSLLFGKLHLITLVFGASLIGVAENYGNNYYAYRLGKPAGERWAMLRGQRATMWLAFATTAIGYALLALAPFPGLRQMAVFSVTGLFGAFVTTLCCLPFADRGEMPFNRFARALGGWRRRWPRWGRNRFSLLLGLAMAAALLAGFAVLKTNDDIRALQNAPQSLLQDQRRIGELMEMAGPAQFYLVSGDSPEQVLRREEALKTRLAPLIAAGQLKGVQAISDWAPSQARQLADRRLLQQTVFAPGGVLALASARLGQPAAAAPPPAAFQPLTLQAWLAAPVSEPLRAQWLGRFGQGYASVVMLRGLAGPSILPLLARQAEPAAGVRFIDKAGEVSGLMRHYRQLMSWVIAASYLLVLAMLWRRFGRQAWRALLPTLLASLLTVALSALLGQPLQLFTILALLLILGMGVDYGVFLLADDDPRAFLSVTLAAAGTLLSFGLLALSSTPALTAFGLTMLLGISLCWLLNPLFTPKT

SEQ ID NO: 7298 - protein, 364 aa, Chromobacterium substugae
METGSQTLQDKSFSPARQSVMDARFEAQKIAFGPVVFQCVRIAWKRGILKALAEAGEKGLSIAELAAAGDFTVYTLKLVLETCLSAGVVELRQGRYALDKTGFCLLSDPITQINLDFIHDVCYQGLFELERSLDEEKPHGLAALGQWDTIYQGLATLPEPARESWLRFDHFYSDTSFPAILPDVFATRPRKLMDIGANTGKFTLAALAHDAEVEMHLVDLPGQLAVIEKTLAEKGLSARANLHPIDMLNPALDFPAGMDVIWMSQFLSCFSEEAIASILRRAAAALADGGRVMILDTLWDRQQHDIAAYCLINTSPYFTAMASGNSKVYRADDYIRLCEAAGLKLVQERDGIGYCHSLLQFARA

SEQ ID NO: 7299 - protein, 189 aa, Chromobacterium substugae
MIRLRRLLPLCLCLVLLAGCQSAPAPQPRLPAIALSPASLGLSLSLAQRLSAAPLDPRDGTPSPALDVQLEIDGDRLQLAGLALGQRILRLSWDGKTLQSQRSPLLPASVDEARIVRDIQLAYWPLPALRAALPEGWTLEQRGATRVLSQQGEEAVRIDSQADPAWTGHSELINRREGYRLSIDSAPLQ

SEQ ID NO: 7300 - protein, 395 aa, Chromobacterium substugae
MTNAVYLNHLGALCSAGRGHAALREALFAPPAPIRRPGLALPDGRVWPSAPYQQALPDVDWLPLPLRSRNNALLLAALEDIRAEVDAAIARFGPDRVGVVLGTSTSGIGESEAAFAALRRDGRFPAGFHPLQQELGSPAALLRHALGIGGPALVISTACSSGAKALASAARLLRSGQCDAVIAGGADSLCQFTVAGFAALDSVSATGCNPFSRNRDGIHIGEAAALFLMSRERGPVRLAGWGESADAHHISAPDPSGRGAAAAMRQALERAGLAPADIDYINLHGTATQQNDAMESLAVSQLFGAAVPASSTKGLTGHTLGAAGALEAAFAWLTLHGNPAARLPVHVWDGAPDAALPPLNLVRPGQAAATPPRRALSNSFAFGGSNACLILEAAQ

SEQ ID NO: 7301 - protein, 152 aa, Chromobacterium substugae
MSDELYEIDSLVPHAGDMSLLDRVLSADADSVVAEVTPRLDQLFCRDGEIGSWVGIEYMAQTIGVWAGLRAKAQGRPPKVGFLLGTRRYTAEVSSFAPDVPLQVSVTQQFISDNGLCQFDCHIDSQGRRLATAQLKVFEPADIDHFIKESSQ

SEQ ID NO: 7302 - protein, 243 aa, Chromobacterium substugae
MTDHAILVTGSSRGIGRAIALRLARDGHDVVVHCRSRREEADAVAAEIAALGRQARVLQFDVTDRQAAAAALLADIEAHGCYYGVVCNAGLARDNTFAAMPPEDWDLVVNTDLGSFYNVLQPLTMPLVRRRKPGRIVTLASVSALMGNRGQVNYSAAKAGVIGATKALAVELASRAITVNCVAPGLIDTEMVEAHVLDEAMKIIPARRMGKPEEVAATVSFLMSEDAAYITRQVISVNGGMMG

SEQ ID NO: 7303 - protein, 410 aa, Chromobacterium substugae
MKRVVITGVGALSPLGHDWQSVYARLQAGRNVVQVMEPWGEYEGLGTQVGAPVQPFELPAHYNRKTTRSMGRVALMATRATEMALEQAGLLNDPLLGSGRMGISYGSSSGCPANMGDFGRMLVSKNIEGINANTYIRMMAHTAPVNIGVFFGITGRVITTSSACTSGSQGIGYAFEAIQSGRQVAMIAGGAEELDPTQAAVFDTLFATSVAHNDQPSLTPRPFDAARDGLVLGEGACSLVLEELEHAKARGANILAEILSFGTNSDGKHVTHPQSATMAGAIRMALDGAQLAPSDIPYVNAHGTATDQGDVAESHATRDVFGEKVAISSLKSYMGHTLGACGALEAWMSIEMMREGWFAPTLNLTEVDPNCAQLDYIAGDGRRLQTELVMSNNFAFGGINTSLIFRRWRD

SEQ ID NO: 7304 - protein, 144 aa, Chromobacterium substugae
MKFAAPLLALALVAGPAMARDTVVQIPLADVLSMPEAQEKLDGSVKFYLAGQHTPAIQTKMGSDVSNQKTNALNKSDEQACRWAILSTLISFQESAKKRHANAVVDIVSYYKKEERRDKETIECHSGTMIAGAAIKGSYAKIGR

SEQ ID NO: 7305 - protein, 263 aa, Chromobacterium substugae
MHYISKTITSPHNDEVKALARLAQHSRDRRKEGVMVLEGIHLAESCLQAGGALTRLYVNEEAQGHPEVQALLARLPAGCAVATLPAAVMAKVTAMASAGELLALCERPRPPAPQASAARVLLEDIQDPGNLGTILRTAAAAGVYEVFLSKGCVDVFSPKVLRAGMGAHFALRIHEHADLAAELAGFGGRKLVTHLEGSSSLYGHDLSGAVAFVFGNEGAGVSDELLALADARIRIPMPGHAESLNVAMAATVCLFERVRQLEQ

SEQ ID NO: 7306 - protein, 441 aa, Chromobacterium substugae
MDLNDWAKSIGEKRWPILPDTLNQLTDACARHSDLINFTDLANLCLSDPFLLLDLFRVVGNSRALQRNESIPSVEQTLMLMGLEAVVNRFGKIVPLEPSPGVLDPEVYEAVGDWLGRSRVAALLVKEWLSIMGELKVEDCFVAALLYNLPACIYMIQRNQLPDKPLLQEVSEAFDADYGQVLEAFVKHMPLPGGFKALIGAGAPTKRRQLLKLAIATANSLEQGVERSTWLVGVDTAAKMINVMPELAYMAVVHAVLNVARHPHVIGYTFPARALLLLPPGPRKGEMKKAAALSGEDQLEHAIRESIRFLANDLKFERVLYYHYEHDGHNLKLRYQVGVAGDSPLRKLPLDLEPGSFFGVFTSKPQSFHAPADVRSQLTRRYEDEFFQHVGDHEFALMTLFGGHKLSGVFYVDNARSGRGIDDATYHRFKDLVTRLTQMQH

SEQ ID NO: 7307 - protein, 246 aa, Chromobacterium substugae
MSRLRHLLLQLLACVGAWVFIAPAQHLAAWAVLQGLLAALLAIVLRQPGWQRLAHGLFVPAAVAMRQAGIPPGWYLLALLLTLALGRNALVERVPLYRSGRRVADRLASLLAADAALLEAGCGDGRLALQLARLRPDLRLRALENAVGSWLLAWLRWLRAGRPARLAVGCRSFWKEDWGSYDAIYVFLSPEPMPKVWRKFLSEGRPGSLLISNTFEVPDIQPDERIPLGGPLQKELLIWRHPNGSQ

SEQ ID NO: 7308 - protein, 304 aa, Chromobacterium substugae
MADESQRPIIVKRIKKGGHGHHGGAWKIAYADFVTAMMAFFLLMWLLGSASAGTLNGISEYFKTPLKVALSGGAGAGDATSVVKGGGNDLTKQAGQVNKAGARKEDVMQKQQEQAKLDQLQQKIQQNIEHSELLNQYKSQLKLEMTPEGLKIQIVDEQNRPMFDSGSSRMLPHTRVLLQQLAPDLNQLPNRISISGHTDAKPFAGGQGGYSNWELSADRANTARRELIAGGLSESKILRVVGLSSANPLIKSDVFSPENRRITILVLNKDAEQSILNDGFKPQMNQEVIGGPGGGQDAAPAGNP

SEQ ID NO: 7309 - protein, 257 aa, Chromobacterium substugae
MQPLEVVMIAGAAIGAFVVANGGAPLKATMKTLPTVFKGSPYGKAFYMDLFSLLFEILTKVRKEGLMSIEADVENPEASPVFSKYPSVMHDHHVVEFICDYLRLMVGGNLNAFEIENLMDVEIETHHHEGEVPVSAVKGLADGLPAFGIVAAVMGVVHTMESVGAPPSELGMLIAHALVGTFLGILLAYGFVGPLGTILEHKLGEGTRVYQTIKVTLLASLNGYAPQVAVEFGRKALSSMDRPSFKELEDHVKQAKK

SEQ ID NO: 7310 - protein, 459 aa, Chromobacterium substugae
MQKQRTTSQWRELDAAHHLHPFTDTASLNQQGARVMTRGEGVYLWDSDGNKIIDGMAGLWCVNVGYGRHDFAEAARRQMEELPFYNTFFKTTHPAVVELSSLLAEVTPAGFERVFYTNSGSESVDTMIRMVRRYWDVKGKPQKKTLIGRWNGYHGSTIGGASLGGMKYMHEQGDLPIPGMAHIEQPWWYKHGKDMTPDEFGLVAARWLEEKILEIGADKVAAFVGEPIQGAGGVIIPPATYWPEIERICRKHDVLLVADEVICGFGRTGEWFGHQQLGFQPDIFTTAKGLSSGYLPIGAVFIGQRVAEGLIEGGDFNHGFTYSGHPVCAAVAHANVTALRDEGIVQRVKDDIGPYMQQRWRETFSRFEHVDDVRGVGLIQAFTLVKNKATRELFSDFGEVGTLCRDIFFRNNLIMRACGDHIVSAPPLVISRSEVDEMLAVASRCLEEFEQTIKARGLV

SEQ ID NO: 7311 - protein, 444 aa, Chromobacterium substugae
MNHQINEWLREHRITEVECIVPDMTGVARGKIVPKDKFVSDPEMRLPEAVLIQTVTGDYPDDSLLDLTDPDMVLEPDPNTLRYVPWAVDPTAQLIYDCCRADGTPVDVAPRNVLKRVLRLFDDMGLEPVLAPEMEFYLLSPNPDPDIPLAAPVGRTGRAEFGRRSYSIDAVNEFDPLFEDIYDYCHAQNLEVDTLIHEIGTAQMEINFLHGNPLELADQVFLFKRTVREAAFRHNMYATFMAKPMENEPGSAMHIHQSLVDKNTGRNVFTNEDGSPSEIFFGFIAGLQKYIPQTMPLFAPYVNSFRRLSRYTAAPTNVEWGYDNRTVGLRVPHSSPAARRVENRVPGVDVNPYIAMAATLACGYLGMVNKLQPSEPRQTDAYELPYQFPNSSEESLQRLAGCKEIAEVLGPRFVKMYVAMKEKEFSEYFRVISPWERKFLLLHV

SEQ ID NO: 7312 - protein, 250 aa, Chromobacterium substugae
MQQAIIGIPSDVKMIGKLPFHAVGDKYIAAAAGGAGGLPLLIPSLGDEKLLRATVALLDGVLLPGSPSNVEPHHYGGPASRQGTLHDPQRDATTLPLIRLLLEEGVPLLGICRGFQEINVALGGELHQHVQEQPGLNDHREADSEEVAEMYAPSHAVSFVEGGLLAGWTGQREARVNSLHQQGIKRLAPGLDAEAHAEDGLVEAYRIREARAFAFAVQWHPEWRYWENPLSQAIFSAFGDACRARRAARG

SEQ ID NO: 7313 - protein, 374 aa, Chromobacterium substugae
MLIGVPKEIKNHEYRVGLTPSGVRELVANGHKVLVQTQAGLAIGFTDEQYIQAGASIASNAEEVFERAEMIVKVKEPQPVECRLLRPGQVLFTYLHLAPDPEQTKLLAESDAIAVAYETVTDERGGLPLLAPMSEVAGRMAIQAGAHALEKAQGGRGVLLGGVPGVAPAKVVVIGGGVVGLNAARMAMGAGADITILDKSLTRLKEIDMVFGGRIKTLMSNSANIDESIREADLVIGAVLIPGAAAPKLVTRAMLKTMKPGAVLVDVAIDQGGCFETSRPTTHQDPIYTVDGIVHYCVANMPGGVARTSTQALTNATLPYMLELANKGWRQALLDNAHLRNGLNICRGRVTHQAVAKDLGYAYVDPIEAIKAAS

SEQ ID NO: 7314 - protein, 166 aa, Chromobacterium substugae
MSQRELAKRAGVTNGTISLIEQNRVSPSVSSLKKVLEGLPITLAEFFTFDAEPSQPRVFYQADELPNLGNEDINLMLVGTSHDKRDIAILRERYLPGADTGPDMLVHDGQEGGVIIRGSIEVTVGNESRVLGPGDAYYFDSKLPHRFRNVGDDICEMVSASSPPTF

SEQ ID NO: 7315 - protein, 130 aa, Chromobacterium substugae
MKLGYTIVYVPDVAASLRFFAQAFGLKQKCLHESGAYGELDTGDTVLSFASHELAAMNLPAGHVRASDSTQPLGMEIGLVTEQVEAAHRRALECGAQELAAPARKPWGQTVSYLRSPDGALIELCSPLSA

SEQ ID NO: 7316 - protein, 496 aa, Chromobacterium substugae
MSRSTHADWKQLAAELKIEGRAFIDGAYRHADDERRFDCVNPATGAKLADIAHCGEADVNKAVKAARRAFESGVWSGLPPIKRGGILKRFAALIREHADELALLETLDAGKPIGDTTSVDVPAAAHCVEWYAESIDKIGGEVAPVDPKLVGLVTREPVGVVAAVVPWNFPILMASWKFGPALAAGNAVIVKPSEKSPLTAIRVAALAKEAGIPDGIFQVLPGPGEVGKALALHMGVDCVAFTGSTAVGKLIAGYAAQSNLKRVWLELGGKSPNIILSDCPDLAQAARSAAGAIFYNMGEVCTAGSRVLVHSAIKERFLAELQAAAARYYPGDPLDPATSMGAIVDGIQHKKVLGYIDKGVSEGASLLLGGKAAHADKGLFIEPTVFDCPRPDLAICREEIFGPVLSVITFDDVEEAIRIANDTEYGLAAAVWTANVSTAHQVSRRLRAGTVWVNCYDEGGDMNFPFGGYKQSGNGRDKSLHALEKYTELKSTLIKL

SEQ ID NO: 7317 - protein, 227 aa, Chromobacterium substugae
MAYRAGRGYDVDLIRELARRLHCPIASESVFPWIRTLKMLEIGEVDIATSATPTPDRLQYAWIYTYKHSKSMVLLRTEVQARTLAALPDDPKLRWGVIRGWKFSPMQDQLLADLAKRNKIVPAVDEDDLYKMLADGVITGALAHPTSYDDWLRNPRIRNQVVVLDLFPDVEATAGGVALSKKRFPEASAELWHAELKKMSRDGTLRDIFRRFLSEETADYLLRSPVP

SEQ ID NO: 7318 - protein, 265 aa, Chromobacterium substugae
MRRNICLALALLFATVCQAAPNPACPNGPLRVGFYKFGAAYRMGQGYDVDMVRELARRLHCQIASETELPRLRALKMLASGQIDIGTSTLATPDRLAYAWIYPYNHTKNMVLLHPSLKERTLPDLLNDPALRWGMVRGYRHSPEQDQFLGQLDAQRRLVVADDEDDLYRMLNDGIVTAAFALPGSYGRWLRDPLLAKRIAVLDLFPASTPIASGMALSKVRFSRQAAERWHQELLKMDQDGSLLGILRRYISDGAAKQMMQLPLD

SEQ ID NO: 7319 - protein, 264 aa, Chromobacterium substugae
MKWLAACLLALCLAAARAAPNPACPQGALAIAYYDFGIAYRQGKGYDPEIIHELARRLNCPIQSETDYPRLRVLKLLEIGQADIGTSTLITPERQRYLWLLPYHHSKNMVLLHRGVQANSLAELLKLPDLRWGMVRGYRHSPAQQKMLDELTLQHKVVVAENEDDLYKMVCNGVVSAAFGHTVSYDPWLQNHQAQQQVTVHDFFPDSEIIAGGIALSKARFSQGAAELWSEEVRRMLRDGSMRAIMRRHLSPAAVEQLFKQPLE

SEQ ID NO: 7320 - protein, 202 aa, Chromobacterium substugae
MKLLHLDSSILADNSVTRELSAVVANTLRQRHDKVETTYRDLAANPIAHLSGEIVGARFTAEADWTELQRSEAALTDQLIEEFFAADVLVIGAPMYNFSIPTQLKSWIDRVAAAGRTFKYTENGPVGLVPNKKVVVVSGRGGVHSGEQGSLMDFQEDFLVKVLGFLGVTDVEIVRAEAIGMGPDKRATSIHLAKEAIAKLAL

SEQ ID NO: 7321 - protein, 333 aa, Chromobacterium substugae
MHDLNDLMYFAKVVEHGGFMAAGRALGIPKSRLSRRVAELEQRLGARLLQRTTRRLALTEIGSQYYQHCQAMLAEAEAAHEAILQSSAEPRGLIRVSCPELLAKTMLSAVLPRFLALHPQVRVALDSTNRRVDLIEESVDVALRVRNVIDDSASLVVRRLGKSRFILVASPDFIRQHGEPQAPERLAALPALSMSRPDGRGQWTLLDNIGQSYTIHLDTPRLMTDDMIVLLEAAIAGVGVAAGQRLPPGAGGRQTQAHPAAIRLSLGHPARRLSHPPRPVAGGARLSRLHRPGADQRRDGGRLGAQRHSPGMTIALAEWCSFHSAPPCSPSVH

SEQ ID NO: 7322 - protein, 190 aa, Chromobacterium substugae
MVFIPFRSAMFTIRPLTETDSIDALTALLHRAYAQLGAMGLSYTAVSQSAEVTRRRIAGGHCLLAWHRDELIGTVTVHHPLPASSCPQFRQPDGAVLVQLAVAPDCQGLGLGERLIAAAEAWAQAQGYRAIRLDTAVEAHHLVSRYLRRGYRMEAPLQWPDKPYRSVVMEKRLEPMAGADTPNRYCTATE

SEQ ID NO: 7323 - protein, 823 aa, Chromobacterium substugae
MWSATAVQGGTLPFAQPLFDYWLDACQRGVLYWDTLYRRGATYLEHCESGKPPVLVFDYRIILDGRELPDPANYALAAIEPPPSCPPTDPAKRPFVVIDPRAGHGPGIGGFKMDSEIGIALQQGHPCYFVMFFPQPVPGQTIESVSKAEGVFLKRVNELHPDSDGKPFVIGNCQGGWALAMLASVAPDLVGPILLAGSPLSYWAGVRGKNPMRYAGGLNGGTWTASLAGDLGNGRFDGAHLVSNFEKLDPANTLWKKSYNLYSKVDTEPQRYLDFERWWGGHYLLNKAEMEWITQKLFVGNDLVHGKIASHDGKLRVDMRNIRSPIVVFASWGDNITPPQQALNWVADLYDNVEDIRNNEQTIVYCLHNKVGHLGIFVSAGVANKEHSEFASALDLIDVLAPGLYEAVIEDIAPDAPGQEYIEGRYIIRFEARDVSDILALDDGRDDEHAFEVVKRVSEINQGLYDRFASPLLRAAGNEAGARLLRELHPARLERTLISPKNPWLWWLPGLAAQVREQRRPAPLDNPLWQWQEQLSGFIGQSLDHYRDLRDAAQEQLFRAIYESPQLATLVGVQPASEPRRHALAWESRELARLKREALAPSFEQGTLADGFVRLLLYVSIGMGVVDERPFNAIRRVMRDVRHEYPLTLMQLKDIVRHQVALVRLDAPRALNGLAALLPDAHRRRQAWTLARDLLTLNGPIPAEHQARLDEVARTLQLDMPAAPGHPTAPSILPQLETAAAPAEIKAEKASASALQPKPAPARKPAAKPAAEAAPAAKPAQAEAKPAAARARKSPAKANGQAPAAAPAKTAKTATPAKRPGKA

SEQ ID NO: 7324 - protein, 204 aa, Chromobacterium substugae
MLTLIYLIAITAEAMTGALAAGRRHMDIFGVSVIAFLTALGGGTVRDIVLGRYPIGWTQHPEYVLLVVAGGIAAVLAARFMRHLNRLFLVLDALGLVAFTIIGCDVALGMHYHPVIVAMAGMITGIAGGILRDVLCNRVPIVFRRELYASVSLLVAMLYMGLNQLNLPHDYNIAASFAFGLALRLTALWREWQLPVFAYRHDHH

SEQ ID NO: 7325 - protein, 226 aa, Chromobacterium substugae
MPLRRLAIRALAGLLALPAAYLLAALLAGLLPVNKGWQAPADGIAVYLQDSNGVHTSLALPVQTPQQDWNALFSPRQTQRPELSAAQPYLAIGWGSRTFFLRTRSWADLTAGNAIAALASDASVLHVEYLPKPAEDADTRKILLTPGQYAKLAAFIRQSAAAGADGKPLWLTNERYDGNDAFYQAHGRYTPFVTCNQWTRNALAAAGVRTALWSPFTRPLFWRLHG

SEQ ID NO: 7326 - protein, 467 aa, Chromobacterium substugae
MNLSALLASFASAFTQDRRQLTLQLGDGHVAAEQLLPQSLDGEEGVSRPYRFTLTCLSPDGAIELKTLLGQSARLGIADAAGGETIRCGVVSQARQLGADGGFARYALTIEPPFALLRHRRTSRVFQDLTVPDIVQQILQEHQAANPAFARGQAIEIKVGPAQPRSYCLQYRESDYDFIVRLLHEEGYAWRFEHVDGDAPQVKLVVFDDAYSLPPAEVERVRFHRSDATEDEDGLTAWHASRQIVPGSVALASFDYQPVSTQHSGDSSQIDQGQGGQALQSSLQDYDPQGLYYAGDADQLSHYARLRQQAHDLQAKQFEGGGAVRGLTAGQWFRLDDHPAHETDSHEQREFVVTGQTLQARNNLPSELTQQLRALAPSLLADSDSQAAPFASQIQAQRRGIPLTPAYAGTAAAKPTSLGVQTATVVGPAGEEVHTDAQGRIKVQFHWQRPDEQWSGVRPAAASGIAP

SEQ ID NO: 7327 - protein, 49 aa, Chromobacterium substugae
MVGCSSGRCQWNCTLMRPWASVWTSSPAGPTTVAVCTPRLVGLADSVPA

SEQ ID NO: 7328 - protein, 57 aa, Chromobacterium substugae
MRQVSWGSMLEEAPTELIQGYWWQMLAVTVAMSVLVTAFSLLVDALRDALDPRAVAK

SEQ ID NO: 7329 - protein, 567 aa, Chromobacterium substugae
MNQQNTLLSVRNLKVGFRQEDGGRFEALKGVSFDIPAHRTVALVGESGSGKSVTSMAIMQLLPPQSSEIDPASELLFQGRNLLRLSRGELRKLRGKDIAMIFQEPMSSLNPVFSVGEQIVETLTLHAGLSRSAAWKRAVELLREVGLPEPEKRVKAYPHELSGGQQQRVMIAIAIACEPKLLIADEPTTALDVTIQKQILQLIADLQKKHGMSVLFITHDLGVVGEFADEVIVMRHGVIREQGTVKQIFENPQDAYTKALLSCRPHLDRRPERLAVIDDFLQPGGYVEPAERTRGYAAGDEIVLDVQGLCKSFDIREGLFGKRQFHAVKDVSFQLARGKTLGIVGESGSGKTTVGLTLVRLHQATGGKALFHGQDLIGMSAKAFHAYKKRIQIIFQNPYASLNPRFTVEQILTEPMLLHGIGQDGGQRRKLALDLLDKVGLPAGALAKYPHEFSGGQRQRIAIARCLTLKPEVLICDESVSALDVSVQAQVLNLLQDLQDEYKLSYLFISHDLAVVKHISDQVLVMNKGQVVEQADADVIYREPKDSYTKKLLGAIPQGWNAALAPA

SEQ ID NO: 7330 - protein, 124 aa, Chromobacterium substugae
MSQPVVTVKNHSSRDVFIEGDPNWDDQTLLIDGQAESGAYPLGPDQSVQLSVDWSGPGNAYMLGVIFADGPDYDYGGDGFYQLTLGQNEGSGLLGVTESDGQAKISYSVSQQTAWTVSLDFADG

SEQ ID NO: 7331 - protein, 219 aa, Chromobacterium substugae
MGWGRLLAAIAVCNLAYWLALLLAARFYGIRVREHCVGIGPVLFGNGKLQLRLLPISAWVRMALLADRRPEEAERVCLDAKAVPIQLIVAASGCVALLWLGACLNEGASLDSFRAGWSQLPFGALPPWGEAQHWLAALSDWTAQSGFLAMLPVVAAKMAVFNLLPLPGAAGGIMLRLLVPMGARPAFEHSNVFRLWMAAHLLWLFCWLAALALHVWPFG

SEQ ID NO: 7332 - protein, 296 aa, Chromobacterium substugae
MTLSVDALSAFVYAAELGSFSAAARRLGKSQSTVSEAIANLEIDLGNLLFDRGTRTPTLTPAGRLLLPQARQVMNASQDMQQQAALLSAGVESRLTIVLSDTFQSETLENVACRLEARYPLLELECLAGEQEDVLDLILSGRAQLGLVGALDRYPPDIRHQRQREASELALYAAYRHPLAGMDRIDEQQLALHRQLRLNTYNDKNPAHAGQRQWYAPSYLMLLDMARLGVGWAELPCWLVKSFGGGELKQLDVAGWPKRMPVDLVWAANRPLGAAAGWLLEQLARPADDAQPNGQT

SEQ ID NO: 7333 - protein, 149 aa, Chromobacterium substugae
MQAANKKLGERVLHAVLYEACAMALLVPLAALVMQKDVLHMGALALMMSTAAMLWNMVFNALFERVERLFGWRRTAGVRCLHALGFEGGLVILLVPLAAWWLDSGYWQAFLLDLGFFVFFLPYTYVFNWLYDHLRERFVARRGLSAAVE

SEQ ID NO: 7334 - protein, 110 aa, Chromobacterium substugae
MKVWLFLMGAILSEVVATSALKASDGFTRLWPSLLTAGGYLLAFYLLSQTLREIPVGIAYALWSGIGIVLVSLIAWLLYGQKLDAAALAGMALIIAGVAVINLFSQSSAH

SEQ ID NO: 7335 - protein, 256 aa, Chromobacterium substugae
MEHDMAILAVCGVKGGCGATTVAAALALLWQRQQRPVLAMDLCRQNLLRLHFGMEWHEADGWRRRRDAGADWARAAWEVGDRHLTLVPHGRVEEDVDQEGPEPEEWLRDELAQLERQPGQRTVLDLPARGVAERQQGLKAASHALVMLSADPAACALLDAVEAELHAGGLPAERIFFVINHFNPLRKLDGDVELLLRKKLGPRLAPLPIHRDEAVREAFAKQQPLFDYAPASQAADDLRQLAVWLSVRLDAGRSGA

SEQ ID NO: 7336 - protein, 863 aa, Chromobacterium substugae
MSLRGADWRAWCLRLGLLHPADAPRLAFALLGLFFVAPTEGWAAWGRAARRYFPQVDFSRLRPADPLRILLQLLWLALVKPPRALGPRRQARLPALLQFARRELAAVSAQRRRLAGWLEGRFPRLFDPASLRGSVEGIAEHAWWQSAAIRTICYLAAALLGVVLVTTPFDEYSQAVFTVVLLLMALWVRRIPGPVPTLILMVFSIAVSTRYIWWRTTSTINDDTWPNLIAGVILLGAEMYAWLVLLLGFFQSSWMLERKVVPLPADTSLWPSVDVFIPIYSEPLRVLKPTVFAAMSMDWPADKLRVHILDDGTRDEIRDFAAQIGVGYIVRQEHKHAKAGNINHALGRTDGSFVAIFDCDHIPTRSFLQTTMGGFLRDEKLALVQTPHHFFSADPFERNLNTRDKVPNEGELFYGRVQDGNDLWNASFFCGSCAVLRRDALMSVGGIAVETVTEDAHTSLKMHRRGYHSAYINLVQAAGLATESLSAHVGQRIRWARGMAQIFRSDNPLLGKGLTLGQRFCYLNAMMHFLYGIPRLVFLTAPLAFLLFHAYTIYAPALGLVLYVVPHMVFSVMSNSRMHGEFRRSFWGEVYETVLAWYITLPTTVALLFPGLGKFNVTAKGGVVEEDHVDWNITKPYLFLLALNLLGVGFGVYRIWSGPGNEIGTVLVNLFWVGYNTLLLGVALGVARELRQVRVSHRVESRLPVSLHLHDGKVYPCHTLDYSEGGMALQLPEGLQLKLRQNTELTVSMRRSGRSFALPCRLVFSKGGRLSVRFVGLTLDEEMALVQCTFGRADAWLQTGERAHEGTPLGGAWDIWRMGGGSLWQLAQQLFSPLAVRNGRWAGFWNWLGSLLPRQPHLHRDIK

SEQ ID NO: 7337 - protein, 756 aa, Chromobacterium substugae
MTSRIPRKTLSILLSGLLLAAPALSVGAKEETAAAQPPAQAAPLVTTRTLSFKQMGAGYPLKMRGDNSLVGVGFGSRGDEVITGLTLHLRYTFSPAMLADLSHVQVLLNDEVVTVLALPKEQGGKPQQLTLPLDPRLLANFNQLKFRLIGHYTNRCEDETHSSLWAEISNASELQMTVQALPFVNDLSYFPEPFFDRRDFSPLKLPFIFAARPSQTSLQAAGELASWFGAQAGWRGVRYSAALNSLPAAQHAIVYAVNGQRPDFLAKLPPVNAPTIAIVPHPERPERKLLLILGRDDKDLKLATDALVLGQAGMSGSQVAVRGIKLEAPRKPYDAPNWVRPDRPTRLGELVDNPRDLQVTGQQPAPVRVSFRVPGDLFTWGSRGIPLDLKFRYTGQQQATGSRLNIGINELFVQSLNLNASGVGSTQTSLRLPVLENGLLSNIDRILLPPFRVGSRNEMQFQYVFAAEKQGECANNLADGNRAAIDPDSTIDFSGYPHYAALPNLGLFATSGFPFTRMADLSDTAVVLPRQPAQQDIGAFLNVMGQMGQSTGYPALRYRLVDEGALDSVKKMDLLIVGNARNLGLLKAWRDKLPTTLDSAGRKVAEGETTDLPAGMGQAPGQAAGGRINGQVDFAAQGKLGAILALESPLASGRSAVIVTGSEPDALALATGALADDGKVAQMSGSAVLVRGDTIDSQQLGPVYYVGNLPLWTWVWLFLSAHPLLLAGLSALAVLIFAFAILRLFKALAARRIRES

SEQ ID NO: 7338 - protein, 375 aa, Chromobacterium substugae
MGIPRRALLAALGALAISTARAAPCDGWPAWQDFQRHFVSDGGRVVDRGADGQPTTSEGQSYALFFALAANDRPAFDKLLRWTRDNLAGGDFSARLPAWQWGKRPDGQWGVMDDNSASDSDLWIAYNLLEAGRLWREPRYTALGKLLALRILREEVADLPGLGPTLLPGRYGFSKPGLTRLNPSYVPPQLVARMAHALPGSGWAALRGTSQRLLLESAPAGYAPDWAAYRQGFSADAASQAAGSYNAIRVYLWTGMLAPDAPGRTALLAKFKPMAQLVAKTGLPPETVDTRNGKAQGTGPIGFSMALLPFLQAQDEQAALQAQLLRVEAMPLSERPDAYYDHVLTLFGQGWQQGRYQFNANGELKPAWEGACAAS

SEQ ID NO: 7339 - protein, 1283 aa, Chromobacterium substugae
MRGILSAMLAVGFSGALHAAPAAVDPAQALLEQARLWQSLGRPLEAQQALDKLQRIHAATAQDRAEALTLQALVQVQQRQDKDAQQTLAKLRKLYPGYSGIARVEQMRRIMGPDRNKLLTARSLFNSGKIEQAYAAFNALYQGPPPEGALALEYWQLVARLPNGGWARSQAELKKLIRQSPSNHRNRLALASIYLLHPPVPASVLADLKALTQFSDSRSEALGLWRRALQQSDLPDDAYLAYLKVEPEDELVSSRLASLQDGRRKRREQLADPAYRALLAADKQLDANQLAAAEKSLQLAASRYGKQAGYLQSLGRLREKQGRYADAVASYRQGQSQQPDDKGWKRRIADAQLADLLARAQAAMQAGQWQAARAQLDQAGKQQPGNVDVLLADAEWQAGQKHAVRARQLYRQALQSKLDSGQALAGLLRTYLDAGEYAQAAEMLRALPPKQQRALGTSYQSARADVERELGDRLLAQGQLSQALPHLQKAVDLQPQNTWNRYALANAWLAAGDAAKGGAILRQLADAPAASPESLYAYALFQAKREDDRSALGALQRIAPDARSEGMAALQRRVWLRETMRQADAQLAFGHAAEARRSLQNAERLMRGDPARLSELAQAWLRAGDAEHARQMLLTQYLEQPGADNELAYADLLLDLGDAAAAAPLLAASAQTRQDMNDEQKRKLADLQAALASAQADAARDAGDGARAQAILLQAAAAAPQDARLQRKLADYDMDAGRWGSARARLRQVLSQQPDDDEAQLQLVDLYIKTGQRDLAVHGVDALLRDKPGRSLDFRLRALTRLGDAGETERLDREIAALLAQGVKSPALMGQAARRARQQDRPAQALAWYRAGFAPAGNEVQTTANSGLLLGQQPLRPVPAESAQQEGLHEDYAELLDARSVKIWQGLDLTYRSADNGTPGQSQMTMWQAPLLVELPAPRAGKYFLRADAVSINAGSLDNSLGNDYALQRFGSVAACAAQSGSSVQSCAGQYGAQTAQGAALGLGYENEHWRVDAGVTPQSFPVSNLIGGVRYSDSVSILNYKLEAARRPVTSSLLSYAGVRDPYTGQTWGGVVATGVGGSLGYDKGGRFGVWSNFAYQQLTGENVADNRKLTAMGGVYWRLLKEPTRQVTVGVNSINFWFQKNLGEFTFGQGGYYSPQRYNSLSVPLSYAARNERWSWLGRASVSVSSANEAASPFYPTRPDLQAQAGNPYVSASSGPGWGVSLSGAFEYQLTSRLALGGMLEYQHSQYYQPGRALFYLRYQPDGASLTLPFPVEPLQPYSSF

SEQ ID NO: 7340 - protein, 132 aa, Chromobacterium substugae
MNLLKMVGCCLAIALLPQAGMAASVELDAARAWYWQHPYQPEAINRLALQLVKAGQTGSAIVLLERAARIAPDREDIRANLLRLQSGSRQVVDAPWAGQGPEPADAAPSQPLAAPAAAEALPPPWPMPAAKP

SEQ ID NO: 7341 - protein, 537 aa, Chromobacterium substugae
MKSSQSATPDTVAPAAPRSLGLGTWSVYFIAKLLLSWQGTLNLHPLPNLAFALALLIPISGKTRLRLRAALALLAGAALLYHDSWLPSPSMALQQLSTLQGFSFHYLLDLAGRVLSLSLLTGALILLCGYWLLSRYLRLGTIVMISLLGLSGRQLWQEQPRAPAAAVADSGAATAGAAPNAAQTPDQQLAAFFKSEGQRMVKFQGPLADPGFDVLILHVCSLSWDDLRAIGMDQHPLLGRFDFLFSNFNSATPYSGPAALRVLRASCGQPKHSELYQSAPKECYLFEDLAALGFKTELTMNHDGSFDDFLKQIRSDGRLNQPLISQQGLPVGLRSFDNTPIYSDYAVLNRWLEQRQQDSSAHVATYYNTISLHDGNRIPSAPGLNTMDSYKYRANRLFADLSQFIDQLEKSHRKMVLVLVPEHGAALRGDKQQFSGLREIPTPHITIVPAAVKVIGGQAHPSQVRIDQPSSYLAVSTILSRMMTKSPFGADYQPAEFARDLPTTPYVSESASSIVMQSGKRFLLQQDGGDWTEYPVQ

SEQ ID NO: 7342 - protein, 76 aa, Chromobacterium substugae
MFNPELSQLQFLVLLAALAAGIAGYQLHARLLPRLRELLSRRMRHFQPHPYLQRLRQQDDAPLAKSRRADPGHKPS

SEQ ID NO: 7343 - protein, 535 aa, Chromobacterium substugae
MDTTQSLGIDGIPPSAAALNGGALYLIAAPGPALAQALLFANLPSAGSQPLICASRQQPAAQQDTAWLDRRIHAGNLHLLSPRKPRKSSAQQIDAYLDELARCRKLLQPAGGGMTVALDHAEDYLPLQQPALARRALQACSHWAARHGHALLLLLDSSHLDAAALAALSQLGSDCAGMVYAQPLGDGFYSWQIAHWLGAGPAETARLRTLELSPRHLLSAQREAEEDAGDATEGHSRLATDALQVLATNAALSGNTPPTPHWRLFDDLPQLLEAAREAVAATVLLDTASSKKEVLGNAVAQLRQQCGKRLKIVVREVGNRRLRQNEEQLLLRLGANAVLPAELRFSSLASIVHSLRQAVYQGRKHVEADALRAASRPEADRGYLPPARFVEVVAGTVQRSRAIDVSNMFIRLQPALGASPAELLALGRFQRAGDLCTADGEYAYLFLFACREADADAALGNLFRMPIGEVAQAEVRSADSESIQLALSQLSRQSGFDKLPDLSRQLSDAPRPRDSRHAHTPPTLQRAPLRRHGSQ

SEQ ID NO: 7344 - protein, 306 aa, Chromobacterium substugae
MLLIAYDLRNGGISKTTRSFLNAAGYLHWRVTVADAKSSNDSVREQLLLQATAKDVAGVALVGADSAGYHLELALLKQMGKVAVGWHAGSSPGPNAELFANVTTDPIAVAQTAVSYAIGSSTGPLGAVIFTDSHFSIAMRKANAMKDALLRCKRCKVLAMEDVDLSKTAQLIPQRVPRLAQKYGAAWTHTLAINDLYFDNINFPLHQTARPDIVNISAGDGSNSAMNRIREGISQQKATVAEPCNQQGWQMADELNRGFARQPPSGFVSKPILVTQDKLLAHPRDGDIEDDQAYRQAYLGIWLKKP

SEQ ID NO: 7345 - protein, 68 aa, Chromobacterium substugae
MAAALRRRACGRGDGVRRGLRRLSGGRYQEGKCQQPRQGAARQGAQTRWGGCAQSAGRLGLGRLHAQI

SEQ ID NO: 7346 - protein, 612 aa, Chromobacterium substugae
MTQHHHLGCACCSMPHLPSLFDNLPDPQQALQALEAALKQAIPSHTPARAVFCGGPIYTVAANGNQRVEALGIADGVIVATGSLQLVETAMEAQMPGQAYDRIDLAGRTLLPGLIDPHAHVLPSALYRHWLPLAPFKGQRLDPQYSYESISAQIREALSQSKLPKDAQGDRWVLGFGVDPSLMKEWIDINADLLNELSEQTPIALINASGHIAYANTPALRKAGLLNPDGSLPPSKGVLTEDRVKALLGAMPPIVWAEAVLQIPKVLQDASQTGITTLLDAGAGVSGSKLEIDLLKLAAHGGPLRIAAALFTPDKERMQHWKELQITPDLDNAKDKRFALKAIKLIYDGSNQGLTGYQNEPYPCAEAHPVPDVPPTGLHNLEPGELAELIQLASDEEWPILIHANGDHAMADVLNGYAESLAPASEAADKKRRLRMRVEHASLMDDRAIAKMARLKVSPSFLIGHVGYWGYAFNKTILGNRRAQLLDRAQSAVQAGMRVSLHSDHFVSPFGPLRMMEQAIFRTMEGAPAKERAPLNPAECLSREQALRAVTLDAAWQCHMDHLVGSLEPGKLADLVILDQNPLDDAVTDLRGITVCQTWLNGAPVYRNPSHG

SEQ ID NO: 7347 - protein, 983 aa, Chromobacterium substugae
MVWKLSDRAAGSSLRCRNRGAKLGEWLKKRYNQAIFPFKKSRLSTMELAKSYEPGDIERRWYDQWEQAGYFKPSMDTAKPSFAIQLPPPNVTGTLHMGHAFNQTIMDGLTRYYRMKGDNTVWIPGTDHAGIATQIVVERQLADQGLNRHDMGREAFTSKIWEWKEKSGGTITSQMRRVGCSVDWDREYFTMDDTRAEVVTEVFVRLYEQGLIYRGKRLSNWDAKLGTAISDLEVVSEEEDGHMWHIKYPVVGSDEYVTVATTRPETLLGDVAVAIAPDDERYLHLVGKQLELPLTGRTIPVIADEYVDKEFGTGFVKITPAHDFNDYEVGKRHSTQLINVMSLEAKILAKAQIFGFDGAAQGTIELPAAYAGLTAQEARKAMLADLQAQGLLLETKPHKLMVPRGDRTGTVIEPLLTDQWFVAMNKVADGDATGQSIAAKAIEAVESGEVRFVPENWVNTYNQWMKNIQDWCISRQLWWGHQIPAWYDEDGNIYVGRTEEEAQAKAGGKTLRREQDVLDTWFSSALVPFSTLGWPEETPDLKAFLTSNVLVTGYEIIFFWVARMIMMTKHFTGKVPFKDVYIHGMVRDHEGKKMSKSEGNVIDPVDLIDGIALAPLVEKRTTGLRRPEKAPAIAKATEKLFPEGIPAYGTDALRFTMASYATLGRSVNFDFKRAEGYRNFCNKLWNATRFVMMNVEGKDCGQDESLPLEYSFVDQWIIGRLQQAEIDVTNALETYRFDIAAQVIYEFIWNEYCDWYVELAKVQLQTGNDAQQRATRRTIVRVLEVALRLTHPLMPFITEELWQTVAPLANAKKADSLMLAPWPVADESKISAAANARMDAFKDMVNAVRNLRGEMGIGPAVKAPLFIETTDASIADFVPYLKLLARLTEGTLVSKLPEDDAPVAMSGEARLMLKVEVDKAAETARLTKEQGKVEAELAKLTAKLEKPGYVDKAPAHLVERDKAQLAELNDKLEKVRAQLVKLA

SEQ ID NO: 7348 - protein, 224 aa, Chromobacterium substugae
MTQLAHSPMQPGLLSFPFLTHTIRLLHRHNGLWFFADDVAAAIKCRSTAALLSKLNREEVRTLPVGVEDVVCLSETGVAMAIRRYRKPAARRFRRWLEEELLPTLWREGEEALTADQLEQALALAAEAARQVSRAVLDAVLENGEACWQHSRWLVTLDYERHNRQKHPLGRMMGLNSAVSTLDGLAELIAVPDGMPATDTELVKLAAACHLRLAERMSLRVADE

SEQ ID NO: 7349 - protein, 359 aa, Chromobacterium substugae
MIHNTIPRWTIVTPVLAWAAIAASSAAGGHASYLTLLAVLLAGTVFAAVHHAEVVAHKVGEPFGTLILALAVTVIEVALIISFMLGGGEEKLALARDTIFSAIMITCNGILGICLLLGGLRHREQNFQLSGAKAALTVLAAISVLALVLPNYGTSQPGPLLSSSQLAFTGVVSLVLYGAFVFVQTIRHRDYFLVEGSHDEDEHAPPPSNKVAMLAVAMLLICLVAVVTLAKLLSPSIESFVVNAGAPAAVVGIIIAALVLLPEGLAAANAARADRVQTSLNLALGSALASIGLTIPTVAMIFVFRGEPLILGLEIKETIFLLLTLVACSLSLSVGRTTILQGIVHLVIFASFVFFAISP

SEQ ID NO: 7350 - protein, 519 aa, Chromobacterium substugae
MRNHHPTPYDVIIAGAGPVGLFLACELRLFGLSVLVLEQAADSHSPLKRLQFGMRGLSVPTLEALHRRSLLDEIIAATQANDAAKQTKASAHWMQQPRRAAGHFAGIPFHLDDIDTSNWPFHLPGPADTPMAITLEVFETVLARRASAMGATILRGVGVDGYLVSDDEVTVHADGTVFNGSWLIGCDGGRSQVRKAGGFEFLGTAPEFTGYSVDAALAEPHTLQPGRHYTPTGMYTYAKPGVIAMVEFDGGACHRTQALTQEHMQAVLRRVSGADATLADIRLATTWTDRAYQASAYRRGRVLLAGDAAHIHSPLGGQGLNLGIGDAINLGWKLAATMRGDAPAGLLDSYQQERHPIGARVLDWSRAQVALMRPTPSTRALAAIIGDLIETRDGATYFAERVWGLSLRYDMASQHPLAGRSVPDFEFDDGTKAGRLLRNGRGLLLHFDAAAPLLNWMKRWQGRVDYVTATVKNNLGLRAVLVRPDGFVAWASETSPDAEEITPILAQWFGEPKESSDHP

SEQ ID NO: 7351 - protein, 54 aa, Chromobacterium substugae
MELGKLGLKLGNFLFYPVRLFLLTFLRALGPALAAILQLLFQLLYLLLQLAIEA

SEQ ID NO: 7352 - protein, 185 aa, Chromobacterium substugae
MNLKTFKALLAAISLTIASTASDAAPIVTLSGPLALQTSNGHYLTAVNGGGLGGPNNGPSAVALHSDAKTKGGWETLYLVQLPNGRVAFRTTAGYYLTAVNGGGVGGPNTSASPFHTDATWASTWERFQLEFDPASNTYALKTANGNYVTFVNNGGIGGANNVPVHSDARTANDWESFTLVPLSN

SEQ ID NO: 7353 - protein, 59 aa, Chromobacterium substugae
MKIQELKQGDLITQHIDNLVVSFEVLSIQQIGRRFQITFSSASGIATASYQADALITTI

SEQ ID NO: 7354 - protein, 117 aa, Chromobacterium substugae
MNNAIACAIAAAASLLALATTSQAAEWRLGDIKSQECLKNSTLISSSIKYCHNCVGKQGNLTSWTFTTTCDGKLQTRLAQSKINCNTPAGQASETAQKTTHTQQAAATLPGPATPCK

SEQ ID NO: 7355 - protein, 52 aa, Chromobacterium substugae
MPRGCGIVEFPAKAAGILILVDGSLIRAFSKGMIGLLAANGTLPCASWFIES

SEQ ID NO: 7356 - protein, 226 aa, Chromobacterium substugae
MKKILPLLALASLSANSRADDNEVLRHIADCSDSFSRYMASQPQSAADKHFSVKNGAAALKMKLVTDAAKELEENIPGSSTGVKDISRYADIDKAIPISGQWALSSYFEEHARFAKNSDAGVKETYNWVFHLDGKKDMLLRDFLRLTGNLSYSCDGNNCLAYQRMAKGGWQAVKPEQLKAGEPYLQIMASKEGSKQFSISCNLASEGKHLPVGLIKTRRPDWQLNF

SEQ ID NO: 7357 - protein, 179 aa, Chromobacterium substugae
MGATQWSRQYQYDAAGQLTGIADSRNGQLNYRYDPVGRLLQAATPKGVENFNFDPAGNLLDNAPAADGHQDNSLLGNLLSQYAGRHYRYDMEKRVNSSLTKLEWDSHNHLSRLIAPDGQRTDYHYAPQGRRIAKISQGQATLYGWDGDVLVIEPCVKETVRYLFEPTAAHKGFRLARRN

SEQ ID NO: 7358 - protein, 73 aa, Chromobacterium substugae
MVERFNGRISDVLATHRCESGKDLGETLQRYVLLYNQHLPQLALQHRTPIQAWQKQRPDLFKKRVSNRPGLDI

SEQ ID NO: 7359 - protein, 248 aa, Chromobacterium substugae
MANRQLLREIRLVHAEVNGIYGHRRIHAELLAQGFACGRHRIAGLMRRNGIRVRTRKHCRPVSGGQHLLPMAPNLLQRQFAAGGDINQRWVSDMTYIRTGEGWLYLAVVLDLYSRAIVGWAMHHRMQQELVHAALTMAVARRQPSGEVILHSDRGSQYCAFDYQALLKRHGMVPSHSRTGNCWDNAAMESFFRSLKSERVYLTHYRSYDEARTDVFDYIRFYNHQRRHSTLGYLTPVEFERRRSELSA

SEQ ID NO: 7360 - protein, 40 aa, Chromobacterium substugae
MLAKWFHFQPSEIDGLEVADFLAWCERATEQIRTEQEAYG

SEQ ID NO: 7361 - protein, 98 aa, Chromobacterium substugae
MSETIQPQPAGSLIESITVELLAPLMLGNGSRVSQLTLRRPKVKDVKLAARFGERQEEQEIGLAALLSGLAAEDIENLDLGDWRKVQESFRRMLGDNG

SEQ ID NO: 7362 - protein, 172 aa, Chromobacterium substugae
MAVQVNNIVNANIYLGGNNLLGCAEEIKLPVLKAVMKDHKALGMFGKLKLPAGFEALEGDIKWSSFYLDAFRAVANPLRALQLMCRSNVESWNAQGLSQERELVTLLTVSFQEFPLGSFKQHEQVDFPSKFTATYIKQTLAGQDVVELDVMSNIFRVGGEDMLANYRSHIGA

SEQ ID NO: 7363 - protein, 475 aa, Chromobacterium substugae
MPANFLHGVETIEVEKGARPVRVVKSATILLVGTAPKGKPGELTLCLSERDAAAFGRGHAGFTIPQALAAIYDQGAGTVLVLNVLDSSLHKSAVENENVSFDSSGRARLRHPAVMGLELKSLDGGRNYVAGVDYQLDADSGELSRLKAGAIASLATVRANYSYADPAKVTAADIIGGVDAAGRRTGLKAAKDAFSAFGFLAKLVIAPAYCTQASVAAEMVAVAEQTGAFALIDAPIGVSVQQALQGRGPGGAINFNVGSERAILCYPHLKVWDDQTNAPRLEPFSQRLAGVIARKDLDKGYWWSPSNTGIQGVIGIERPLTALLDDANAEVNLLNEAGIVTVFNAFGSGWEVWGNRSAAWPVLSHIRNFIPVRRTADIINESLRYFSKQYMDRPLDQPLIDSLVGSINAFFRKLIGDGAILGGHCWFDPARNVKEELAAGHLLLQYKFTPPPPMERLSLEAEISDEYLLNLKGER

SEQ ID NO: 7364 - protein, 61 aa, Chromobacterium substugae
MIYRYDGPPSGVTLADGREVMLFCGQEADLPEDGEYTRALLAQRYLQPADRQLNQGETHAG

SEQ ID NO: 7365 - protein, 75 aa, Chromobacterium substugae
MLMLESGGELTRALGRIEGKLDMIAASQVGQSERLDGLDARLRQVEQQAARVGAISGCVVAVLTAIAAEMLKRAW

SEQ ID NO: 7366 - protein, 71 aa, Chromobacterium substugae
MTDLFDQAQALEQRQREEALARQAVRMNLAGAASYSHCQECGDDIPASRRRAVPGCRRCLICQKSHEKGWC

SEQ ID NO: 7367 - protein, 144 aa, Chromobacterium substugae
MKLEQLPNLLPETVRLIAGMIGLPNTLKLVENLGGTTFPVSKKRSRLGEARYLALAEVVGVEAADRLCQHYGGDLLYIPRCASALRRLRDYAICEAFDRLSRELGSNAAVSQLAQQHRLTDRRIWDILKRTDCSDPAATDPRRH

SEQ ID NO: 7368 - protein, 104 aa, Chromobacterium substugae
MNLVDDLGEKKMIDANSPLRPLRNAAIVASAHRVAAAVERLTRLGFTVMWVELLEPRQPTIRIEPHPDCRRMAGQGDAAHDDFYSSPKAGRFRINGCLVVWTEY

SEQ ID NO: 7369 - protein, 51 aa, Chromobacterium substugae
MVETVLDQVLQERNLRLKSEKRGAVVAFLYDYASKGGGRDGMLMALQALVA

SEQ ID NO: 7370 - protein, 64 aa, Chromobacterium substugae
MAGGNKNGATLFKVAPFFIAFIHFFLDDAGQWLAAWVLAYLAHARPGRAVVKPAARPAIRPDKA

SEQ ID NO: 7371 - protein, 207 aa, Chromobacterium substugae
MRQRVAVIDFETTGITPGPDCRATEIGVAMVENGRVVDRFQSLMNAGVRVPPMIEALTGISNAMLRAAPPAHAVMRDAAAFVGSAPLAAHNASFDRKFWDYELAQLGLARGQDFACTLLLSRRLLPQAPNHKLGTLTRWASLPDTGRAHRALADAEMAANLLCHLEDTLRGQFRLGDVNHGMLCKLQKVAAAKIRPYLDELQAAQRV

SEQ ID NO: 7372 - protein, 67 aa, Chromobacterium substugae
MSKKPQEKLDEETLALLAWCAEVETHLVAAGATEAEAQEHIEEQAEWYTDQFFDGLTPEEAAKAALA

SEQ ID NO: 7373 - protein, 135 aa, Chromobacterium substugae
MSVSRYLVKEDEVAFTAMRAQGAGGQNVNKVSSAIHLRFDIAASSLPEWLRERLLGLNDTRISKEGVLVIKAQQYRTQEQNRADALLRLQALVDSASHTPKARRATKPTYGSQQRRLAGKSQRGAIKSLRGRVDD

SEQ ID NO: 7374 - protein, 668 aa, Chromobacterium substugae
MRQLTIRQLMSIGTAIAVIPLLFGNLLIWQGNASLRQAATASGNASAALLHFKNARYNVVQIQQFLTDAAATGETADDYRDEESNWKQALTELDTLSQLLPELAADLQTLKPQVNHLHEEGRAMVEAYIRQGREAGNAIMKKPGSGFDDTTDAIDKKLEELSKRIEQLFSAANNAQESALRQTALLNAAIAALAILLILAANSYQYLSLRRLLGGEPAYASEVAKEIADGNLSLQVANQSQSTDSLLGSMKTMTQKLTEHLRLLDQETKQVGQSSYQISEISKHITDNSEREQGHSDEVRQATTVLEETTESVRAIAQKVSQHADQARLSANQGMATMRSNIEEMGRAVDEAQQAEGKIQALSEANQKIQVITQTISSITEQTNLLALNAAIEAARAGEAGRGFAVVADEVRKLAHHAGQATDEITAIIGNLNQLIEENTQSVQGIIERTRAGMQKAEEASTAISSLVHDIDNNVHAAHQISDASSTQMQRLDTLRSTLAKLLDNMSGNALKVRTTGVISRDLYRVTGNLSQIMEKFRFDPNWTPTARSNEHRRHPRVNKNLLVQVDDGGQKRDATTVDFSLTGLQLRLPMPLQAKAGSELPLSIQLPQDSIERYSKQQPLTLTAKLLWTRKTEEGELYGFSFGRPNPQQLAQLEQAFLFFCHNPIYE

SEQ ID NO: 7375 - protein, 513 aa, Chromobacterium substugae
MKRTLLALSLVLAGLAPLSHADVADGHALPPGISWQQGDVPAAFAKARSENKPVFLYWGAVWCPPCNQVKSTIFNRPDFIAATRQFVPVYLDGDSANAQQLGEQFKVRGYPTMILFRPDGTEITRLPGEVDPERYLRTLQLGLVTVKPVKALLADALAGKPLAAEDWQLLADYAWDVDQGQIIPEKDVTATLAQLAQRVPAAQTATATRLRLKALAALAGEKEPPPFDHEDARAQLLQVLADGKLSRANADIVIYAASDVIKLLGDDAAGKQALQQAWGRQLAALEADATLSWGDRLGATSALLSQFKQQHPKQPLPASLLADVRSQVAAADKASANPYQRQAVITAAGELLADAGLLDESDKLLQAELKTSHAPYYHMLILASNAKERGDKAAALAWYEKAYQASEGQATRLQWGASYVSNAVELAPQDADRIEKAASEVFSDAGRSSSAFYERSRRSLEKIASRLKAWNQDQKHADEIGRLAGQLNGVCEKLPAGDAQKPVCDGLVKNLKS

SEQ ID NO: 7376 - protein, 59 aa, Chromobacterium substugae
MPVKNRKHRILLLSSLLALCLIGQILSYRTVNLSSLCAGAIIGILIAQLSAELDALRAV

SEQ ID NO: 7377 - protein, 138 aa, Chromobacterium substugae
MQARLKWVDGVCFMGESGSGHAVVMDGAPEGGGRNLGPRPMELLLLGTAGCTSYDVITILKKSRQQVTDCWVEMEAERAGAEPKVFTKIHFHFVVTGKELKPDVVERAIKLSAEKYCSASIMLGKTADISHDFELREA

SEQ ID NO: 7378 - protein, 341 aa, Chromobacterium substugae
MLVLGIESSCDETGVALYDTEQGLLAHQLHTQMAMHAEYGGVVPELASRDHIRRAIPLTEACLQDAGKQLADLDAIAYTQGPGLGGALLVGASMANALAFGLNIPVIPVHHLEGHLLSPLLADPKPQFPFLALLVSGGHTQLMAVRGVGNYEILGETVDDAAGEAFDKTAKLLGLPYPGGPLLSKLAESGNPGRFTLPRPMLHSGNLDMSFSGLKTAVLTLTKQVEAEHGAIDEQARMDICRAFQEAIVEVLVKKSLAAMKQAGMKRLVVAGGVGANKQLRAALDDAAARRKFEVFYPPLALCTDNGAMIAFAGAMRLKFAEPAGGYSIKPRWDLSSLPAV

SEQ ID NO: 7379 - protein, 631 aa, Chromobacterium substugae
MIQLKNLNLRRGLKELLVGANLTLNPGYKAGLTGANGVGKSSLFAMLLGELHADGGDALIPPNWTLAHVAQETPALERSALDYVLDGDKELRSLEAQLAIAEGKHDGNAIGHLHGELANIDAYSAPARASKLLTGLGFDEAGQQRPVASFSGGWRMRLNLAQALMCRSDLLLLDEPTNHLDLETVLWLEDWLKSYPGTLLMISHDRDFLDSVCSHIVEVANQSLTLYTGNYSQYETMRAEKLARQQGEYEKQQRQIAHLESFINRFKAKASKATQAQSRIKALEKLERIAPAHVSSPFDFHFDSPDNLPNPLLKLEKANAGYGDKIILSQISLSVESGARIGLLGVNGAGKSTLVKLLSGDLDPLSGERVNAQTLKIGYFAQHTLETLRPEESPLQHMQRLAPTARELELRSFLGGFNFRGDNATDPTGPMSGGEKARLALAMIVWQKPNLLLLDEPTNHLDLEMRHALTLALQDFSGALIVVSHDRSLLESTTDVFWLVSGGKVQPFDGDLEDYRQWRIAQLAEGSQPSSGDAQGVNRKEQKRQEAEARQQLAKQRKPLQNRLSKLEQEMNKLSEEKSQLEAFLSSSEAYDDANRQKLADSVKRQGEVAGRLETVEEEWMDVQEQLEAME

SEQ ID NO: 7380 - protein, 289 aa, Chromobacterium substugae
MSWLNKLLPPKIKRENRADKPSAVPEGLWSKCPECEAVLYYTDLESNLQVCPKCSHHHPLTARQRLSLLLDEEGRREIGEEVRPVDILKFKDSKKYPDRLTAAKSDTGEDDALVVMQGSIHSLPAVVAAFEFRFIGGSMGSVVGERFVRGVQAAVEAKVPFICVAASGGARMQEGLNSLMQMAKTSAALQLLSENKLPFISLLTDPTMGGVSASFAFLGDVVLAEPKARIGFAGARVIEQTVRETLPEGFQRAEFLLEKGAVDMVVDRRELKRKIAGLITLLMKEPSVA

SEQ ID NO: 7381 - protein, 262 aa, Chromobacterium substugae
MSRIAKCFADLAGKKALIPFITAGDPHPGLTVSLMHGLVDGGADIIELGVPFSDPMADGPVIQRASERALKHKVGLRHVLEMVAEFRRTNAVTPVVLMGYLNPLCAMGYAEFARRAKEAGVDGALTVDCPPEEAAELQAALDAAGLDTVFLIAPTTPPARVAEIAKLARGYVYYVSLKGVTGAGHLDIDDVARKIAALRQELPLPIGVGFGIRDAATAKAISSAADAVVVGSRLVQEIEAATPETAREQLTHLVAELKAAIR

SEQ ID NO: 7382 - protein, 400 aa, Chromobacterium substugae
MDRYDFPDAQGHFGPYGGVYVAETLMVALDELKAEYARVKADPTFWQEFHHELKHYVGRPSPIYHAKRWSEQLGGAQIYLKREDLNHTGAHKINNAIGQALLAKRMGKKRVIAETGAGQHGVATATVAARYGMECVVYMGAEDVKRQSPNVFRMKLLGATVVPVESGSKTLKDALNEAMRDWVTNVDSTFYILGTAAGPHPYPMLVRDFVSVIGEESKMQMPEIIGRQPDLVVACVGGGSNAIGMFHPYIDVPGVRMVGVEAGGHGIDSGRHAAPITAGAKVGVLHGAKSYLMQDEDGQVVETHSVSAGLDYPGVGPEHSHLKDIGRAEYVAINDEEALQAFHDCCHLEGIIPALESSHALAWAAKTAPTMSKDKVILVNLSGRGDKDINTVAGLSGITL

SEQ ID NO: 7383 - protein, 206 aa, Chromobacterium substugae
MVRIKICGITRAEDGAAAAALGADAVGLVFYPPSPRNVSLEQARAVIAALPPFVSVVALFVNPAREWVEQVLAACAVDVLQFHGEEEAEFCRSFRRPYLKAVRVRPGMDLLEWAGRYPDARGLLTDAFVEGAHGGTGATFDWTLLPEALPLPLILSGGLDESNIVEAVRRVKPAAVDVSSGVEASKGIKDAARMAAFISGARHGSV

SEQ ID NO: 7384 - protein, 264 aa, Chromobacterium substugae
MGMRIALGIEYDGRAFAGWQTQPHGNTVQDRLNQALSQIAGNQAISTVAAGRTDAGVHAAMQVVHFDTEAARPLNAWVRGVNALLPPEIAVVWAREVDETFHARFSAFSRSYSYFLLSSPVRPCLLAGKVGWFHQALDVDAMRAAAGRLLGRHDFSSFRASECQAKSPVKDLQQLDIHDNGGLLRFDLKADAFLHHMVRNIVGALVYVGKGAMDADGMSALLAACDRTSAPPTFMPDGLYLTGVGYPEPFALPSQFAAERLALR

SEQ ID NO: 7385 - protein, 684 aa, Chromobacterium substugae
MDYKRDGPRRKEPAPASGDDGKRHVASPDQGSRLDGAGLGELKVSSRLGEPLQAELRLLGGVFDKTDQVQVAIFADPAQGEVAPEQLQQVASIAHKLDRSSDGRHVLQLASSLPITAPRLAFRLEVRAAGVKVEKRYALMLEGAPTAQDSAADHAKPPSAAAPETRVYQVRKGDSLSAIAARMRGHAAGEDVAGKLLKDNPDAFIRGDANRLLAGAELRYPAQWTLRGEPARHAAEKGDAAGAEAKSGSMAKLLADGRPAGVAKAEDHKPMPSVASVKPAASSPAALAAERRMRDMLAMQDRALKQTEARARALEAQIRTIQQNKDKTAAAMTPPMPPQAKPAVPPPAAVQTPPASAARSEPPAGMDKPKPAVVVTAVTASAPRPAMSPAESKREQAKAPHAAASSVVDDALAVLGDRDVQLRLGGAGAALALVALLLMRRKRAGAAQAEAETADRRRQRRAVLYADAGAADLADEHAEKRRRHRSGFGRSDGRGRGVLAYGRDDQVLLILREGLEKEPARQDLRYKLLEVLSAQPDKAAFLEEAARSRDIFGKDSTQWMRVCELGRAAMPGHPLFETAQAPQSVEMPAVGALEPVVPSAAAAAEIAMPEEARTPLPPTAAPAVAETMIEAEREPAPLRGAPAAPELEAEPRPDPEKLELAKLYMEMGDKETAEILIREAQQGR

SEQ ID NO: 7386 - protein, 60 aa, Chromobacterium substugae
MYRPQSRPDCRYASQACQQQGQTRHAKICDHRGRPQPICLHVLPQARRICPPSRSALAPS

SEQ ID NO: 7387 - protein, 723 aa, Chromobacterium substugae
MGRIHVRSNLGELLKADIEMTGVQPGEMDAVRVGLASIDTFQALNVDYASSLSQLRFALSPNPRGALIRVSSVQPITDPYLRFVVEAKAPSGRSVREYTVLLDPANYNVGGPNIVQDVPSYADSDQAGRYQAAAPAKPRVVEPTVLKVRPGATLRSLAQRVKPWGASLRQTMAALVQANPDAFAEGDVNHPKPGSSLTVPSARKMKALGAAQVASILGDAAPAAASAGGQSAAPAGKGGDVLKLVPGDGSDNARLNDLQQQINAREKALQEASARITALEQELKAMRGGQPLPAKPVMASAPMAVASVPAAAPAASAPKPMPKPEPAPHPLKKPAPAHAAPPMPPPNKSLLDKLLDHLPLIGGGVGVVALLGLLGAVVMRRRAAAGSLSATSATLARSTVTGHGPSTVGGSHSFMSNFTQAAGAIDAAEVDPVAEAEVYIAYGRDQQAEEILKDALQKDPSRHEVRMKLMEVYAARPDTAAFERLAKEMNAAFDGKGGLWARTVTLGRAIDPDNPLYQMAPDAELDLSAGLGGGIDLDQELFGEAAPDAPPAAESAPAMAEEADPLAALFDTPAGQAPAAEDQGGTLDFDLEAMLPAEAAPVAAEEPAPAGEASLLDFDFNLDAPPPEEAKPAAEGGGGLESLYEDMLAEAPAAEAPPAEEPPAQAEGMSVMDDPLSTKLDLAKVYLDMGDREGAREVLQDLVSEAQGALKEEAKALLDKISV

SEQ ID NO: 7388 - protein, 336 aa, Chromobacterium substugae
MSTSLQLAVVGATSLVGQAILELLAERNFPAARVFAVDVAEQDGSTVSFGNLELDVHMVDEFNFENVGMAIFAAGSAVSREYAPQARDAGAAVVDFSSAFRADAGVPLVAPAINAAELEDLGRAPLVAVPNCTTTPLALALAALLPLGVQRASIATYQAVSGSGQAAMEEMADQTTALFSHRDAEVKAYDKRIAFNVLPQIGELDENGDSEEERSVRDETARLLGLAPESLEVTCARVPVFFGHSWAVQVELHKEFDLEQVKKRLQAAGLKVVGRDQHGGYVTPMEATGNELVWVSRLRAHGKVVSMWLSADNVKAGAAIHCVRIAEILAGQSALM

SEQ ID NO: 7389 - protein, 370 aa, Chromobacterium substugae
MRVGFVGWRGMVGSVLMQRMREENDFAAIDEPVFFTTSNVGGKAPDIGREVPALKDAGNIDELKAMDAIVTCQGGDYTSEVYGKLREAGWKGYWIDAASSLRMQDNAIIILDPVNQNVIEQGLASGVKDYIGGNCTVSLMLMALGGLFQNDLVEWATSMTYQAASGAGAKNMRELLTGMGAIHGQVGDLLADPASAILDIDRKVSDFLRGDGFPSQNFGVPLAGSLIPWIDKDLGNGQSKEEWKGGAETNKILGRGANPVPVDGLCVRVGAMRCHSQALTIKLKQDVPLDEIEAMLAAANPWARVVPNTREASMRDLTPAAVTGTLRTPVGRLRKMAMGGEYLSAFTVGDQLLWGAAEPLRRMLRILIER

SEQ ID NO: 7390 - protein, 393 aa, Chromobacterium substugae
MSDYDLIIIGGGLIGLSTAYNAVSPYGGHPVLQGNKVLVLEQSTFFNQFCSSAGASRQFRFQYSETYMTQLVMAAVPEWELPQSQTVTQPIPCVGSLWFGDPNTPTTEGGIAPAIETMQAMGVPFQSLTRAEVEEWYGFRDLPANYSGFFQRDGGVINLPATLRAMYNLAHDQGVQLKEEQKVIDIESSGGQITVTTDAGAYRGKKLVITAGAFTNEVIAPLGIQLNLTIWNMVSAYFRKTRADIDYPTWFAFQQPTAANANLYYGFPETSWSHPGYIRVAPDYPYQIISDPRERRPPTPQDYAGTCEWVAQHMSGLSPEPEYASACMVALADDGKEFILDTLPGHPNIVLYTAGWAAKLVPLLGKICVQLAINGATDYDISPFSIGRPGLVR

SEQ ID NO: 7391 - protein, 584 aa, Chromobacterium substugae
MITLNDIPHSTGSQADLAVDVAVVGAGVGGLYTGYRLLGGEYKPGGSRPTSVHVFDLADRLGGRLLSIKLPGMNVIGELGGMRYMRSQEMVTALIEDVFKLPNQEFPMGEPDDLYFYLRCQRFKANAWTSAQAQGEKFHVRYTFKLGEEGYSPDQLFNKIVYDVLMADPWFVAEFGDKVKKIDQYTYTFQLTSREWNIVKPALTYVFPDSPFRGMKVNDIGFWNLIKDQVGQDAYSFLADGGGYYSNTINWNAAEAFPYMVGDFSSADSSYRTISDGYDQIAYALAQSFTDMSGAKLWLGNRLETFSRAQDGSGYRYLLTFWNAAGQYRWTVKANNIVLAMPRRSLELLDQQNFFFNREGAQQLQKNIASVIMEPSFKLLMGFEEPWWTEDFGAESGHSITDLPMRQCYYFGTDPANNHSLFLSSYNDMRTVPFWQVLMQGRDKLPRYLGHTTRLVRQEHLEALAKEPGEPAPIAMVEEAMNQVRELHGKGNEIPPPYVARLQDWTQDPYGGGYHAWCADVSVQNIMPYMRRPDHGENIHITGEAYSDDQGWVEGALCVTELMLQEWFDMAWPAWLNRDYYLGW

SEQ ID NO: 7392 - protein, 38 aa, Chromobacterium substugae
MRFHEPLIVHRVDDDAYVSDDYGRDNAGQTRVLIQAAN

SEQ ID NO: 7393 - protein, 354 aa, Chromobacterium substugae
MKIAILPGDGIGPEIIAQAERVLDVLRRDGLKIETEHAPLGGAAYDQYGAPYPEATQKLAREADAVLLGAVGGPQYDKLERPLRPERGLLAIRKDLGLFANLRPAILYPELANASTLKPEVVAGLDIMIVRELTGDIYFGQPRGIAVNELGEREAYNTMRYSESEVRRIAHVAFGIAMKRGKKLCSVDKANVLETTEFWKEIMIDVAREYPQVELSHMYVDNAAMQLVRNPKQFDVMVTGNIFGDILSDEASMLTGSIGMLPSASLDQNNKGLYEPSHGSAPDIAGQNLANPLATILSAAMMLRYSFGQETAAQRVETAVKKVLAQGYRTGDIYEAGCEKVSCSGMGDAVVAAM

SEQ ID NO: 7394 - protein, 93 aa, Chromobacterium substugae
MAWLHRHPLAAFLLLGLSFLLFGVGTINLALLLQLNLKLWLDAGWQAAMDGALRQLGELLLSGYAAMAAYIVFKCCEKALVERLTWREEDKRK

SEQ ID NO: 7395 - protein, 193 aa, Chromobacterium substugae
MGQRYLELKDSHREFIAGQKLFFVATAMQDGRVNMSPKGMDSLRVLGPNQVAWLNVTGSGNETACHVEHSPRMTLMFCAFEGKPLILRLYGQARAIHQGDPEWADYYGLFEPLPGARQIFLLDVGLAQSSCGMSVPYYQYQGEREQLNDWARTKGEAGVQDYWRSRNVSSLDGLPTGIVEKSGLASADETRQQ

SEQ ID NO: 7396 - protein, 212 aa, Chromobacterium substugae
MKAFTTLQGLACPLDRANVDTDAIIPKQFLKSIKRSGFGPNLFDEWRYLDHGEPGMDNSKRPLNPDFVLNQPRYQGAQVLLARENFGCGSSREHAPWALDDQGFRVVIAPSFADIFFNNCYKNGLLPIVLDAGTVDQLFRECEAAPGYSLTVDLAAQTVSTPSGQAFPFDITEHRKHCLLGGLDEIGLTLRHADEIKAFEAKRRAEQPWLFA

SEQ ID NO: 7397 - protein, 61 aa, Chromobacterium substugae
MKKEIVWIGLALLLAACNTVQGIKTDAKEGGQAVGHGLQKAGQAIGNAVEKGGEAIKRTAE

SEQ ID NO: 7398 - protein, 471 aa, Chromobacterium substugae
MTAQTLYDKLWNSHLVRQEADGTALLYIDRHLVHEVTSPQAFEGLKLAGRQLWRVDSVVSTADHNTPTDHWDQGIQDPISRQQVETLDANIQAFGALAYFPFKDKGQGIVHVMGPEQGATLPGMTVVCGDSHTSTHGAFGALAHGIGTSEVEHVMATQCLVAKKSKNMLVRVDGKLGAGVTAKDVALAIIGKIGTAGGTGYAIEFGGEAIRGLSMEGRMTLCNMAIEGGARSGLVAVDDKTIEYVKGRPYAPKGEQWEPAVAYWRTLHSDAGAHFDAVVELDGAAIQPQVTWGTSPEMVVEVGGKVPNPARESDPVKKAGIERALAYMGLQADTPIDQIPVDVVFIGSCTNSRIEDLREAAAVAKGRSKAANVKQVLVVPGSGLVKAQAEAEGLDKVFAAAGFEWREPGCSMCLAMNADRLLPGERCASTSNRNFEGRQGQGGRTHLVSPAMAAAAAVAGHFVDVRQWSVR

SEQ ID NO: 7399 - protein, 258 aa, Chromobacterium substugae
MESPSATPLGAFLRAHRERLTPQQAGLPTGTRRRAKGLRREEVAQLAGISPTWLTWLEQGRTESVSAHTLTRLAAALQLSGAETDYLFDLAGLKNPKDKRAEDNPQARDILAEMLPHIAIPAYVLDRHWRAAAWNPAAAELFCGWLGKPEASRSQLDFIFLAPEARTFLDNWPERARRIVAELRADLGQQLDDAETADMLERLRRDSAEFDRLWQQQDVLEREGGERAFHHPTLGQLNKRQITLRPANAPEFKLVMLL

SEQ ID NO: 7400 - protein, 125 aa, Chromobacterium substugae
MAMTPQQALDSYQQALATHDWRQVAPWLHEDACFVFSDGTFKGKAAVCEAIRQTFDWIRGEDYRIADLHWTHAGENFAACVYAFSWRGLVDGQPAEGRGRGSCALIKDGQGWRLLQEHLGPPAES

SEQ ID NO: 7401 - protein, 382 aa, Chromobacterium substugae
MQSLLPFAGFYFTYFTFQGMFSPFWGLYLESLSFSALQISVLMALSTLARIIAPGFWGWLADKSGQRRNIIVTTSILSAASFCLVGLHNGFWWIFVSMAVSHFFWAAALPLVEASTAYLTRAQPGRYSRVRVWGSIGFVCLALTGGYLLDWLGIAATPWIVSALLIGVALTALKVPEVKLASRGKPAGPIWDTLKKPAVIALFACCFLQAFAHGPYYTFYSLGLKQFGYDKAAVGVLWALGVVFEVGVFMLMPRIMRRFSLEALMLASLLAAVLRFGLIAAGLSLPALAAAAQALHALTYALHHASAIGLINRMFDEQHHGRAQGLYIIASFGLGGSGGGLVGGLVWPHGGVLPTFAMSAGAALAGVFVCLRWLRPKRQACQ

SEQ ID NO: 7402 - protein, 134 aa, Chromobacterium substugae
MARPEEQDDGKVRLDKWLWAARFFKTRQLAHEALELGRVLVNGDRVKASRVVKEGDRLFLRINQLEYNVEVLQLATQRRPAKEAVLMYREDAESVAAREARMLLLKAEHASFPHGDGRPTKKARRDISRFKSSF

SEQ ID NO: 7403 - protein, 216 aa, Chromobacterium substugae
MASVKLALHTIRVENIFCIGRNYAAHAAELGNPVESEPLVFLKPTSALLDESSPIHLPEYSDDVHHECELVVLIGKGGGDIAPEQALSHVAGYGVGLDLTARDAQSAAKSKGHPWTKAKGFRGAACLSALVPAERVADPQRLQFELRVNGQLRQAGDTGMMLFTVAQQISYLSRTYGLSAGDLIYTGTPEGVARIRSGDELDLSLHGQVSAHWKVA

SEQ ID NO: 7404 - protein, 587 aa, Chromobacterium substugae
MSQNNTATLEDFFTGLSEANQQWMQQFVNSLSLGASPDSAAHPLAGAWSQLMNQTNQLFSLQSALYQQQLNLWSQFLGKAADTAPEAKAGDRRFASPEWNEHPFYSFLKQSYLLTSKWMTELVDQTQIDENAKDKLAFATRQYLDAMAPSNFMLTNPDVVKRAIETKGESLVEGMKNMMEDIQKGHISMSDESKFEIGENLVITPGQVVFRNELIELIQYTPTTEKVYEKPLLFIPPCINKFYLMDLQPDNSMVRHFVAQGYRVFLVSWRSAVAEMKHFTWETYVEKGVIAAAEAVRKITKQPTMNALGFCVGGVILSTALCVMQAKGLDYIDSATFMTSLIDHAEPGEIAYYIDESLVASREAKLAAGGIISGKEIGRTFASLRANDLVWNYVVNNYLLGKTPTPFDLLYWNNDAVDLPLPMHTFMLRQFYLNNALVKPGAITLCGVPIDISKINIPVYMFAAREDHIVLWSSAYSGLKYLSGAPSRRFVLGASGHIAGSINPVTKDKRNYWVNEQLPISSDEWLEGAQSQPGSWWKDWDAWLAPQSGKQVAAPKALGNKELPPLLAAPGSYVLAKAMPSVTASLQ

SEQ ID NO: 7405 - protein, 392 aa, Chromobacterium substugae
MEVAIVAAQRTAVGSFGGSLAKIPAPELGATVIKALLEKTGVKPEDVSEVILGQVLTAGSGQNPARQALIKAGLPVTTPATTLNVVCGSGLRAVHLAAQAILAGDAEIVIAGGQESMSLSPHILPGSRDGFRMGNAQLVDTMVNDGLTDAYNAYHMGITAENVAAKYGIGREEQDAFALQSQQRAAAAQKAGKFQNEIVPVLVPQRKGDPLAFDADEFIKHDASAEGLAKLRAAFKKDGTVTAGNASGINDGAAAVLLMSTQKADQLGLKPLAIVKGYALTGCEPEIMGIGPVSATRKALAKAGWTVEQLDLVEANEAFAAQALGVAKELGWGSDKVNVNGGAIALGHPIGASGCRVLVTLLHEMQRRGAKKGLATLCIGGGMGVALAVERP

SEQ ID NO: 7406 - protein, 183 aa, Chromobacterium substugae
MKVIDTSIPDVKIIEPTVFGDERGFFFESFNLKRFEEGIGRAVDFVQDNHSKSAKGVLRGLHYQLPPYAQGKLVRVVAGEVYDVAVDIRKSSPTFGQWVGVVLSAENKRQFWIPEGFAHGFLTLSDEAEFVYKATNYYMPQYDRGILWSDASLGIDWPAAGELNLSAKDKAQPLLGAAEVFLS

SEQ ID NO: 7407 - protein, 295 aa, Chromobacterium substugae
MTQARKGIILAGGSGTRLYPATLAVSKQLLPIYDKPMIYYPLSTLMLAGIRDILIISTPQDTPRFQLLLGDGSRWGLNLQYEVQPSPDGLAQAFIIGEAFLAGAPSALVLGDNIFYGHDFAKLLTEASSQTAGASVFAYHVQDPERYGVVEFDAAGVARSIEEKPALPKSNYAVTGLYFYDSQVVEIAKSIQPSARGELEITDVNNVYLQQGLLNVQTMGRGYAWLDTGTHESLLDASQYIATIERRQGLKVACLEEIAYRSGWIDDEQIVRLATPLKKNGYGQYLLAMIGAKNS

SEQ ID NO: 7408 - protein, 301 aa, Chromobacterium substugae
MLLTGADGQVGFELRRALAPLGEVTACGRARMDLADEAAILAVLDAAKPDIIVNPAAYTAVDKAETDRDAAFAVNAAAPGVLARWAAANGALLIHYSTDYVFAGDKPAPYREDDETGPQSVYGASKLAGEQAVRAAGARHLILRTSWVFGAHGGNFLKTMLRLAQERDALKVVGDQFGAPTCAALIADVTAQLIARYHARPENFADGTYHLAAQGETSWHGYAQRVIRRAGERGFPLRLTADAIQAIGSDQYPLPAKRPANSRLDCGKLMRAFSLGLPRWEDGVDGVVDQLYALSQAEGAV

SEQ ID NO: 7409 - protein, 355 aa, Chromobacterium substugae
MTIIVTGGAGFIGANFVLDWLAGSDEQVVNLDALTYAGNLETLASLKHDRRHVFAHGDIGDRALVDRLLSEHQPRAVINFAAESHVDRSIHGPGDFIHTNVVGTFNLLESVRGYWNGLPEAAAKAFRFLHVSTDEVYGTLSEQEPPFAETRRYEPNSPYSASKAASDHLVRAWHHTYGLPVLTTNCSNNYGPYHFPEKLIPLVILNALAGKALPIYGDGLQVRDWLYVKDHCSAIRRVLEAGRPGETYNVGGWNEKPNIDVVRTICAILDEMRPKVGGGSYADQISHVQDRPGHDRRYAIDARKLEKELGWKPAETFETGIRKTVRWYLDNQDWVANVSSGAYREWLAKQYEAQA

SEQ ID NO: 7410 - protein, 42 aa, Chromobacterium substugae
MPANRIIHASAPLDSAQSGNGRRPTSLVECAVWRARPKYAIS

SEQ ID NO: 7411 - protein, 152 aa, Chromobacterium substugae
MSANWIGIGALAKRSGVAASALRFYEAKGLIQSVGEAGQPRRFHKDVLRRVSFIRIAQTLGLSLQDIGEALAGLPRQRTPTAEDWARLSSAWRPMLQARIDTLCQLRDQLDSCIGCGCLSLRKCKLNNPADHAARLGDGPRFLLGDAPVDTA

SEQ ID NO: 7412 - protein, 197 aa, Chromobacterium substugae
MAHTLIVYFSAEGSTHQLACAIRDGAAAYGGASLLRLEPRHIVDGRYAPPAMAASAESLRRADAVIFGSPTYMGGPAAQFKAFADAGSAYWRGQPWTDKVAAGFTIGSSLNGDQQGTLSYFATLAAQHGMLWCGLDLPGGKHIDDLNRLGCQLGLCAHSADGSLHPADLATARHLGARAARVADRLRRNALLEENAP

SEQ ID NO: 7413 - protein, 135 aa, Chromobacterium substugae
MTPAIQRIDHIHVHVSDREQAEAWYRRVLGFERIPELAFWDADGGPLTLANRERTVKIALFERGGAGKQPAVALEVEADAFQAWRRHLKQALGHAPELADHAVSWSIYFADPDGNGYEITCNDYAALAQRLRACP

SEQ ID NO: 7414 - protein, 42 aa, Chromobacterium substugae
MSKSRHSTKEAKKQPLMSPKEKRAAKHQKKHAPDGTPIIVPH

SEQ ID NO: 7415 - protein, 602 aa, Chromobacterium substugae
MNTLATPQLDTVPQRIASLRAAMRNAGVDACLVPSSDPHLSEYLPKRWQARRWLSGFTGSMGTLIVTADLAGVWADGRYWVQAEQELAGSGVQLMKIDTAASSQHLQWLADTLQAGQTLAVDGDVLGLAAAKALQAALAPRGIQLRTDIDLIDAVDPQRAPLPDAAVYQHEAAFAPQSRADKLARVREAMRQAGAERHFISTLDDIAWLFNLRGADVNYNPVFISHALIEADRATLFVAPGKVDAALAAQLAADGVRVADYAAAKPALAALAGGALLIDPRRVTLGLRQAVADGVKVIEAINPSTLMKSQKTAAEAAHVRKAMEQDGAALCEFFAWFEANVNQSRITELTIDEEITAARARRPGFVSPSFGTIAGFNANGALPHYHATPEAHSEIKGDGLLLIDSGGQYLGGTTDITRVVAVGAPSAAQKRDFTLVLKGTMALSMAHFPRGTLSPMLDALARAPLWQHDIDFGHGTGHGVGYFLNVHEGPQSISRAVPEPHMAMWEGMITSIEPGVYRDGQWGVRIENLVLNVASEKNQFGDFLKFETLTLCPIDRRCIERSLLTQPEIDWLNGYHAEVRARLLPLVDGAARDWLLANTEAL

SEQ ID NO: 7416 - protein, 313 aa, Chromobacterium substugae
MGMACFVFQKAPMPFDRLNDLRLFLDAAQLGSFSAAGRKHGLSPAAASACIQRMEAALNVRLFQRTTRQLKLTEAGDTYRAYCRQALELLEEGESRLQQEQQALSGAIRLSAPSDLGRNRLLDCLDRFGAEHPGVYFSLSLDDTPVDLIGEDVDLAIRYGKPADSSLVARELAASRRVVCAAPGLLARLGAPAHPRQLAGLPTLTLATGHGPMNEWRYRERGEARSLRLERARQSNDGEVIRRWAVQGHGFAYKSQLDIEPDLRAGRLATVLDDYFTEQAPLHLLYPGQRLQPARIRRLIDHLLETFAGTTQK

SEQ ID NO: 7417 - protein, 133 aa, Chromobacterium substugae
MTPSFLATGNLLPLLQQMEQTLHQPAARADAALLERWLDDDFREIGRSGRQYDKAAIIAALLRENPDASAATHSSDYRLTLLAEDIALLTYHSAHAGPDGALSGHALRSSIWKRVNGAWRLAFHQGTPAPSSY

SEQ ID NO: 7418 - protein, 100 aa, Chromobacterium substugae
MTVWIAMAIGGLAFSALCRDARLKRKVSRIVMIAAPLLFCLFAWHQGAQASEFAIFLPFLALITFLNLRNTRFCDACGATQHNRGFSRPRHCSQCGASLP

SEQ ID NO: 7419 - protein, 216 aa, Chromobacterium substugae
MSDGDIQGRMFDEFAELARTVGNAHRLLLLEHAAQGERPVERLAQLAGLTVANASQHLQQLKRAGLVASRRDGKHVLYRLGDGPVVNLLDALRQCAEHRRREMGRLSAGADGAEAVSREALLERLRDGDALLLDVRPADEYAQGHLPGALNIPLEMLPQRLAELPAGLEVIAYCRGPFCALSVQAVAALRAGGLAARRLADGFPDWKAAGLPVEMS

SEQ ID NO: 7420 - protein, 167 aa, Chromobacterium substugae
MDIGLESLRWAVPIGIGATLLMDGWAWLQNRLLATPSLDYALVGRWIGHLARGKLSHPSIAKAAPIRGEAWLGWSAHYLIGILFAALLLAVAGPEWARRPTLAPALLTGALTLAAPFLILQPGMGAGLAARNTPQPNAARLRSLSAHMSFGIGLYASAGMLCALAPF

SEQ ID NO: 7421 - protein, 450 aa, Chromobacterium substugae
MPIVDSEQTASQYSQDRTRMKNMFLLGLSLASAPIASLAAAQAEPQTAEQQVDRYGSQIFRDSRAVGMVMVVVDKKQTLQRFYGQTRPGSRQKPDADSLLRIASISKTMTGEVLSSLALENRVKLDDPLQKYAPQGMALPQAGQSITLLNLATHTSGFPREMPGSKPQDTPVFVWPDQQQRWSWLSASKARFAAGEKAQYSNLAFDFLADALAVATGRPYAALLRDKITAPLGMKDTTLNPTAAQCARLLEGFGASPCVNTTAASGSGGIYSTPRDMQRWLQDLVYPQDAARKQLRDQMFRMYFKRDDLRSLRGMDVAGQADELGLGWIRMQEKPDAPEIIQKTAGGGGFIGYVAIAPKHDVAVWVALTRSGGTHYHNMSGGANKLVAELSGYQPAALVAPKPVAARKTAAHKAVVSKPAARKTAAHAKPAARKAAAGKKTHKKHKPANS

SEQ ID NO: 7422 - protein, 324 aa, Chromobacterium substugae
MSNDFSINRRQFLASASAGSVGLLLAHGDALAANGASKNMTQLESGKTGFWPGDARLVISISMQFEAGAQPERGASGPFPPLDPKYADLPMQSWYDYGVKEGIPRLLDLWDRTGVKVTSHMVGQAVDRNPQLAKEIVARGHEAAGHGQTWEPQYSMTPQQERDAYRASIASIERATGTRPTGFNAFWLRGTPNTLGILQELGFVYHIDNVSRDEPFTVPVNGKPFVVVPYTLRNNDIVRYDSPALSNEAYLADLKAEFDLLYREAGQRRRMMSISTHDRISGSPARVKVLEDFIRYAQGHDGVRFMRKDEIARFAQRASGVPAF

SEQ ID NO: 7423 - protein, 235 aa, Chromobacterium substugae
MSLNADFLRQRSVVVVGGGSGIGRAVAQEAADAGAQVYVLGRSPTVSGPWQSLRADVTDSASLDAAFAEIGRIDHLVLTAGARVGSPTLAAVEWADFERTFNVKLFGAVLAVRQALPYLAADASVTFTSGLLSRKYGAGGLLKSTVNAALEAAAKNLAKELAPRRVNVVSPGVVDTELWGPDGAESRQAAMARIGAGLPLGRVGRPQDLAQAYLFAMGNAFLTGAVLDVDGGGLL

SEQ ID NO: 7424 - protein, 175 aa, Chromobacterium substugae
MNRLPHILTAGLLALLAGHAAAGEALPQPQRVFSERNGGAAAAVKLAAMRYAAFWNTGDPSYAELALDPDFIDRTLPAGRRQGVAGPLQASNAFRAAVPDLKVEVTDMILAGDRVSLRLHFTGHFTGKFGDAQGAGQAVDFQAFDLYRVKNGRIAENWHLEDNLTLLKQLGVVKP

SEQ ID NO: 7425 - protein, 55 aa, Chromobacterium substugae
MSANVSTNAQALVLKKAMQADSQTAMTLLQGAAESSAQIQASNPAHLGNNVDVRA

SEQ ID NO: 7426 - protein, 317 aa, Chromobacterium substugae
MSATRHNPLLILGSGPAGYTAAVYAARANLKPVLITGMAQGGQLMTTTDVDNWPADAEGVQGPELMQRFQQHAERFGTEILFDHIHTTHLSEKPIRLVGDAGEYTCDALIIATGASAQYLGLPSEEAFSGKGVSACATCDGFFYRNQDVAVVGGGNTAVEEALYLANIAKHVTLIHRRDTFRAEKILVDKLMSRVAEGKISLKLNATLDEVLGDNTGVTGVRVKLNDGGSEELALTGVFIAIGHKPNTDIFKGQLEMDATGYLITKGGRDGNATLTSIDGVFAAGDVQDHIYRQAVTSAASGCQAALDAERYLDSLK

SEQ ID NO: 7427 - protein, 211 aa, Chromobacterium substugae
MKTFKDSLKGLRQTLRQAAPPPAAPARPAAPEEPDFKQLFRDVKPLKPDGRHHPKPAKPSPRPRKPSQGPALHAAACQEILQHQIGWFEPAAQLHQYARPGMPAATLKRLRQGYWPQAAQLDLHGLDRYQAQDALALFLHRARQRGQCVRVIHGKGFGSQGAPVLKKMVRSWLQHHPDVLAFCEAESGMGGSGSLLVLLRRPSHADGHGDD

SEQ ID NO: 7428 - protein, 150 aa, Chromobacterium substugae
MTGTPCPDFTLPGTAGAEFQLASSDKPLVIYFYPKDNTPGCTNESMDFRDLHGEFAAAGAQIVGISRDSLKSHHNFKAKLELPFELLSDAEETACSLFGVIKMKNMYGKQVRGIERSTFVIDAHGNVAREWRGVKVPGHASEVLAFVKTL

SEQ ID NO: 7429 - protein, 485 aa, Chromobacterium substugae
MYPPGQPAGQQHEQGDHIMAGRKKTTACKLFVLDTNVLLHDPTCLYRFEEHDVFIPIITLEELDTHKKGMSEVARNARQASRFLDDIISGQELKITEGIPLKHASRDAASGRLILQTQAINGTLPSSLPMGKADNQILGIVMALKSHYQGRSVILVSKDINMRIKARALGLEAEDYFNDKVLEDTDVLYTGTREIDQNFWERNSKDIKSWQDHGRSYYQLSGSDCANLYVNQLLWQEGEKPFQARVIKVEGKTAVLETLKDYSHNKNNVWGITARNREQNFALNMLMDPNVDFVTLLGQAGTGKTLLTLAAGLAMTLEQKIYSEIIMTRVTVPVGEDIGFLPGTEEEKMAPWMGALEDNLDVLNKSDDDGGDWGRAATRDLIRSRIKVKSLNFMRGRTFLNKYLIIDEAQNLTPKQMKTLITRAGPGTKVVCLGNVSQIDTPYLTEGSSGLTYVVDRFKGWDHSAHITLQRGERSRLADHAGEVL

SEQ ID NO: 7430 - protein, 209 aa, Chromobacterium substugae
MTDLFREMSAGESDGNETIRGSNSPDSETLRGGAGNDVLIGSGDETTLEGGKGDDTLHGGSRSKDTYVFNLGDGNDLVIDDHVTVDSSRQSEIRFGAGIAQSDIVASQSGQDLLLQHVNGHDSIRVQGWFDWQRQQGTVKTVTFADGGSWSAGQLDQMAMNAAAGVPMASQAQALVGAMAAFNPPAAGQMSLSADYASEAPTLAASGWK

SEQ ID NO: 7431 - protein, 408 aa, Chromobacterium substugae
MKILLIHQNFPGQLRHIADDLKTRPGIDLLAVGRDTAPGLQGVRLLRYKPHRRPSRETHPYLISYEDAVLHGQAVLRSLQPLAHRGYRPDVILAHPGWGETLFLKDLFPNARLIHYCEFFYHGQGADADFDPEFPLSLDGAARLRARNALHLLNLENCDAGICPTHWQHSLHPAAYRAKLRVAHEGIHAERLGPDPSAALTLPNGRELRAGQKIVTYVARNLEPYRGFHIFMRALPDLLRAEPDCQVVIVGGDGVSYGNAPADAANWREKLLRENPVDPNRVHFLGKVPYEVYRKALQVSAAHVYLTYPFVLSWSLLEAMASGCRIVASDTAPLREVIRDGVNGHLTSFFDQEALIGRVREALRADDPAMRAQARRTAARYGVEPGIVAYRDLLGVGMRAERTFSHRT

SEQ ID NO: 7432 - protein, 473 aa, Chromobacterium substugae
MKQQIEALRDFLRRYRQAFAEYWSIRHQLDPKPRSEDELAFLPAHLELTDSPVSPLPRWSMRVIVALCLCMFLWALIGQLDIVAVAGGKTVSGGRTKIIQPLEPSVVKAIHVRDGQLVKAGQLLIELDATAAGADNRKAGDALETARLAAARYQALLAALDNGRLPQLEKLDGVDPAKQLSEETLAVGQWRAYQAKREALQATLRQREAELSTTRQQVRKLQGTARLAEAREHDYQELLDKNFISRHAYLDKQQARIEQQGDLASQQSRIQELAAAIAGQREELQALTANFRSDALGKLREAREQASQSGEEMKKTGRRQALTQLTAPVSGSVQQLAIHTVGGVVTEAQPLLAVVPANETLEVEAQIENKDIGFVRPGQAVTVKVESFPYTRYGYLDGVVETVSHDAQQDEKRGLLFPARIRLRQGHLLIDGARVNLSAGMAVSAEIKTGKRRVIDYFLSPLQEHIGEGMRER

SEQ ID NO: 7433 - protein, 714 aa, Chromobacterium substugae
MKYQSAQDVPEQVVPHDLGLLGLVLLAQFHGIAADPAQLSHQFGRSAERFSETDLLLAAKQLELKAKIVKQPLERIGLMALPALALAVNGEHFIVARCDGDKALIHDLKQGRPVVLSLDELAARYDGRLLVAASRASAAGALAKFDFTWFVPAIVKYRKLLLEVLGVSFALQLFALVTPLFFQVVMDKVLVNRAFNTLDVIAVGLLLLSVFNVVLSALRGHVFAHTTSRIDVELGARLFRHLLALPLAYYEARRVGDTVARVRELDSIRNFLTGQALTTVLDLLFSFVFLAVMFYYSGWLTLIVVISLPCYAAWSALLTPVLRRRLDEKFARGADNQSFLVESVGGIGTIKSMAVEPHMTRRWDKQLAAYVAAGFRVTRLANIGQNGVQLIQKLVTVATLWLGAKLVIGGDLSVGQLIAFNMLAGQVAAPVVRLAQLWQDFQQVGISVERLGDILNTRTELPASRAALPPIQGKIEFDQVVFRYRPDGPEILRKLSLEIRPGEVIGIVGRSGSGKSTLTKLVQRLYVPESGRVLVDGNDLALADPAWLRRQIGVVLQENLLFNQSIRDNIALSDPGMPLDAVIRAAKLAGAHDFIMELAQGYDTMVGEHGASLSGGQRQRIAIARALVCNPRILILDEATSALDYESERAVMQNMRAICQGRTVLIIAHRLSTVRGAHRIIAMDKGVIVEAGSHAELAQKPGGYYAHLHSLQQG

SEQ ID NO: 7434 - protein, 286 aa, Chromobacterium substugae
MRFAITLSDRFKPVLDVFLQAGWQPVKVFCTPVDHRMHHHKASLAFAEQRKLPLQLSPMQPRDLQELAEQGCEALLVASYNWRIPDWTPYLKYAVNFHPSPLPIARGPYPQVRALLEGHREWGATCHKVAADFDTGEVLAQERFPLSETESHQTLDVKLQLALYRLSRTVAHNFEASWRDAAPQAEGGSYWPLWSEQERMLDFTRPVADLQRQLRAFGDFECAATINNITIFIHRAEGWVESHGFAPGSLIYSQADQLLVAASDGMLLISEWSLYGPDAATGRLRR

SEQ ID NO: 7435 - protein, 451 aa, Chromobacterium substugae
MRHGIDLDKARAWHEREIRGFLARHPRSLALSERGRAHLLFGVPLHWMDDWPTPCSLFIAEARDAALTDADGLEYVDFCLGDTGAMFGHSPAPVAAAIAREAARGLTAMLPGEDALWVAEELSRRFGMAAWQFTLSASDANRFAIRWARAMTGRDQILVFNGCYHGTVDDVFVDLVDGAARPRASLLGQVYPLTEHTRVAEFNDLAALDAALADGRVACVLAEPAMTNIGMVLPDPGYWEQAQAIIRRRGSLLLLDETHTISCGPGGYAAAHGLAPDLLVLGKPLAGGLPAAAYGFSAELAQRAQQAKRAAPPGHSGIGTTLSANRLACAAMRANLAEVMTEDNYRIMFERAGRLAQGLRELFARRDLPWCVTQLGARCEFQFAPRPPRNGSEAGAWQDEELERCIHLHLLNRGLLITPFHNMLLMSPSTAEAGIARLLQAFDDWLDAAQA

SEQ ID NO: 7436 - protein, 51 aa, Chromobacterium substugae
MPRACLVQIDAVPHCHIRLAVRVSHAPSMPNPGGARQKARRGCAAPGQSLQ

SEQ ID NO: 7437 - protein, 71 aa, Chromobacterium substugae
MKIDDFNVVADLIGMKKRSREAVWLMEVEGMTGYSAAQQMDISESTVSRAHARFVRAIRQVNTLAGHLPLR

SEQ ID NO: 7438 - protein, 679 aa, Chromobacterium substugae
MEYLKITNHTNTYCEYFILNKNHYLQHYSNEFFHPPRSAGSPAIQQKHKETIMSMENQAAPDSRVINVRDSDSRTEIDTDPSLGRIADIHFPDTPDYTVRGMVRQGDDLLVQFGNNQQLALKGHYLGADHQFGKMSFQSYASWTYEMMTQRFGLSVEGAGPFHFTDAGETITGNDQNNALYGEGGDDVLRGGAGKDTLVGGAGADGYAFAPGDGQDIVDAYSAGAGRQDSIHISAPLSIVDKLTRQGDDLTLSYNQTDSITIKGFFLGADHQIASFNFFDAGQISALSYEELAQRFPPQILGTLGDDTLAGTDGNDLLQGGLGDDLLIGGKGDDTLEGGPGKDTLIGGRGNDLFVLRAGDGRDVIDAFDDSADRLDTLLFQDVSPDSIRNVRRQGDDLVFEYGPQQPYPGLGSQPDQVTLKGHFLGAEHQISQIAFNDGTRWSYEQLAAKLPIAVVGNDTSSHFTDANETIHGSGGDNAIYGMGGNDLLLGGLGDDLLDGGKGDDTLEGGPGKDTLIGGRGNDLFVLRAGDGRDVIDAFDDSADRLDTLLFQDVSPDSIRNVRRQGDDLVFEYGPQQPYPGLGSQPDQVTLKGHFLGAEHQISQIAFNDGTRWSYEQLAAKLPIAVVGNDTGRGPSIRQDELPELCQLDLRNDDPALRPERRRRGTVPLHRRRRNHHRQ

SEQ ID NO: 7439 - protein, 456 aa, Chromobacterium substugae
MLRGGAGKDTLVGGAGADGYAFAPGDGQDIVDAYSAGAGRQDSIHISAPLSIVDKLTRQGDDLTLSYNQTDSITIKGFFLGADHQIASFNFFDAGQISALSYEELAQRFPPQILGTLGDDTLAGTDGNDLLQGGLGDDLLIGGKGDDTLEGGPGKDTLIGGRGNDLFVLRAGDGRDVIDAFDDSADRLDTLLFQDVSPDSIRNVRRQGDDLVFEYGPQQPYPGLGSQPDQVTLKGHFLGAEHQISQIAFNDGTRWSGDELASRFAVTIEGKGGSYRFGDANDNVVGSAGNDTIYGMGGDDLLQGGAGNDLLNGGDGDDTLEGGLGRDTLAGGAGDDLYLHPRDSGDDLIRDNQGSNHLQLGEMSDSLWLSRRGDNLEISLPYAQGKDKVTVENWFRGAEHQLERISSADGKTLLAGQVDALVSAMAALGGDAPGASAMTQSLQQEPLHALVASSWH

SEQ ID NO: 7440 - protein, 162 aa, Chromobacterium substugae
MEDIDLLRLKLTSSLRPLGVLWRHIAQEALTAHGVSVSGGSALLFIGRLGEGVSHRALADELGMEPASLVRIVDQLSQAGLLRREQGLQDRRVKTLWFTDAGREVTRKIETELVALRARVLAPLSQADLEAALRVFQVLEQAAQTRVPDDPMLDPPHDRAAR

SEQ ID NO: 7441 - protein, 676 aa, Chromobacterium substugae
MIALPAKRDWLFSARTFAAAMLALYIALALGLPRPSWAMGTVYIVSHPLIGATRSKAVYRVFGTLLGAAAAVWVVPPLAGQPVLLSLVVALWSGSLLYLSMLDHTPRHYLLRLPAYTMPLIALSAVYAPENVFDIAIARSEEIALGIVCASVMAALVLPTRVSAVLSQRVDGWLKDAAAWATDTLGSAPQPPSAGRNRLAADLLAFDQLLTHLSYDAASRNAERTAGELRARMSMLPPLLSSLSGLQAELRNTPQGPSPALAQLMEAMADWLGYPVDNPWFLSQARALRRQLDDPPPAGGWPSLLESTVRMRLKSLVNLWQDCLTLRALISRGAPLWDWRPAYRRWEVGVKARHYDYGLLGFAAASAALGIFLGCLAWIALGWQDGANAVVLGTVACCLFGAMDEPAPMLRTLFVVNTVCTMLAGLLLFAVLPAVHEFEMLALCLAPPFLLGGALMNQPRFGPVAMLLVVFTANLIGLQQSYNADFQSFLNSNLAGAAGILFALVWTLATRPFGAELTLRRLIRANWRDLAQNAAGRHGGDYERLTALMLDRLSLLAPRLAADGADSSAGFRELRVGFSALDLQRDEHRLAGAAHQAVDAALQGVSEHFRACAEADRYLDAPGALLGRLDAAIALTLADAAPAAREARNALVEMRVSLFPDAAGCQPASPVSGAQP

SEQ ID NO: 7442 - protein, 66 aa, Chromobacterium substugae
MIGEINFYGVYFPSLLVMMLIAFAASSLLCRALARLDLYRAVWHRSLFNFALYLIVLGGTIALFHR

SEQ ID NO: 7443 - protein, 281 aa, Chromobacterium substugae
MLLTLATLAVAIVVVRHIWVYYTDAPWTRDGHIAADVVQVAPDVSGLITEVKVADNQLVKKGQVLFVVDRAHYELALRQAEAALAAQRATLAQARREAARNHSLADLVAAEAREEGDAKVQLGEATLAAAEAAVGVARLNLERTEVKSPVDGYLNDRTPRAGDYAANGRAALSVVDSHSFHVDGYFEETKLGGVELNQAVDIQIMGESRKLRGHVQSIAAGIENRDRSNGASLLPNVNPTFNWVRLAQRIPVRIALDEVPANFRLIAGRTATVSVRQGGRS

SEQ ID NO: 7444 - protein, 473 aa, Chromobacterium substugae
MKAALKLSALSLAGALAGCAAVGPDYHLPSQAALGKPAANAAFQSANHAAFAQQPVPAGWWRLYDDARLDSLVEEALTANADIRAAAANLRKAMAVEASVNAERDPHASVSATVQRSQDSGEAYLLEKKLPVANVGDGGLQIGYEIDLFGKLARAEEAARAGTQATEAAMDLARTTVAAETVRAYVQGCAAGHQLAVARHELDLQNRGVAVAKRMQSAGRGRATDVERAQAQADIQRAALPRLQAEQDAARFRLAALLGKAPAERPAAVCSALPQLKQPLPVGDGAALLKRRPDVREAERKLAAATARIGVATAQLYPSVSLGASAGFTGLLEHVGEDRTQRWSLGPLISWTIPDSGARARVKAAEADADAALAHFDGVVLNALRETETALTFYAKDLERNADLRSARDNAHAAAQDNRRLYAAGRAPYLASLDADRALAGNESALAASDAQVALDQVSLFLALGGGWEQAPR

SEQ ID NO: 7445 - protein, 305 aa, Chromobacterium substugae
MKQEVIFLSEGLELVGHLYRPADYQPEKRYPAIVVSHPFTGVKEQVAGRYAERLAQDGYLALAFDTAYQGESEGLPRHLETPHSRAEGIKSAVSYLSNLPDVDPGRIGALGIAAGGGYAVFTARTDPRIQAVATVNAVCQGSLLRDGLNGSRSSEQLQGLLAAAAEDRTAQDRGEAAATRSALAETAQAAAEQPQSLLREAYDYYRTPRGHHPNAENRFVLSGLDALAGFDAFARIDMLAQRPLLMIAGADADTRYFSEQAIAAATEPKELCLIAWASHFDLYDREPCVAAAAAKLQAFFDLSLA

SEQ ID NO: 7446 - protein, 123 aa, Chromobacterium substugae
MLAMSEKSNPCQSCGACCASFRVSFYWAEADDGGGLVPSHLTEKLNDWTRCMRGTWSASPRCAALQGEVGDSVGCGVYPLRPSPCREVEAGSAQCLKARASHGLPALRGAPAAANEAAPLLAG

SEQ ID NO: 7447 - protein, 415 aa, Chromobacterium substugae
MSEKAGRGVAIIGGGPAGLMAAEVLAARGCAVDVYDAMPSVGRKFLLAGIGGLNITHSEAYPAFVGRYGDRAQQIEPLLKDFDADALRAWVHGLGVETFVGSSGRVFPREMKAAPLLRAWLSRLREAGVRIHVRHRWQGWNADGSLKFDTPGGELAARADATLLALGGGSWKKLGSDGRWLPWLAEKGVATAPLAPSNCGFDAAWSDFFADKFAGEPLKSVGLAFQGGDGRAFQRVGECVITKSGIEGSLIYACSALLRDEIARAGSATCHLDLIPAWDEARVLAEVSHPRGSRSLSSHLQSRLNLKGARAGILRECLDKNSFQNPAALAAAIKRLPVTLKAARPIDEAISTAGGVSFAALDERQMLAALPGVFCAGEMLDWEAPTGGYLLTACFASGRAAGQGIADWLERHASK

SEQ ID NO: 7448 - protein, 542 aa, Chromobacterium substugae
MRKFSDWPIWLRLTGAIWTCLVLAWSGLIAWETQASRQIAVEQAKDLAHSMNEMTLAGLTGMMITGTVGQRDVFLDQIRELSAVRDLRVIRGDPVNQQFGPGNAGDKARAGDALERAALQDGKPRIEIESTPEQGEQLRVVYPALASPNYLGKNCMTCHQVADKTPLGAVSMRISLEKPYAAVDSFRTQSILFALLASLPLLAVVYLFIRRFVTRPLQEMSAGLAELAQGEGDLTRRLPAAHRDEIGTTASHFNRMLATVADLVRQVSDSANAVAQSSRSLSGGANQLAASSHRQNSQSLAAAEAVEQLASHIGEIAGQAEQVSNGAEESLQRSEQGRQSLRQLQQEVGQVQEAVQLMAQAESDLANSTAIITTMTREVREIAEQTNLLALNAAIEAARAGEQGRGFAVVADEVRKLAEKSAKSASEIDTVTGSLNSKTDAVRQAVAASLASLDASRQSADSVASVLAAGNQSVAEVRGGLRQIVEVTEQQRRTSQMVNESIDAIADMARTNDADIQQTVGAAEELEALAQRLTDSVSRFKV

SEQ ID NO: 7449 - protein, 460 aa, Chromobacterium substugae
MKPAAFSTLPLPAPLLSNLDSLGYHQMTAIQAASLPAILEGRDLIAQAKTGSGKTAAFGLGLLASLNPRWFGVQALVMCPTRELADQVAQEIRRLARAIDNIKVVTLTGGSPMGPQIGSLEHGAHIVVGTPGRLQDHLFRETLNLSGVKTLVLDEADRMIDMGFIEEIVGIVRACPKTRQTLLFSATYPEDIRKASSQFLRNPVEVKVESLHNADHIEQWFYKVKPETRLETVSRILRHLRPTSALAFCNTRERCKELVRELQEQGFNALTLHGDLEQRERDQILLRFANKSATVLVATDVAARGLDIKELDVVINVDVTHDPEVHIHRIGRTGRGEQHGLALTLATDSEAKRLVQIENYQQADLTWADVEELTPAPGGPLLPPMVTLEIAGGKREKLRPGDLLGALTGDAGFAGSQIGKINIFEFASFVALDRAIAEQALAKLSQCKIKGKQFKMRLVG

SEQ ID NO: 7450 - protein, 277 aa, Chromobacterium substugae
MSLQLTRLSPALGAVVEGIDLARPLDDEQRRAVNEALLRYQVLFFRGQDITPLQQRNFAVRFGDLHTHPIYPQHPEAREIMVLDTDVVDLQDNAIWHTDVTFIETPPLGGVLAARELPELGGDTLWASGIAAYEALSASLKARLEGLSAVHDFAKSFPLARYGVTDEDRRRWDETRRKHPPISHPLVRIHPESGRRALFVSEGFTVAVNDLPEAEGQALLQFLFAHQSRPEFSIRWRWQAGDVAFWDNRCTIHYAVDDYRPARRVMHRATILGDRPY

SEQ ID NO: 7451 - protein, 284 aa, Chromobacterium substugae
MGMSGIETTAEAELLSVSSRIEGSPRREREPSRLWLGVASLALLLGGWWLLAHSGWVPALFLPAPEAVLNKLFVVAGQGFMDATLWQHLEASLQRIALALMAAAAVGVPLGALMGRSRLAQGLLDPMLEAYRPVPPLAYLPLIVIWFGIGELSKVLLIFLAILAPVVIATRHGVAQVSRNRLRAAQSLGASRAQLLWLVVLPEALPQILTGIRIGLGAGWSTLVAAELVAATRGLGFMVQSAAQFLVTDVVVLGILVIAAVAFALELGLRALQRRLAPWHGQQD

SEQ ID NO: 7452 - protein, 261 aa, Chromobacterium substugae
MAALIADRVSVRYPGQAQPALDGVSLNVGPGELAVALGPSGCGKTTLLNLFAGFQFPDSGSVRFGGAPVTGPGAERAVVFQQHALLPWLNALDNVAFGLRLRGVPRAERRELAQKALEQVDLAEAGARYPWQLSGGQKQRVGIARALAGRAGTLLMDEPFGALDAFTREQMQELLLKVWAESGGSVFLITHDIEEALFLATELVLMSPGPGRIVKTLRPPFSRRWRAGDSAREIKSDPEFIALREQLLADVFAQRRQEAWA

SEQ ID NO: 7453 - protein, 328 aa, Chromobacterium substugae
MAKPRAFLKLILSAALAVSGVAAAADAVTVGYQTGIDPTKVPQADGAYEKATGSRINWRKFDSGADLIAAVASGDVAIGNIGSSPLAAAASRGLPIETFLVADEIGSAEALVARKGSGIAKPQDLIGKKVAVPFVSTTHYSLLAALHHWGVDPAKVNILNLRPGEIAAAWQRGDIDAAYVWDPALGKIKPGGAVLTSSAEVAKWGAPTYDIWVVRKDFAAAHPEFVSRFAKVSLDAIAGYQANPQAFIANAANIAKISRLTGAAAPDVVAGLKGNRFLGRDEQAALLQSPFVAAVGKTAAFLKAQGKVESLQPDYGPYVTNRFVKTAR

SEQ ID NO: 7454 - protein, 69 aa, Chromobacterium substugae
MVCIDEVSVSDMLASPFYQPRASVIAYIDLKPVLYYNGAGIYQWSDTLDKQCLSYWLTHPELPPGWELN

SEQ ID NO: 7455 - protein, 63 aa, Chromobacterium substugae
MVIDFQRARSLRLENKDDCHDAIVLLAGYFSPAEISNAEIECYKVSHADIALIRDAFKRAAPG

SEQ ID NO: 7456 - protein, 538 aa, Chromobacterium substugae
MTITKRLLLTTVLALLAMLALGVQGLWKQQQANDRFDYMKINTFPSIHTLDDAKEALADVRLTLARSVALSDPAAKKAEFAALADLDKRFDAALDKYEKDLISNDDDRKLLQVDRDDMKLYRQQRDKYLQLLQGSNVAEADKLMTGDMSNEAKALNQALIDHIEFNYKLADQLSKDNDAAYAAAWWQSAILIGLAVVICGWLSGHLFLNIRSSLEQTLSTMQSVRTSLDFRLRAPVARMDEIGKTATAFNELMARLQQSFQEIRGSVTAMEDAIVHMADSSGHIAHSSVQQSESASAMAAAVEQVTVSINHVADRAREANHQAREAGEIADRGSRVVLGTVDGISAVAESVGEASDRIGKLREDSVTIATVLGVIKDIADQTNLLALNAAIEAARAGEMGRGFAVVADEVRKLAERTASSTTEISAVIDKMQQGTQAAVTGMQQVVDRVNQEAEKARGASDAIQQIKTNSEHSTLLIGEISDSIVEQGSASNTIAQKVEQIAQMAEANSKASSDSASSAQQLKEQAGHIQKTVAQYQV

SEQ ID NO: 7457 - protein, 221 aa, Chromobacterium substugae
MFAFTDRQRLSALVQLSLFHIAIIASSNYLVQLPITVFGFHTTWGAFTFPFIFLATDLTVRIFGAPLARRIILAAMVPALLISYLVSTLFYQGGWQGMAALEQFNLFVARIAAASFAAYALGQILDVQVFNRLRQLKAWWVAPAAAMFLGNISDTLSFFFIAFYKSSDPFMAANWVEIALVDYSFKVLICMLFFLPMYGVVLKMIVKRLLRAGIGEQLQPA

SEQ ID NO: 7458 - protein, 132 aa, Chromobacterium substugae
MTQRSNLDIVRATYEGKSEDNGRNLLAALAPDAAWTEAAGFPYAGTYVGPQAIVENVFQRLGSEWDGYRAAVDRYFVDGDNVVAQGFYHGTYRATGKSFSASFAHVYTLKGGKIVKFEQIVDSAKVWEAMRG

SEQ ID NO: 7459 - protein, 62 aa, Chromobacterium substugae
MRSLSESRRAAARAIRLVYGRRRAPAAAAWNMNMPVWPPARLELARSWLYLRTILVFLKEAP

SEQ ID NO: 7460 - protein, 344 aa, Chromobacterium substugae
MISSAPRLSMLELAPIVAGGDAAQALQNSVRLAQHVEQLGYTRFWVAEHHNMAGVASSATAVLLGQIAAHTQSMRVGSGGIMLPNHAPLVVAEQFGTLATLFPGRIDLGLGRAPGTDPLTARALRRDRFAGEDFPQQVAELRGYLAPAQAGQQVRAIPGIGTEVPIWILGSSLFGAQLAAQLGLPFAFAAHFAPAQLGEALQLYRHLFQPSAALAKPYAMVCIPALAADSDEKARRLATTPYQKFLNLIRGDRQPLPAPVDSMDGLWNPREEFSVRHEWLGAAVFGGPATVKAGLQKLLDETGADEIMLSVDCHDFSDRLRCCEIVADILPQLKTAQAAPAAAN

SEQ ID NO: 7461 - protein, 229 aa, Chromobacterium substugae
MKSYGAEFLGTFWLVLGGCGSAVLAAAFPGLGIGFAGVALAFGLTVVTMAYAIGHISGCHLNPAVSVGLWAGGRFPAGQLAPYIAAQVLGGIAAAAVLYAIASGAAGFDVAKGFASNGYAEHSPGGYSLAAALVCEVVMTLFFLLVIMGATDKRAPAGFAPLAIGLALTLIHLISIPVTNTSVNPARSTGVALFVGGWAVQQLWLFWLAPIIGAVLGARVYRLIAGESD

SEQ ID NO: 7462 - protein, 188 aa, Chromobacterium substugae
MEGMLAGLLAALALPKVGLPAIFAVSLISATLLPLGSEPAVFAYIKLRPDMFWQVMAVATLGNTLGGMIDWWMGYGAKVGLLRYRQRRSHHMHGHSHAKPDGRPPRARKPALNPRYFRWMRRRGAPILLLSWLPGIGDPLCTLAGWLRIPFWPCVCYMAIGKFLRYLAATSALLWIPDDFWRDLAQWL

SEQ ID NO: 7463 - protein, 466 aa, Chromobacterium substugae
MAISVFDLFKIGIGPSSSHTVGPMRAARQFIARLEKDGLLDAATRVQSEMFGSLGATGKGHGTDVAVLLGLQGEQPDLVDTDAVDGMLAAIREQRKLKLLGKHEIDFIEAEHLVLHKKKTLPYHPNGMIFEAFDAAGNSLSKRAYYSVGGGFVVDEAAIDAGFVPPGVTELKHPFKSAAELLALCQRHGKSISQIMLENELSWRSEEEVRAGLLNIWNVMQACVKRGCEREGILPGGMKVKRRAADMHRKLLASPEAAMRDPLTVMDWVNLYALAVNEENAAGGRVVTAPTNGAAGIIPAVMHYYARFVPGASDDGIVRFLLTAGAIGILFKLNASISGAEVGCQGEVGSACSMAAGALCEVMGGTPEQVENAAEIGMEHNLGLTCDPVGGLVQVPCIERNAMASVKAINAVRMALRGDGQHFVSLDRVIKTMRDTGMDMSTKYKETARGGLAINVIEVPVNIVEC

SEQ ID NO: 7464 - protein, 177 aa, Chromobacterium substugae
MHALEIETPRLRLRPLLERDDAFILELLNEPAFLANIGDKDVRDLAGARNYIEKGPQASYQQHGHGLLLVELQAGAVPVGICGLVKRDSLPHPDIGYAFLQRHWGRGYASEAGAACLAHGRERLNIDYVVGITAPGNLGSIRVLEKLGLQYDRTLALPGINGPSLYYVPAGRGEKPA

SEQ ID NO: 7465 - protein, 626 aa, Chromobacterium substugae
MAWSVADSRSLYGIRHWGAGYFDVGDSGNIVVRPNVRQQKEIDLYRLVHELGAKGLDLPLLVRFPDILQDRVSRLCGAFDKAIAEQGYGNRYTAIYPIKVNQQEAVVKSIIATQEVSIGLEAGSKPELMAVLALAPKGCTIVCNGYKDREFIRLALIGERLGHQVFIVIEKESEVELVIEESKKLGVRPNLGLRVRLSSLASSKWSDTGGEKGKFGLSAGQLISAVDKLTAAGMADCVRLMHFHMGSQIANIADYRLGFREAIRYFAELRALGLPVDHVDVGGGLGVDYDGTHSRNDSSINYDMDEYAHVIVSMLSEFCAENGIPHPRILSESGRAMTAHHAVLLMNVTDVERLPDTVSKIDNVEALSLPLRKLLELASLNDEELVTEIYYRASHCVSEVSDMYAEGRLSLKEKALAEEVHATLCRRLHTQLQASQRSQRQVYDELTDRLADKYFCNFSVFQSLPDTWAIDQVLPIMPLHRLAEQPTRRAVLQDLTCDSDGKLKHYVDQQSIENSMSVHEVKQGEEYLIAVFLVGAYQEILGDMHNLFGDTDSVNVYVRQGGELEFSGVEEHDTIEDMLRYVHLSPEDLLNRYEAKTRECDLSAEERSQFFAEFCRGLKQSSYLSV

SEQ ID NO: 7466 - protein, 331 aa, Chromobacterium substugae
MTQASRFLQHALHPDAGADASWPLPSGLQARWVAAGCVEIDPGLPQADSVLLSCGVHGNETAPIEVADAILADIADGTLALDCRLLVMFANIEAIRAGERYLGYDMNRLFNGAHAKHADLAESRRAAELEVLAGRFFAQARARKLHYDLHTAIRGSAFEKFAIYPYLHERVHNRQQLAWLQQSGIEAVLLHSQPANTFSYHTSRRFEADAFTLELGKARPFGQNDLARFAGIDQALRRLLSAPASGVPALQPDALPLFRAKYDLVKRSEHFRLHLADDVENFTRLPDGMLIAEDGDTRYLATGGEERILFPNPAVKPGLRAGIVVEPARLD

SEQ ID NO: 7467 - protein, 311 aa, Chromobacterium substugae
MRISSATLYQSGIDNMSNLQAQLVQVNMQIDNQKRVVTPADDPVASARIELLNTSSGQNSQYKTNTQSVQSWLSLSDTTINSAINLMNAMKSQSIYAGDGSLSPTQLQAIQQTVKEGISELTGYANATDGNGSYLFSGNQVTTVPFTVNMASSPPTATYNGDSGQRSVQVAASRIMTISDPGNAIFGTPGTGGSATGAFDSLINLYNLLGQNPKPANYQTQLNAITNQITSATQQMTTSLASVGAREQENANLQGMSSSLDLQYNTSIGDLQNLDMAQAISTFTMTQTSLQYTQKTYAQVSQLSLFNYISG

SEQ ID NO: 7468 - protein, 600 aa, Chromobacterium substugae
MAIVGADIFGIGLSGLNAAQNALSVTSNNISNASTPGYNVEYITQAGRQPQNVGFGFLGQGVDVTNVLRTYSQYLAGQVQSAQTGSSYYTTQLQQLNQINNMIGNSTQSPNPAIQSFFGAMQTLSQQPSSLPTRQNVLSMGQAMAASITSLNSQLVQLQQGVNGQVQTAVQSINALAQQIANLNKQIGAATGGNTQAPQPNTLLDQRDQALLQLNQMIGATASVQSDGSYTVSIGSGQTLVTGGTVNQLATQADPNNPSNLQVGFTNPNNTLTILPDTILNSGQLGGLLNFRDGALAQTQNQLGTMAIDFAAAMNYQNSLGVDYNGQPGGPIFKDLSAYASNPQYAAGQFQVTMGDPKLLATASNLVATGTAGNPSGVTMSAVWSSLPGTYATSINGTPPSFPATTSHPSSGLTNMTITASAAPVSMTATIAGTNGGGPYNVVPVTGQPNAYKLQTTATPPVDVGIGFQLSGSPDPGQTFTVGPKPIPAVGTVTPPSGDNSNLLQLTAQQNIALVNGQSYQTYFTSTVTTVANQTYAVGLQNTSAQNTLQQATRANSNLTGVNLDQEAANLIKYQQSYQACSKVIQIAQSTFSSILNIMS

SEQ ID NO: 7469 - protein, 320 aa, Chromobacterium substugae
MTAKFQAVAPQDALSRQLAIDPSHMRSLKAKASSDPKAAARETASQFEALLMNTMLKTMRETKFDDSEESNGMDTYRSMADQQMVQAMSANGGLGLGDMIYRQIARQSGFSPDEGQTHALNSRPVAGQWSPVQPIGQRMQQAYRSAQGASGAAVADSPTAATPVGGGRAFASSLLPHARAAAQQLGVAPECVVAHAALESGWGKRAIRNSDGSDSHNLFGIKAGSDWQGKTTTIMTTEYSGGVAQKRMETFRSYDSYADAFSDYAKVLKGSSRYKNVLNQGQNMYGFAQGLQSGGYATDPRYARKLVDVAASLAQQVAKT

SEQ ID NO: 7470 - protein, 366 aa, Chromobacterium substugae
MMKKWIVLACLLLASLPALSAQRLKDIANIGGVRPNQLIGYGLVVGLDGSGDKVTSSPFTGQAMINMLNQLGVQVPPGTKIDPKNVAAVSLTATLPAFSKRGQMIDVTASSIGDAKSLRGGTLLLSPLKGADGQIYAMAQGNVVVGGAGASAGGSSTQINQLSVGRIPAGATVEREVQTALGDGEFIHLELQEADFTTANRAVQAINKTFGADTARAVDGRLIEVRAPFDSNQRVQFLSRMENIAVDPADVSPLVIINARTGSIVMNQAVTLSSCAVSHGNLSVTVTNTPQVSQPNSLSGGKTTVTNQADIVINSTGGKVVGLKGGANLSQVVNALNALGATPQDLISILQAMKSAGSLKADLQII

SEQ ID NO: 7471 - protein, 227 aa, Chromobacterium substugae
MKTNLVMLAVALLALAGCAVQEPPLVQTPTTAKPQPRAMGIPANGAIFQAASYRPLFQDGMPVQVGDTLQVMIQENSSTSASEQTTDTRTSALTSNITAGVKIPFLPSGLAGGLGGTNFNSSGSANNTGKGNNQVATSFVSSITVTVIDVLANGNLEVSGEKQVRINSDTESIRLSGVVNPRDIAPDRTVSSLKIADARVEQQTKGNNRLYNEPGWLSKIFMSLLPI

SEQ ID NO: 7472 - protein, 260 aa, Chromobacterium substugae
MMRALYIAKTGMDASQFQLDVVSNNLANVNTIGFKGSRGVFEDLYYQTLRQPGGQLANGNTNPTGLQIGTGAAAVASSRIFSQGSPQQTGQPLDLEIDGDGFFRILQPDGTTAYTRNGQFQRNSNGDVVNPDGLPLNPNINIPATAQQITVSSAGVVQYTLAGATAPQTAGTIQLTTFINPQGLQSLGSNLYLQTAASGDPQDGNPQTDSRGAIKSGFLESSNVNVTEELVNMITAQRSFEMNSRAVTTADQMLQKLSNM

SEQ ID NO: 7473 - protein, 243 aa, Chromobacterium substugae
MFLAMTGAKHEMWQQATTANNLANVNTNAFKADLAAFRALPVVGDGAPTRTYVVDNTIGFDASQGSLQHTGNPADFALGSPGFFAVQGPDGQEAYTRDGGYALDANGLMRTRTGLPIMGDGGPITVPAGSQVQLGADGSVLAIPLSGTNRTPQLVGQIKMINPGPKDMYKGEDRLYHVNGGGTAPASADVKLVPETLESSNVNSVDALVQMISHGRQYELNIKMMQTAQQDDQQAAQLLSVTS

SEQ ID NO: 7474 - protein, 412 aa, Chromobacterium substugae
MGFQQGLSGLNAASTQLDTIGNNVANANTVGFKSSRTEFADLYGNSLYGMTSTTPGIGTQVSAVTQNMGSGNLETTGRSLDLAINNSGFFIMGLPNGTQAYSRNGQFQVNNQGYIVSTAGNYLQGWTANAQGAISQGPVGNLQLTNTSIPPTATSKMNMAVLLNSASTPPTTAPINNPAQPSSYNWTNNQTVYDSLGNSHQMTFYYSLNTPVAGAGNTWTVNAYVDGAAATAPSTFTLSFDTNGNLTTNTPFNVTFTPPSANGSAAPQTVAVNFAHSTQIAQNFFTSPVTQDGSAPGTLQTINISANGLIQASFSNSQTKTIGQVALANFINPQGLQDTGGNLWTQTGTSGPATVNAPGSGNTGTLSAGQVEDSNVNLTNELVNMITAQRYYQANAQTVKTQDTLIQTLLNI

SEQ ID NO: 7475 - protein, 243 aa, Chromobacterium substugae
MASATSATSPFNYNSLNNQPAPGSTSVQAANGSSTGSGTAAASAQSLQNNFLTLLTAQLNAQDPLNPMDNSQLTSQMAQISQVSGLQTLNQTMQQLVTAQNSTQSLMASSMIGKNVMVAGNALTAPAAGKTVQAGVVLSGPAASVTISVLDKNGNVVDSVPLTNPGAGLNTFSWDGTDSNKNPLPAGNYTFTAKVTQASAGGTTTATAYSNQQVKAVSWAQGTPMLVLSGNTQVPLSSVAQMS

SEQ ID NO: 7476 - protein, 136 aa, Chromobacterium substugae
MSLSNLFNISGSALSAQSMRLNVVASNLANAESATSSTGQPYKGRHVVFTAVPVDAAQPQVAGVRVTSVVEDQSPPRLKYEPGNPLADERGYVTMPNVNPVEEMADMIAASRAYQNNVEMMNTAKSLLQKTLQLGQ

SEQ ID NO: 7477 - protein, 137 aa, Chromobacterium substugae
MLDKIAHYFDFQQRALNLQAYRAEVIGSNIANAETPYYKAVDFDFKAALQAQQDKQGKLAMAVTDPRHLASEAGGVNANVPMQYRNAVQPSLDGNTVDMDVERGAFADNALQYQTTLTFLGKRISSLNSAIQGSGSG

SEQ ID NO: 7478 - protein, 265 aa, Chromobacterium substugae
MLALEQLLISLAEPSPVQAQIITKALEALGAAQIEIHPNGEELIQQARERMPNLVISAYHLPDMTGSQLVQTLRDSHDLYDVPFILISSETKQERLESIRQAGSLAILPKPFSEEELHAAMQSVMSFINCDSLGAEVDADMALMNVLIIDDSSTSRHHIRQVLEKLGFEHFCESSGGERALQLIEQEAFQLIITDYHMPQIDGMELARRIRASGTQEGAPILMITSDSEHVGQAELEDAGIAACCSKPFDIDKLRELVRRLLNEY

SEQ ID NO: 7479 - protein, 275 aa, Chromobacterium substugae
MEYAVQRYAATRPWAKRVGQLYVQAAQVAEARAQMKDVIRRELERAAQVFEIPQSAIGCELALAEAWGHFVRQGRVVSHLRDALALALGQTRQPGNLPDTLALPAEAFFLHVPGEGGAFVAHQPERRALLLTLVRMGFAPDGVNWLQAADQVEVVRVEYPGELAPQLAEVGETWHGLLAAVLNGLAMMTQPKLERVKGWEAGAPAEWVAAAGHPTCAKTRQKARSQLLKAGFGEITFCEAADLAAGADYSSQGYWRRQALGGDKGHSRLVWVAPR

SEQ ID NO: 7480 - protein, 507 aa, Chromobacterium substugae
MYGLSMAGSAALAMAALLALQWWAADAELSARAQWLARQLAAELAPAGAALPRAGAVAIDAPACLSARAALTSLVQQTPHARYAIRRLPDGRWCGSDQARSDALSGERPLEWARSGAGAATLVLRGGMAALELETGWLRALLSQAREAGVDLQVRLEGGRLSADGAIVPAGGHPGEAAFPVANLAADMAVAGSVDVWAFASRSWAASLEALLLSLLAGGMLAAWLLRGAGVRNASDWEILEGIRHQEFFAHYQPIVTAASGECVGVEMLARWRHPVQGNVRSDLFIQTAIDAGLIVPLTRYLLKRVAGELRQVVLPPGFMVGINIASEHLSMPELVNDCREMLDMLNEKQAVLVLEVSEQTPLREASGALDVIRELRLLGVKLALDDFGAGYADKAYLQRWGFDYLKVEKGFVSALGQECLRGNVLDGLPLSSEEMGVRVIVKGVETQGQQSYLNVKGFELLQGFYFGKPMTLNHFRQWLYSGIVEDRRHAQRRSPTGRRASDRGGG

SEQ ID NO: 7481 - protein, 442 aa, Chromobacterium substugae
MNFSDLGIAPTILRALEAAGYTSPTSVQAEAVPAAIAGRDLLVSAQTGSGKTAAFLLPALTKLSERSTGKGQGPRVLVLTPTRELAQQVEKNALEYGKDLRWMKTACLVGGSSFGFQIRALSRPIDLIVATPGRLMDHMRSGRIDFSRLEMLVLDEADRMLDMGFIDDIEAIVKATPETRQTVLFSATLDGIVGRMAEKMTRDPQRIEIARTETSGGTIEEHLLYADDLNHKHRLLDHILKESGFDQCVIFSATKAYTEELADKLADQGYSAACLHGDMPQSWRNRTLNDLRRGRIKVLVATDVAARGIDVPTITHVVNFDLPKQAEDYVHRIGRTGRAGRDGTAITLAEAKESHKVRRIEQYLKRSITEGVIEGMEPTRRPSKGGPRRNGKPGGYGDRRNGGYQGQRREGGYQGQRREGGYQGQRREGGYQGNRGPRTSAQ

SEQ ID NO: 7482 - protein, 195 aa, Chromobacterium substugae
MNGWKMAALAAAAGWSMAASAGINDCGTTYAVINSGFDMRGTNGSINYIGASTPNQLMISGNVNGMQVTRYIDLVGFTVSGSWGNLAGAAWPGGGITSLVINGKEMDISGWSHLPGQGAGSVMTTAKIVFAGNVSFGYNSAGVANANSRINYLAPFPAGGAHANKGLMLGGTTYSNGVPNGSFMGGSAMDCPAAK

SEQ ID NO: 7483 - protein, 563 aa, Chromobacterium substugae
MALQFLFNHLGFETSAAKRALLQGPGDAAVDSVTVLDAERRPVLRSPLHALGRVDGWRDWHYWQADISALRAPGRYQLWLDGSAPPLLSAPFEVADRRFGTPLLSDLLHYFKSQRCSGLYDQADRQARVEGTDERRDARGGWFDASGDCSKYLSHLSYANHLNPQQTPLLVWSLVRARRALSAQPKWFDERMTDEALHGAAFLLRMQHESGFFYQTLFDGWSKDEDRRSLCAYSTQQGLRSSAFQAGWRQGGGMAVAALAAAAGLSRDGDAPREAMLAAARRGFVHLQEHGLSYLADGRENLIDDYCALLAACELHAATGDGDYADAAAERVACLLARQHEDGWFWLDDERQFSYCHASDAGLPALALARYLETLPDGLYAAEAERGWRLVMQGEMARSAVQEGNPFGYLRQWAQRPGRTPGARFFMPHDNASGYWWQGENARLASLAAAAWAGGRRWPELAPRLHGYAQSALDWILGMNPFDTCMLQGHGRNNPHYEPGYYNACGGVCNGITGAPGAEGGIAFLLPEETDISQSWRWSEQWLPHGAWLLLALALRQWFDGAQ

SEQ ID NO: 7484 - protein, 403 aa, Chromobacterium substugae
MKSPAAKPDPLMVSGTNLEHARSHNRRAVLETIRRNRQLTRADIARMTALTPQTVSNIAAELLEAGVLSAGEPLRDGARGQPAIPLSINPDGAYSIGVQLDHQSLIAVVVDLAGQVRARVELAVKRPSPGAALPLIADAAQRLRRESGLDWSRLLGMGLVMPGPFGVEGMTSVGPTTLPGWENIDAAVLSAALGMPVLLEKDATAAAIGERLYGMASQLQNFVYLFIGTGLGAGLFLDGRLYAGGRHNAGEVGHMIVVPGGRACECGNQGCLERYVSLRALYEALGLADGALATPEHLARREVDAAGEAWLASAAAPLRQAVNILECLLDIDAVVIGGLLPPAWMEALVRRLDPLPVSTRHRGGERLRLGSAGRDVVALGAAALAIFDEFNPQYEVLLKSGRG

SEQ ID NO: 7485 - protein, 288 aa, Chromobacterium substugae
MHIPAKFLIGVDGGGTGTRTCVAAPDGAVLAQAEGPGSALSLGVEKAWRTILSTLDAAFARIGVASPSYRDCALGIGLSGVHNSQWARQFQAQSPGFAALKLATDGFTTLLGAHAGKPGVIVALGTGSIGEALYADGSHREVGGWGYPSGDEASGAWLGQRAAQLTQMALDGRSSHGPLTRSVLEFVGGSWQSMMGWNGRATPAQFAQLAPLVLAAARTDPQADALLRQAGEDAWAIARALDPRSELPTALCGGLGQALRDWLPPGFRQQLVPPQGDATRGALLLLQR

SEQ ID NO: 7486 - protein, 420 aa, Chromobacterium substugae
MKPHRQALACLALLACALGAPAHADKVKLEFWTDSLKPRFDGYFAAVKKTYEAQHPDVEVQWVDVFNDNFETKLNAAIAAGKPPALVNHDVPRLFKYSQKGSLIPLDSALGADKSAYLPNALADLSFGGKLYGLPWYNNVNVLTLNGELFRKAGLDPRHPIASLDDELRLAKIIKAKTGVPGLLPQLGQIDGIMLGQGLPLIQNGKAVFNSPAHAALVRKFADAYRAGALARDSLFADDNYQDSVKLYNSGRLAMMETAPTAAQKAREDARGIYAATVVQPAPLGPTRIVQGGYLFSWAVSRGLPARTQQEAVKFARFLTSDSQQLAFSKVTGATFPSTQKALADSYFVKASADGGAIESSRIEGAKVARNIRTLVLTGVPRVADLKKSLVDNVEAAVTGKKDAQKALDDAAAFWNRHLQ

SEQ ID NO: 7487 - protein, 288 aa, Chromobacterium substugae
MKSSERNAWLFLAPALLLLAVFTFWPLLFGGFIAFTRYDLVSPPQWVGLDNFRDLLDDAVFWQAMANSLKYLLVVPAIQLSGIALAVLANRSLPGIRLFRAALYLPVVTTVSVVGIMWNWMYADYGVLNSALHWLKLLAAERDIGFLSDDSLALYSVMFVTWWRGLGYYMVLYLAGLQSIPAEMQEAARLDGANAWQRFWRITVPMLKPTILFCSLISTLDALKAFEEVLVMTRGAPLNSTYTVLYYAFHQGFNQLDFGRGAAAGLTLALVCLLLAWLNFKLIRADHR

SEQ ID NO: 7488 - protein, 282 aa, Chromobacterium substugae
MTAIALLRPAARRRALRRLPHSLLLLALSFACCYPFIWTLGIAFGNGEQVFDFPPELWPRDAGWRHFIAVWDAIPLGRFFCNSLWISGLTTAGTLVVSALAAFPLAKLRFRGRQLVFYAILATLLLPSEINFISNYVTISRLGLDDSRLGVVLPSLAGAFGIYLMKHAFEEIPDEIVDAARMDGAGDWQVFWRICLPLSLPYLATLGIFTLVWSWNVYVWPSVVLKTPELYPLSVGVLYLKGAFATSTRMVAAGAVIAIAPVLLVFLCCQRFFMRGMDGAVK

SEQ ID NO: 7489 - protein, 438 aa, Chromobacterium substugae
MDKHPPVLPSARPLQRQDYKTLSLAALGGALEFYDFIIFVFFAVVLGKLFFPPAMPDWLSQLQTFGIFAAGYLARPLGGIVMAHFGDLLGRKRVFTLSILLMALPTLAMGMLPTYHDIGIWAPLLLLALRILQGAAIGGEVPGAWVFVAEHSPSRHTGFACSMITAGLTAGILLGSLIATAINLAFTPQQIAGWAWRLPFLIGGVFGLVAMQLRQWLHETPVFAELKARKALSEELPLKTVLKKHKTAVALSMFATWFLAIAIVVAILMAPAYLQKQFNILPVDALRANSLAIVALTLGCLVAGVLSDRIGSGLTFIGGSLLLGASSYAFYTVLAVDSSQLYPLYALQGFCVGIVGAVPLVMVRAFPAAVRFSGLSFSYNVAYAFAGGLTPVILSVWLKYDAMAPAYYLLLQCLLGLLVGVYLLARRRDAGLAAGIQA

SEQ ID NO: 7490 - protein, 279 aa, Chromobacterium substugae
MTDAIQGQEFMLLDWMRRLGGKRAPPALLEKLREEAAAMPLLAGLSAEENGRLLQLAGELLMAKTITALEDMEVDDAMRCRAVLQLALPGMNLGIGAYGNWREVVLYPAPFVVRSRWQDGMGLTHEGEQVLIGQAHYQGPLVLSWPDVNESPLLDGWNVALHEIAHQFDMLDGPANGAPPLHKGMDRALWSRVWNQAYRQFCREVDHGLEGWLDPYASENPAEFFAVQSEAFFEIPHLQRRDYPELYRQLSLFYRQDPAARLPEVAEADLLPPPPPPQA

SEQ ID NO: 7491 - protein, 401 aa, Chromobacterium substugae
MTVPIWHDLALNPLAAFGILLALGVIGGQIAVRVARLPAITGYIVTGLLIGPYSLNLLDQQLLNEASLFVQLALGIALFEAGRRVDLRWLRLEKTLLATTLLYCLLVFAALYALLSGNGFGPAASLMLAALGMATSPIVVLEIVRESRADGQVSERLLTATALSSLLAMIGFALALSYSHLSANHSVEDGILMPGWLILGSAALGLAAGLVTTQLNRWLGGHQRDAQRVMLFGLIALLVGLADMLQLLALLALLVAGMSTRSLRHGYTVSEPGILSLSHVFTVAFFVSAGAHLSPQALASHWQLALLCLILRSGIGMLVWWLAARGNGLSRKQGAWLGLALSPLTGGSALLLGLGMVSLGEAATSFSAALMAALLINEIVAPILTRLALRLAGETAGASHA

SEQ ID NO: 7492 - protein, 377 aa, Chromobacterium substugae
MLEFNQSQPLTLGVELELMILNRRDYNLTRGSDDLLLQINRKPHGFDIKPEITQGMIEIGTAIHHDVNQMLEELLAIRQLLVDSAHKLNLGLAGGGAHPFQHWDDQRIYPKERYQLVSELYGYLAKQFTVYGQHIHIGCPDGDAAVRLNHYLARYIPHFIALSASSPFYQGVDTAFQTSRLTSVNAFPLSGCMPVVDSWDSFNHYFQRMASLGIVASMKDFYWDIRPKPEYGTVEIRICDTPLAIDTPVLLAAYAQMLARRCFAEDWHDISPEPYLTYSYNRFQACRFGFDGVLVDARSNRQQGLQEDLLDSLKALDEHAEALNCQAQLAQLRQRALKRHSDSQWLRQIHDQSGSLSEVVRRQSEHWMYAGPGVGVN

SEQ ID NO: 7493 - protein, 264 aa, Chromobacterium substugae
MPFQLPQQPAPALPARWCVFDGSQLWLLDKRLPSLPPEGCQLTGTSFLGVHEEHNLFMAELVGNRPEQGEWLPLRPALMALPAAQIQAAARAAQLRQFRHSHRYCGHCASPLQTSRDQVGKHCPSCGQVYYPRISPAMMVLVNRGRELLLARSPHFTPGMYSALAGFVEPGETLEECVHRETLEEVGIRVKNLRYAFSQSWPFPHSLMLAFTAEYDGGDIRPQEDEIEDAGWFDIDALPTLPSPISIAHHLIAHGRELILKQET

SEQ ID NO: 7494 - protein, 432 aa, Chromobacterium substugae
MLKKALHNAARLAHPRMKEAIVKQKTLLSLALTLSLPLACAHAQAAAMTVDSLDGPVTRNEIQSFVDYAQGLQPGASNVGNEWAQGRSGENLKAMALVYDIAPSQPLLDKMVSFCDALLSERNDIAPAPTGQRVIWTGRIDPVWPNTPDVSPIQTGGEQGDPVGHLASCARQILKTSAIYDQKVAGGDPFLFGATYLQRAKTYLREADKTVDQHILKSLLKLSDGKLMYFAANAPYKGGQPVPWNQQMMFGYGFLNLAQAHELLRDNPSLVKRYDQILQANLDWFLQSGLTRYTDKAGRSAYDWGYTLPDTSGEDNSHGSLDTAGLYRLYQSGRYGLKAAQLAPIANTVLDVMRLGDRHYAGRLNGTTGAGNSKDTNYLRSGYLFTSLFQPSAYYTMMSDAGIQDGSTTSRIDAFSRFLAVKAARAAGKTQR

SEQ ID NO: 7495 - protein, 71 aa, Chromobacterium substugae
MKITFEYTPFSIAALKGDPPPIKQLPDGYPAPAKGDVFLLGDPPLRLLVAERRYRFHGGEWGLHIMLGLDG

SEQ ID NO: 7496 - protein, 42 aa, Chromobacterium substugae
MAVAEGLWLMAGFDDCWRGMEPVAIWQMPAGLLWLNFMTLLE

SEQ ID NO: 7497 - protein, 130 aa, Chromobacterium substugae
MIAIGLAMASSVSHAEPEDQPLPGDFQAAPAAKPLHKSRASQAAPRAASHNKAARAKHHAPKASHGKLKPAKAHAHAKHHRHTGKKHAKKPHGAHHAAKKAHKPAKAHKNKHHKNKKLAKKHHAKHKKTQ

SEQ ID NO: 7498 - protein, 226 aa, Chromobacterium substugae
MIAATRIRYGARRIYVLLRREGWRIHHKKTYRIYCEEGLNLRRKRPKRRVAAAHRHARPAVSNLNACWSMDFVADQLFNGQKIRALTVVDNFSRESLAITVDFALKAADVVATMQHVQALRGTPQRIQVDNGSEFISLALDQWAYEQGVTLDFSRPGKPTDNAFIESFNGSLRDECLNVHWFLSLDDAREKIERWRQDYNEFRPHSSLGDQTPSEFRLAHLEAGNL

SEQ ID NO: 7499 - protein, 270 aa, Chromobacterium substugae
MPAAAAAILDIAENLKMKKLNAVLALALTLGAAAAQADDLAAIRKAGVLKIGTEGTYAPFTYHNPAGELTGFDVELGQAIAKRLGVKAQFVEGKWDGLIAGLDVKRYDVVINEVAITDARKQKYDFSEPYIVSKAVLIVRDDNRDIKRFEDLKGRKSANTLTSNFGKLAQRYGAEIVPTQGFNESVALLESGRVETTINDSLSFLDFKKKQPASRLKVAATEANGDASGVLLRKGSPELKAAIDKALAGIKADGSYQKLSHKYFGADVSH

SEQ ID NO: 7500 - protein, 222 aa, Chromobacterium substugae
MQLMADSLPSLLYAGFVFTVPLTLLSFAGGLALGLLVALIRLFGPRPLVLLVRAYSWLVRGTPLLVQLFVIFYGLPRVGIVFDPFPAALLGFVLSVGAYTSEVIRAAIASVPKAQWEAAYSLGMSWSQAMRRTILPQAGRVAVPPLANSFISLVKDTSLAAVLTVPEMFQAAQRIAATTYEPLLLYLETALIYLLLSTVLTWLQERLEKRFDRHVAPVGAAS

SEQ ID NO: 7501 - protein, 255 aa, Chromobacterium substugae
MIKLSRIVKSFGEQTVLHDVSLELAEGGVTALIGPSGSGKSTLLRCANLLETPDGGELQLAGETLRFEPGRKLSRDAVLRVRRVTGMVFQSFQLFPHQTVLQNVMEGLLTVQRWPRDKAERRARELLDKVGMAHKADAWPSTLSGGQQQRVAIARALAPSPQLLLCDEPTSALDPELAAEVVAVLRQLAADGVTMLMATHDLRLASSVARDVVFLEGGRVVEAGPAAQIFRQPREARTAEYVSTLTAGARDLVQI

SEQ ID NO: 7502 - protein, 308 aa, Chromobacterium substugae
MDQSLNQLPGAPRPRILVVDDQTANILLIRELFKDECEIFMALDGEQAIAQCQALMPDLILLDLVMPGIDGFEVCRRLKEDPRTRAVPVIFISAQREEADEARGFELGGVDYIVKPVNRTILRARVRTHLALKFQTDLLNSIALMDGLTGVANRRKFDEELQTSWLLCARQRQPVALLLLDVDYFKRFNDRYGHQAGDDCLRQVAQAMRRALQRPHDLAARYGGEEFACILPDTDREGAAHLAETILQSIRELGIPHQDSELGGAVTASIGVAVAQPEPDTAPQTLIEAADRQLYQAKRAGRGRVSAA

SEQ ID NO: 7503 - protein, 1236 aa, Chromobacterium substugae
MISWNKGAQEMFGYHAGEALGRSLWQLIVPEDKEREEHDILSRIARGERIAHFQTVRRRKDGSLIDVAVSVAPIYGDNGAVIGAAKTVRDITRQKAMEAELLALNTRLEEQVAERTLQLEGARRDLRTVLDSVPSMIGYWDKNLVNRVANHAYHNWFGLEPDSLPGTRLPDLLGEASFSISRPHVEAALRGESLRFERTLPDLDGNPRHTLVHYLPDVMDGEVRGFYSVVHDVTELVEGRLQLAAALRENQALLGIINEQLQYAVTDPEGRFLEVNDRFCEISGYRREELLGRNHRMLAEGLHDEPFWQGIRQTLDRGEAWHGEICNRARDGSLRWADTVIVLQRDGDGAIERVIALRIDATRRRLIDAEVSRLSLLLSNVLSAASEVSIIATDRDGLITVFNAGAERMLGYVQDEMVGRCTPARFHLADEVAARGRELSQQYGEDIAGFRVFVHVPESAGAEIREWTYVRKDGGHVAVSLAVTAMRDGDGAISGYVGIATDIAERRRSEMQLRQAKQQAEQANQAKSRFLANMSHEIRTPLNAVLGLLQLLQRTPLDIRQQDYVAKTRAAANSLLGLLNDILDFSKIEAGKLQLDPHPFALDDLLRDLGIILSGSHGDKDVEPVFEIDPELPAAVIGDRLRLQQILINPAGNAMKFTERGQVIISVGQILRQGDATTLHFGVSDTGIGIAAEQLKRVFDGFTQAEASTARRFGGTGLGLAISQRLARLMGGQLEAQSEPGRGSRFWLEITLKIADPAPLVAPGGKALRVLIVDDNPLVGEVLGHTLQAAGWHSDYIASGAEAARALEAGRRYDAVLLDWRLAGSDGVETAARLRAAGAGKPPVLMMVTANGRETLSHIADAPFAELLTKPMTPRQLIESVQACLSGRAGPPCQIAAEPRLPGMRLLLVEDNALNRQVASELLALEGARVELAEGGLSGVEKATAADADYDVIIMDMQMPDIDGLEATRRIRASGCESPILAMTANASPADRAECLAAGMDDHIGKPIDINQLAPRLLALCGRAPRTEAAVVGAAPAFDIEPEEVVLRRFGQQADTMRNALRRFIEEAELLANLLQLQLESGDAAQRAATLHSLKGIAATVGAAALARRAGELEQCAKPSAPRPLDADAWREAAMALQQLAKDSVRQLARRLPEPVAAAAPAAAPALSVQEWRERLQAIQPLLERGNLAAIDLATALLPLAGERMRPQVESLVAQVGRLQFAPALHLLKTLIESEP

SEQ ID NO: 7504 - protein, 363 aa, Chromobacterium substugae
MTSKPHLSSAARWAAATLLLALALTTLACRQIEQRNAETLRQAASQQAQRALSAIVERLQRYAYGLRGARGAVVAAGDGPHAQEAFHRYSLSRELPREFPGARGFGFVRRVPETELKAFAAAMRAATGFSVHQFQPYRAEHAIIQFIEPLAANRQAVGLDIASDPDRRAAAQEAVDSGEARISAPVTLLQAPRLSKQGFLILMPIYRDILTPASLAERRAQALGWSYTPVVMPEVLAGLEQDPQDGWVELSDATNPANPLGFFRSYASGSAEAAVATQSAPIFGRVWRLTFHASPAFADSLQLPPTRLLNLGSLLFSLFCAALAYAWRSEMLSRKRLLDARMTSPPLSKARSTPSSARRWTAS

SEQ ID NO: 7505 - protein, 270 aa, Chromobacterium substugae
MSVGHYENFPVGSLLLPRRMRRAVHAIYHFARYADDVADEGDADAAARLAELDRLSADLARIEAGAEPQIELMRPLAAAIAAHGLPFQPFHDLLSAFRQDVVKTRYQSFAELVDYCRRSANPVGRLMLALYGVDDARSLAQSDGICTALQLINFWQDVAVDWQKGRVYLPQDDLARFRLDEGRIEAGQCDDAWRGMMLYQVERARKMLQAGAPLGRTLQGRLGLELRLIILGGERILKKLHASGGDVFRQRPKLNGLDWIYMMWRACRAV

SEQ ID NO: 7506 - protein, 281 aa, Chromobacterium substugae
MTPDQYCEDKAAASGSSFYYSFRFLPAERRSAITALYAFCREVDDAVDECHDLGVAQAKLAWWRGQVGRAYQGEADHPVMRALLPHLSAFQLPREQLEEIIDGMEMDLSMVRYQRFQDLLLYCHRVAGVVGQLAARIFGYSDERTLEYAHELGVAFQLTNIIRDVGEDARRDRIYLPMEELQRFNCPAMDILHYEESEAFKQLMAFQIERAEEHYRKAWELLPAADRKSQRPGLLMAAIYRATLREIQQDGPAKVLNQRLSLGTGRKLWLAWKTWTLGYRP

SEQ ID NO: 7507 - protein, 425 aa, Chromobacterium substugae
MKPRVAVVGAGWAGLAAAVELAGEADLTVLEAGREPGGRARQVGTDGDRFDNGQHILLGAYAECLRLMRRVGAEPESLLRRLPLQWRREGGVDMRCPRWPAPLHLAAGLLAARGLGWSAKWQLARALLGLRAAAYRLPQDCAVADWLRDHGQQEEALREFWRPLVLSALNTPPEQASMQVLATVLRDSLGARRAASDLLLPARHLSALFPEPAWRWLAGQGADLRLGSRVRRLSREAGRLLVDGEAYDAVVLAAAPYHAAALLDEPRLRAQLQDYRYCPIVTVYLRFAASPRLPAPMMGVRGGAADWLFDREALCGEAGLVAAVLSAPPALPEQDELVRAVLDDVRRLAPHLEQPIECKVIVEKRATFASAVGLRRATVRSGAEGIYLAGDWACPDYPATLEGAARSGVAAAAAVMQDLRMKARQ

SEQ ID NO: 7508 - protein, 251 aa, Chromobacterium substugae
MKTEFAKDALAGRVILVTGASQGIGREAALALARHGAAVVLLARSVKGLEKVYDEVVATGAPEPAAAPLDLLNAGENEFGNLALTIQREFGRLDGILHCASHFYALSPLSNQTIEEWMNQYRINTVAPFALTRACLPLLKAAPDASVLFVGESHGLHPAAYWGGFGASNAGLPYLTKVAASEWEMHANLRVNLLTPGPVNSPQRNRTHPGEAKGERGELADLMPHLLYWLGGDSRGRSGEVVELDLRKPQS

SEQ ID NO: 7509 - protein, 179 aa, Chromobacterium substugae
MKALVLLMTLLALAGCNWVGTVSGLTKDSDKAVGAACRQTGRSLEECYLRNPEADKASIYAGWREMNEYMAKNKLETMAPPPEKPTGSSAAMSADRPASAAMSGGKNGDGPKPLTSEEADRAAKNDPQVEAVLAAMRNGSPSSAGSAARQSSGKGEPDQKRLLNIIQDLNKTDPGRAPG

SEQ ID NO: 7510 - protein, 453 aa, Chromobacterium substugae
MAKTKTVFSCTECGGQTPKWQGQCPHCNAWNTLTEAVSTPAAAGPRFQSWAANVTKVQRLSEVQTEETPRDPSGIDELDRVLGGGIVRGAVVLIGGDPGIGKSTLLLQALSVIGQRRKVLYVSGEESAQQIALRASRLALDTSSVNLLAEICIENILATLKNDPPEVVVIDSIQTLYTEHVTSAPGSVSQVRECAAQLTRMAKQSGITVLLVGHVTKDGSLAGPRVLEHMVDTVLYFEGDSHSSHRMIRAIKNRFGAVNELGVFAMTDRGLKGVSNPSAIFLSSYRDDVAGSCVLVTQEGTRPLLVEVQALVDDCHGGQPKRLAVGLEQNRLSMLLAVLHRHGGVACFDQDVFLNAVGGVKIIEPAADLAIILAMVSSLRDKPLPEKLVVFGEVGLAGEVRPVARGQERLKEAAKLGFTRAIVPTANKPRQEIEGLKVLAVDRLDQAVEFCRE

SEQ ID NO: 7511 - protein, 186 aa, Chromobacterium substugae
MIDAQLIEQERPYLLRYALAQLRERDAAEEAVQETLLAALESQNNFSGKSTLRTWLTSILRFKLIDGMRRKGREKLFESLEDEADDGDFDGLFSQDGHWREPVKAWSGPESQLISRQFWQVFEQCSQVMPKRTAMVFVMREVMGMEIADICNNLEITATNCSVLLYRARMSLRECFSIRWSREGEL

SEQ ID NO: 7512 - protein, 59 aa, Chromobacterium substugae
MKLSCRAASRLISAGLDRPLTTGEHLKLRMHLLLCGNCRQFSQQLALLQQAARRAGQGE

SEQ ID NO: 7513 - protein, 292 aa, Chromobacterium substugae
MLQKLLADHDDDLPAAAEGLRLLADAEPLSDEELSSLSWLINHVVGESQGGWEAAWSLQQKLLSRAAAPRLLRSAAVAAGLGGQEADARQLEARLAEACGVSGELAGRVVRFASLQHLAAGQPPRQTAQALAPLLAESLPPASGQDAALAAALNNIVSALLDHPQLDEADEAVAQAMRQGADRAHDLWLRAGTWLNRERARYLQALVENRLGDAEAALRAADAGLALIAANGPEDVDRAFLLLERARACRRLDRRGEAEAAWEQARRLAEAFDPALREWFDRRSQALAAAPA

SEQ ID NO: 7514 - protein, 328 aa, Chromobacterium substugae
MPAKPSAPPAARLHPRNRHQGRYDFAALIAAFPGLAAHVGKNAFGDESVDFADPAAVRALNRALLKLFYDVDGWDIPAGYLCPPIPGRADYIHALADLLARGHKTGIPRGAGIRALDIGTGANAVYPLIGHAEYGWSFVGTDVGDEALSNAQAILAANPGMAAHIELRRQTSPQSIFRHVLAADECFDLTLCNPPFHASQAEADAAARRKWQNLGKDGGKRSPKLNFGGQNRELWCAGGEEAFVCRMVEESAALAERVYWFTSLVSKSASLAAIQRALRQAGAHSLTVPMAQGQKQSRLVAWTFMDRQRQNDWRQRRWQPPAVRLAEG

SEQ ID NO: 7515 - protein, 116 aa, Chromobacterium substugae
MNAMLVGADTLGNIPDVLQNYGITIHRHLSGRNSSHQRKVDRLPAGTDLLILFTDFLGHNVMRHFRDLAAEEKIRFIACRRSVCALKQSLTGAGMCENPCAACPQRASEKAGKRKR

SEQ ID NO: 7516 - protein, 43 aa, Chromobacterium substugae
MATGRPGKSGGKSFSDKAFRARQPKAAATLPRQAEEKNLEKRD

SEQ ID NO: 7517 - protein, 261 aa, Chromobacterium substugae
MTVAVWGRWALCALLLAPLARAGDGPWARAQRDHALLIGLEGTFPPYSQMKDGRLQGFEVDFGRALAAQMGVAARFQTVLWEHMLNSLAAGRLDVVINQVVATPERAKRFDFSIPYTYSGLQLVVRKADLARFHNAGDLAGSHVGVSSGSNYEQWLRTHAPQAHVHLYQDDPTKYDGLRRGEVDAIVINRLAAFNLSLQSKGELVPAGRMLAREDACVVVRKGNPQLLAEVNRAIGHLQRDGTLQALSRKWFKADIVSRPQ

SEQ ID NO: 7518 - protein, 319 aa, Chromobacterium substugae
MKIASATVSLGSSFSQSQSLSVTQTLAVQQPMPQADSVQLSSQATQSSLLGHLASDKDAVYSLIEAILEKAFGVHFKLLCLFPLNPDQTQAPAAAQPEVSAQQDIDYQEQQRLNFTASGQITTQDGKQLQFSLNMQMQSSYQYHSNQRYQSGGAASHDPLMVNLASNAGSLDGASVSFDLQDNGQMASLPFSSQGGWLALDKNGDGKINDGSELFGPQSGNGFADLAKLDSNHDGVIDENDPAFAQLKIWTGRDSSGKDQLLSLKDVGIGAILLPSVDAPLTLRANASDPAPQAQMRRAGVFVKDDGEAGMISQLDVYG

SEQ ID NO: 7519 - protein, 49 aa, Chromobacterium substugae
MAGLVDLALRQGLISRQAAIGTIGNKENCGVKSTADRSIAGGAPIRTSP

SEQ ID NO: 7520 - protein, 539 aa, Chromobacterium substugae
MIRHGLGEFAQRLKLPRAVEKAGEWLNLGLPDGAAGQPTAVRVRLAFEELGPTFIKLGQILSTRVDVFPPDWIDEFEKLQNQVPQVPAAAVKKLIREALGAEPDELFAEFDMRPIGSASIAQVHHARLPDGREVAVKLRRPGIMEKVEADLRILAHLAHLLELEFPELRRYQPSSIVAQFSRSLRRELDLAIEARNMDRFAKDFADDPHVVVPKVHWQYTRAAVNVQDFVDGVSAGELARLESSGLDPVLLAQRGADAVLKMILVNGFFHADPHPGNVFFLAEHRIAFIDFGMVGRISHVRRDEIVDLLSAVAEHNEHGIIDVLVEWTGNTPVDMQKFADEVGEFMFQYEHVPLKGLNISQLIADIMTLIRNHGIVLPPDMAMLFKALITLEGLGRQLNPDFQLVAHITPFVKELIVARYHPAALLKRGRQSLSEGLEMITGLPRDLVRIGRDMRHGKFRVNLDLQRLDNFGKQLDRSSNRLTMGIVTGCLIIGSSIVMTVNAGPKLFGLPFFGFVGFMLALFNSVWLVWSIWRSGKDL

SEQ ID NO: 7521 - protein, 245 aa, Chromobacterium substugae
MKLQLRLSALALAGFMVFAQAAPDKATPDKAPAEGKPAAESAAPDKPDDPISKYAAPQEDAVGDLLLQAMSLLGVAYRFGGNTPDDGLDCSGFIRYVFQKSLRVNLPRTAAEMAKVGKSVARAELVPGDLVFFNTRGFNYSHVGIYMGNNKFIHAPRTGKNIEVSNLTQSYWSARFNGARRVNRSTAGQTADTSDDVSVKGAAKKAAPAAEVKCRKGHKKCKAEAARGKSSGKAAKGGKKKKGRH

SEQ ID NO: 7522 - protein, 73 aa, Chromobacterium substugae
MALNMEFPVWRDPDGNVVACVEKLKVMRENLEEIAQMAQDAFEDAVLMGCDEKQVRDFMVAMMQNLDNPYRTE

SEQ ID NO: 7523 - protein, 412 aa, Chromobacterium substugae
MPFEAFIGLRYLRAKRRNGFISFISLISIVGIALGVAALIIVLSVMNGFQKEIRGRILSVASHLEVSSYDGRLGNWQGARDMLVKQPHVVAAAPFVNSQGLFVAYGNVRGGLLRGIDPAQEDKVVDVGRHMVAGKLEDLKPGSFGMALGVELARQLGVGVGDKVTLMTPQGNITPAGMIPRTKQFTVTGLFKVDMFEFDASLAMVNLRDAQLLARMGDTVSGVRLKLDDPMLAPQLKADLRPQLPQLMVTDWTDTNANYFRAVQIEKRMMTIILTLIVAVAAFNLVSTLVMVVTDKQADIAILRTLGASPGSIMKIFMIQGAVAGVLGTLSGAVGGVVIALNLDVIVPVIERIIGTKILSSEVYMIDYLPSDVQWGDVSTITIISLLLALFATLYPSWRAARTQPAEALRYE

SEQ ID NO: 7524 - protein, 228 aa, Chromobacterium substugae
MSKVLSCQGLGKRYEEGKLALDVLSDVSLEVAKGEHLAIVGASGSGKSTLLHLLGGLDSPSHGTVEVLGKDLSKLSEQERGKLRNESMGFVYQFHHLLPEFSALENVMMPLLIRRMDKKEAARRAGDMLERVGLGKRLEHKPGELSGGERQRAAIARALVTEPACLLADEPTGNLDAQTARQVFELMLELNRTLGTSLIIVTHDLDLAARTQRVLRLNEGRLAAPESA

SEQ ID NO: 7525 - protein, 428 aa, Chromobacterium substugae
MLFIRKEMNFFALLDALQTENGLIELGLGALCVLAAYAIARRLFIHWFAHHPERYDRFLPYTGFRLVLPVSAQLLVVLVSLAWSRFEHAPMLVLHIISALLFWLAVIRLCTAVVRQALPQGKFERNTEHFLASMFWLGFVSWTIGFDVAVMDWLESISFHIGKTRLDLLTIINGLLWVTVIVVVALWASRLLEARIMKLKHLDPNLRIVFAKLTRTGLVVASVLVALPVMGIDLTVLSVFGGAVGIGLGLGLQKIASNFVSGFIILLDHSIRIGDRLMVDNRVGYVTKMTSRYVVLKGADGTEALIPNDALMSNTVINQSYSDKNMWTSLPVQVAYGTDLDLALSLLKQAADQPRVLKNPGPNAFVTLFADSGINLELGFWVADPENGFMGLKSDINLAIWRLFKQHHIEIPFPQREVRIIGDKPAQA

SEQ ID NO: 7526 - protein, 206 aa, Chromobacterium substugae
MSAKRLAIIDDDEAVLQSLLWLLDGQGYRADGFDSGEAFLADGCEAEYNGIILDLRLSGISGIVLLEKLAGRPYCPPVIMLTAHGDVPHAVAALKLGALDFIEKPFDDVHLLERAAAAVALDEQNRQLHGHQRKVSAALALLTEREREVMQLILAGKLNKQIAEELSISMKTVEVHRSRVFEKMGVKSAVELAGMLAAPGAQGGKL

SEQ ID NO: 7527 - protein, 150 aa, Chromobacterium substugae
MGSKQPVSVLVVIHSKDGQALLMERADKPGYWQSVTGSREGGEALIDTARREVAEETGLDIGAGQLSDWGIVNRYEIYPHWRHRYPDGVTHNDEHVFGLLLDAPRAVTLAPREHLAYRWLRWDEAAALAFSPSNAEALRLLPGRLGLPEA

SEQ ID NO: 7528 - protein, 109 aa, Chromobacterium substugae
MTLHRIAAALAALLFALAPAAWPAPATVTIDISKFAFNPKEITVAPGTRIIWTNRDDTPHTVNSRDKIFASKALDTDDKYEYTFATPGDFNYYCVVHPYMTGAVHVRKP

SEQ ID NO: 7529 - protein, 323 aa, Chromobacterium substugae
MKQEESRQQTTDGDAPDGGRRKTLSCLAEWSGAAIVWTISGGIPHALGAGNAAAAADGKALTFVQISDTHLGFHKEANPDVVGSLRQAIADINALPQAPAFVLHTGDVSHLSKPEEFALARDIFKEIRTDRVHAIPGEHDAIDDGVSGYLKFFDHDGKSRAWYSFDQGGAHFIALNNVLNFNMGRLAALGEEQLAWLKSDLAGVSRSTPIVVMAHIPMWTVYEPWGWGTADAAQALALLRPFGSVTVLNGHIHQVLQKVEGNIALHTARSLAYPLPTPGQAGVGEPGPLKVPAGELGKLLGTRQLTVVPGAQRLAMIDRPLVR

SEQ ID NO: 7530 - protein, 435 aa, Chromobacterium substugae
MNAPSPHSYKIPTRRWRIGWLLGVGILVNYFDRISLSVAAPQLQQEFGLSNGELGLLFSAFFWSYALLQIPTGVILDRFGATRIGRLGALLWGVAATLTACAGGFAGIFAARVLLGVAEAPGFPVSAKATGYWFPRRERAMATAIFDAAAKFSNVIGVPLVALAVVHLGWRWGFGVSAILSVLYFIAFYLLYRDPSADAKLSEAERQYIIQGGAAEEGVSRQGSLAMLGYLLRQRKVWGLSIGFAAYGYVFYLFLTWLPGYLVQAMHMDILKSAWFSAIPWLFATVADLFVGGWLIDKLIARGHDETRVRKTVLLCGMAMGMAVFGATTTTDPYVAIIWITIALSGLAAAAPVGWSLPSLIAPRGGTGTVGGIMNFANNMMGAVAPIVTGIIVGATHSFANAFLVAGFMLVIGILAFVFLLGRIEPIPEPGASSR

SEQ ID NO: 7531 - protein, 220 aa, Chromobacterium substugae
MDAAALRGDYIFPAPGRKLDPAACYRRFVSANIRRQIAPAKPPAIISTINVSANMKYGNIVVMGVAGCGKSSAGRLLAEALNASFIEGDSFHPPENIARMRAGVPLNDADRAGWLANLAERLRQGRADGERMVLACSALKRRYRDVLRGGDPDLAFIHLAGERALIAERMRERSGHFMPESLLDSQFGDLEAPGADERAIHCDIQQPPAALLRQILQALA

SEQ ID NO: 7532 - protein, 339 aa, Chromobacterium substugae
MSRKPRIRSGGGATMHDVARAAGVSAITVSRALNQPQQVSPQLREKVMQAVDALAYVPSRSARTLASARSRTVLVLIPSLDNTVFLDTLAGIESVLDAAGYQMLIGNSHYSAEQELLLLRAYLQHQPDGVLLTGLTHAAPFEDILRRRALPAVYMMDLADDGRCCVGFSQEAAGAAITRHLLERGKRRIGFLGAQLDERVMKRLDGYRAALDAAGLRDAGLEWLDPSPSSMRMGADMLDAALAARPDCDALFCCNDDLAIGALARCQQLGIAVPQRLALAGFNDLQPSAWCTPALTTVATPRREIGSHAARQLLRMIDGGEPDALQTDLGFQLMLRRSS

SEQ ID NO: 7533 - protein, 205 aa, Chromobacterium substugae
MYLPKHFAVGDREALLRLMRARPLATLTLNGPDGLIADHIPLLAREEGGVLRLCGHVARANPLWRLLEGGADALAVFHGGDAYVTPSWYPAKAEHGKVVPTWNYAVAHAYGRLRAVEDAAWLRGLLDELTRTHEAGFETPWKVADAPADYIGKLLGAIVGIELEVARLEGKFKLSQNQAEATRDSVRRGLASRGAELADRMAERR

SEQ ID NO: 7534 - protein, 286 aa, Chromobacterium substugae
MGGNPLSREEMGMEFLFDLDDPLQCLEQIYQQLSPMVVAFQPQQPGAKPGRCFGSGLLLDYRGEKFIVTAEAVLAEACVAHGQQVLACVDKLQLPLQDLACASPQHMDIAAIHLPQPWLERHAPPHGFALDHGGAPDPLASAFTLLLGHPVRGPKPASQLNSHIGIVSRAYRGDSRRSQVIHPLFVEFDSRDILSRAKLDKAGLQEYYQLCGAPAISLYHSFQDDSNRLTAYLQGVVVEWDRDGIGATASSAALLPGFLDNFLQQLRRGDAHGRAEVASLLEKYRR

SEQ ID NO: 7535 - protein, 1394 aa, Chromobacterium substugae
MPMSPRMKFILLAVSSYVLFALAWIFFADQLPVGAETGRLLPLPLVKGVAFVAVSAVLLSLLLRSVPAAEAPASLTWLGAVSSGMNPDRWSGWRGYAAALALTACALGLRQLLLGGDSHPMLMLLALPVILSAGIGGLGPGLLATVLAALAADLMATPYLHDPLTPWTERLQLAFLVANGLAASLFNAALRHALARVELNRRLLDAVVSSTSDAIFVKDPQGRYLLVNRAGLAFVGKSGKEVLGQDDREVFDAETAREVMASDRVIMQGGRVQTHEELLTLQNGEKLVFLVTKGPIYSPDGRLGGLFGISRDITVHKAAEEALQASEAALRQAQQLAGIGNWSWDLETDTHRWSHEVYRLFGLDNRAPPPGYPAIQRYFVKESWTVLSEVVERCRLIGLGYDCDLELQRPDGAACWVTARGEAKHGAEGKIVGLYGTVQDITDRKQISMQLKASEARLQLVAEATSDGFWDWDLRTGRVYRSPRYYEVTGTRAEDDTGDFRFFRQLVHPADLPFVLQAIEAHRRGKTPRIELEFRLARQDDGVRWLQVRGRAVEWDDKGAALRLVGNLSDVTERKRVDDDLRLVLNEAGDAIWVTDADGYYIFANPAACRLTGHVLEELKSMHIRDLVAPECLGALPEHLAKLSNGPFQRSEWLLRLKQGGSICVDLTTGRLKDGRYMAFGRDLTEQHRAEQALRSREQQLARVIDGSDQGYWDWNLKSGSFQVSPRWESMLGYGPGEMRITAENWYDHVHPEDVERTRSSIQGNLRGELASHEVEIRCRTRGGDWRWILSRGRVVERSDEGEALMMSGTHTDITERKVFEQTQKEAAAVFDSSYEGILMVSREGVITKVNSAFTRITGYSAEEAIGRKPSMLSSGQQSAEFYEDLWQSVLGHDFWRGELWNQRKNGELYAELLSISVVRDAQGEVLHYIGIFSDITKLKAHEAELDRVAHFDPLTGIPNRRLLSDRLNQAIIRANRSGKSCAVCFLDLDGFKAVNDQHGHAAGDQLLVAVSRHLKSILRADDTLARLGGDEFVVLLSDVGTLEECMLVLDRILSAVATPVRLGEAEVRVTASIGVSLYPQDNVDADTLLRHADQAMYLAKDGGKNRYQLFDPENDRKAQSHRQLLDMLRRGLARKEFVLHYQPKVNLFDGEVIGVEALIRWRHPKRGLLAPAEFLPHLRGNELELAFDLWVLDAALAQAAEWVGRGLNIRVSANISASLLLRPNFCGELEAILGRHPAVPSGYLELEVLESAAITDVEQATRVMERCRELGVRFALDDFGTGYASLTFLRRLPVDTLKVDLSFVSDMLGNQEDRRVVESVIQLASALSRQVVAEGVETLAHGMLLRQLGCRYAQGLGIAAPMPADEVPGWCRQWRDDGAWQRLLAAEPAPDRG

SEQ ID NO: 7536 - protein, 47 aa, Chromobacterium substugae
MSAAGNIGIEAACVLHVYVGLAADGLRSGDCLGNRWPQALFVTGGGI

SEQ ID NO: 7537 - protein, 157 aa, Chromobacterium substugae
MTAASPKATIRLARAADAGELARLYRQLVDDPAIRVLPERLQALADGERAQVLVCEGEGRLAASAWLGFCEDVMYGGQPFAVLENIVVDRDWRGRGLGRALLDEARRRCLARGCSKIMLLSSAQRADAHRFFLQAGFRGDAKRGFVMYRRDMAAAQT

SEQ ID NO: 7538 - protein, 322 aa, Chromobacterium substugae
MARNIEIKARVADWAALERKVGGLAQPEGALLQDDSFFACGNGRLKLRVDGEGRGRLIFYRREDLAGLKPSFFLASETAAPDPLRELLAEAHGLLGRVRKQRSRYRLGRCAIHLDRVEGLGDFIELEAELADGEPEAAARAEIEALMAALGIAGASLVRGAYFDLQAEAARDAIRIGLERADQPEVVALIDELDAYQKPLSPPESHHGVDIETLLRPDVAFAVARDGEGRALGCGAVWCADGVGELKRMFVRPAWRGLGVARRLMAFLEDQARARGCEAMALETGVLQHDAITLYQRAGYGFCGPFGAYREDPHSVFMQKPL

SEQ ID NO: 7539 - protein, 223 aa, Chromobacterium substugae
MKIAMLALCSAMALSLPARAETPAQTENLFTLPLDAFQQSKAQPSQRVYLKPGVDLKSYHAVLPEPLLFMRQGPDGNWQLLQPGDENAIASYFHQRLQAELAAAGVPIALQPAPGVARLRVAVTGLSQERPGVDPIDLLPVKAVFNLARLAAGKEPYLLKIASMAQLEDSQDASLLAGTVNLRQNAKSKDKEQPLTLDLIKPLVDDWCRQSARQLAAHLGKAP

SEQ ID NO: 7540 - protein, 61 aa, Chromobacterium substugae
MTSPDGPSPRNLLQYWLHKLTGSRLSAHDELHFGHLQEEFALNLAVILCILLLTLFTYLRN

SEQ ID NO: 7541 - protein, 251 aa, Chromobacterium substugae
MAGDGATPPRLAGGERAMGKMKGGWLLLAGLAQAAPAAHYQSYTLAVEPWGMLDTDRGVGPDFIRFLAAQAGFEVTAEARPYRRVLDGMRSGENAINLGIPSPERNRYGIAICTIGSVKVSLVYLKSAGREHHSAASFSGLQIGELRGSRTLEEFDRTVKHRPVLLSDMSQGMRMLDATVCVRPGCGNLLAEAGVEPAGLGEWLFAEQPLEIYVSRASALSRDAAAMLRLRLACDSAAGRQEMRRLLAPYR

SEQ ID NO: 7542 - protein, 228 aa, Chromobacterium substugae
MSISSTSSDSNTYWQQMQALHQQRRQDVNNLTQSVQQGDISGAQQALAALQQLNGSNSSSASGSQDFSAALNNAISSASAAGSSTTAASAADPFAAANSSTTSGASSSISSLLNTLGQDLQTGNISQAQQDFQQLQQGLQQAGGTQQASAGGHHHHHHHGGGENGGQSGGQNELLSALGGTSQTSGASAAGSSSSSATNTQQLQAALSLYQANAGSNDISSLLMSLSV

SEQ ID NO: 7543 - protein, 202 aa, Chromobacterium substugae
MLGALCRRWRRSRLRDPRYAGLFDGHPDELVSLDCETTSLDVSRAELLSIGAVKLRGNRILHSEALYLLVRPGIAPAGDNIAIHGLRRRDVGQGLAPEDAVRRLLDFIGGRPLLGYYLEYDVAVLDKYVRPLLGIGLPQRRIEISSRYYDYKLRQHPGGHIDLHLSCLYRELAIPEPPRHDALGDALGAAMLYQALRQRGFG

SEQ ID NO: 7544 - protein, 601 aa, Chromobacterium substugae
MSRFDFSHPPFDSLTPAEREALEARADIVYHPDGAQVCGPGQPIDALYVVLKGVVCELAGDEAVARYLSSDSFDARAVAAGQTLHRFVAEEEALLLALPRDALLALTEKNPQFGAYFYASASQKLSLLAQRAGGRELQTLLAATVRDAGCRQPVFVDAAASIRDAARAMRAQRSKSVLVRDGERLGIFTTTDFRDIIIDGVDSGEPVGRHCSYTLLTIDIDDFLFNALLLMTQRNLRRLVVTEDGQAAGILAQVDVLSYFSNHSHLIAQRLERAQNLEQLADAARQITRLVGILSGHGVRPLQLGRLVQALNARLFARAWQMIAPPALLENSCLLAMGSEGRGEQLLKTDQDNALLLRDGFAPDGLAACCDAFSAALAGFGYPPCPGRVMVNNPRWRLSGAQMRQRIDGWIHDSDGETMMELAIFCDAEAVCGDAGLLDDCRSYLRDGLQDDAAFFSRFARAIGQFDTPLGPFSRLRTREHDGRELLDLKKGGIFPLVHGLRALALEHGVREASSQQRARRLAEAGQLDPALADDILEALAFLLQLKLDHGLRRLAEGREPDNQIEPAKLSTLERDLLKDALAVVKRFKSQLQHRYRLGSF

SEQ ID NO: 7545 - protein, 260 aa, Chromobacterium substugae
MCQLLGMNCNIPTDILFSFEGFHRRGGLTDHHADGWGIAFFENKGCRVFLDDKPSVESPVADLVRRYPIKSENVIAHIRKATQGEVNLANTHPFMREMWGQYWIFAHNGNLEAFQPEPGQHYRPVGTTDSERAFCHLLEKLRAKWSEPPELEALFDEVARLSDEISASGVFNFMLSNGEALFTHCSTHLHYIIRRSPFNTAHLVDDDVSVDFATVTTPRDQVAMVATQPLTDNEHWQALSPGELILFRDGAPLLSRTRPA

SEQ ID NO: 7546 - protein, 303 aa, Chromobacterium substugae
MDRLTAMQVFAEVAQLGSFTAAGDKLDMSRPMVTRYVDELEQWLGVRLLQRSTRKVTLTDAGLACLARCQQMLELAAEVRADASQRDGQMRGLLRVTASTSFGQAVLAGAIAEFSERHPQLRVDLQLGDRTVNLIEERIDLAIRITNEPDPGLVGRRLCDCRSLAVASPAYLARHGVPRHPLELEAHRCLSYSNFGRSEWRFQQGAEEALRVRVSGRISANEASALLSAALAGAGVSLQPSYLAAPYVRRGELVALLPGWEPAVLGIHALYPSRRLLPLALRGLLDFLAERFSGPQAPWDRQP

SEQ ID NO: 7547 - protein, 286 aa, Chromobacterium substugae
MIRQTLIAAALSAAGFAHAGDLKLSVYNADGNSFNVSSVLVSGDKDAVLIDTGFTRADAYRIAARVLDSGKNLKTIYISQADPDYYFGASVLKQIFPKAELVAAPEVLAHIKGNVKGKVAFWGPKMGANAPQAKPLLPTEIKADKIMLEGKALELRDTKGVMAHRGYVWIPSIRAIVGNVGVYSGMHVWTADTQNDAERKGWYKQLDDMEALKPETVVPGHMIAGDKMDVSAIRYTRDYLKTFEAKNAATRNSGELIEAMKQAYPQAAEVSTLELGAKVRKGEMKW

SEQ ID NO: 7548 - protein, 233 aa, Chromobacterium substugae
MVSERAMKLHYFYDPLCGWCYGASPLLKAVAALPGVSVEMHAGGMIDESEGRTVTPDWRGYVMPHDARIAQMSGQPFGDAYFNGLLKDIGAPLASDPPIAAILAAGKLGADPLAMLARIQRAHYLEGKRIAELETLSELALEQGLAAADFALAWREARAEAERHIAQTRGLMSQWGLRGFPSAVLEQDGKLERLELSGWFGKPEQLAAELAQRLPKLAASGDDALFCTPDSCR

SEQ ID NO: 7549 - protein, 440 aa, Chromobacterium substugae
MHKGISRVLRGMTLAAALAYGGLALAACPNWAEGTAYKAGDVVSYNNANYTALVAHTAYVGANWNPAASPTLWTPGGSCSGGDPTPPTPPNPPTPPSPPPGNTAPFAKHALIGYWHNFANPSGSAFPLAQVSGDWDVIVVAFADDAGNGNVSFTLDPGAGSVAQFIQDIQTQQAKGKKVVLSLGGQNGSVTLNNATQVQNFVNSLYGILTQYGFDGIDLDLESGSGIVVGAPVISNLVSAVKQLKAKVGPNFYLSMAPEHPYVQGGFVAYGGNWGAYLPIIDGLRDDLSVIHVQYYNNGGLYTPYSNGALAEGSTDMLVAGSKMLIEGFPLGNGASGSFKGLRPDQVAFGVPSGRSSANSGFVTADAVAKALSCLTALQGCGSVSPAQAYPTFRGVMTWSINWDRHDGYPFSKPVAASLHQLPATQAKVKKAVRAVRTAW

SEQ ID NO: 7550 - protein, 242 aa, Chromobacterium substugae
MTITVNGVEISEDMIASQLEHYSDTPSPRDTAIQQLILHTLLVQQAKSEGLDVADEQQAIQALLDQKLQVAPIDEASCREFYEQYPDRFVSGDSAVASHILLPKGEGLEAGLIKAKAEGILAEVQAAPSRFADLAREHSTCPSGQQGGSLGQFGRGQMVPEFEQAVFSTAAGEITPHLVETQFGYHIIQVNERAEGSKIGFDEIKDRLQQYLTDLAANQAMHEYLNGLVGAADISGYSMSAQ

SEQ ID NO: 7551 - protein, 260 aa, Chromobacterium substugae
MRKLLLTTALVAAFAGSAIAVAGPSINGQQITDARIDAVAKMMEAQGQNVTPQARDQIKDQLVTAEVLRQEAVKKGLDKSPEFTAELANMQAMALANRLVKDFEKANPVSDADLKAEYDKLAASVPETKQYHARHILVKTEAEAKAVIEALKKGKAFDKLAKEKSIDPGSKNKGGDLDWQEAGTFVAPFSEAMSKLAKGEVTAKPVKTEYGWHVIKLDDVRTQRNVPSLEEIRPQLTQRVMGSRIEKYVADLKAKAQIQQ

SEQ ID NO: 7552 - protein, 264 aa, Chromobacterium substugae
MKHSRIAALLLAATISLPAAAESIAVVNGTSIDKAELDAAVANVVQSNGGKVQDSPELREQLKSSLINRELILQEAARRGLDKQPAFAQRLNEVRAGMLRDALFGDIVQKAGIDDAQIKAFYDQQAAKLAAAKEVEVHAYQITLANEADAQKVIAALKKGAKFEDLVKSKSIDPNAKQSGGDMNWGNLSQMDPKLAEALKPLSKGQYSSKPYQSQLGWHVFKVADIRNAQLPPLEQIKPQIARQLQEEAIAKAVEDLRAKSKIQ

SEQ ID NO: 7553 - protein, 82 aa, Chromobacterium substugae
MLEAALQSLAPEHLDIQDDSALHAGHAGARDGGGHYTLTIVSARFANLNRVQRHRLVYQTLGELMTSRVHALAIRALTPEEL

SEQ ID NO: 7554 - protein, 100 aa, Chromobacterium substugae
MLYAIIAQDAPGTQEQRLAARPAHLARLQALQDAGRLKLAGPFPAIDSIDPGPAGFTGSLIVAEFASLDDARAWAAADPYAAAGVYAAVEAKPFRQVFPA

SEQ ID NO: 7555 - protein, 177 aa, Chromobacterium substugae
MKFFTDLLPVLLFFGAYWLTRDMFVATGVAIAVTVIMVAWAWIRHRKVETMQWFSLALIVVLGGATLLLHDKHFIMWKPTVLYWAMGAGLLISDFAGKNGLRMMMGQQISMPDPVWRKLTWAWGGFFAMMGGLNLFVAYHFSEDVWVNFKLFGGMGLMLLFVIAQSLFLAKYIEEKK

SEQ ID NO: 7556 - protein, 42 aa, Chromobacterium substugae
MKILLLLCAVVAAGLWLYIRKTWLESEERIHLSHYLPDRDHV

SEQ ID NO: 7557 - protein, 195 aa, Chromobacterium substugae
MFQLQARASAEIEIRKSRFIGVLLPAASRAEAESALADIRRQWPDARHYCAVLLCAGDSMLDDDGEPSGTAAKPMYNVLQHKEITNVLAVVVRYFGGIKLGAGGLVRAYTQAVNAALEQASLAEVVKMRRLRLAVDFSAESRLRRLCQELGFAVLALEYGEQALLTIALPEAACGAGVARLTDGMSGAIRLLSDG

SEQ ID NO: 7558 - protein, 310 aa, Chromobacterium substugae
MTQKQYRLVTRSDFDGLVCAVLLNELKLINEVKFAHPKDMQDGKVDISADDITTNLPYVAKAHLVFDHHLSETLRNATDADNYVIDAKAPSAARVVYNHYGGKKTFPGISDEMMAAVDKADSAQFSAEEILNPKGWVLLNYLMDARTGLGRFREFKVSNFQLMMDLIGYCRNHGIDEILQLPDVMERVALYREHETQAKEQILRCSRVHGNVVVLNLLHEETIHPTNRFMIYALFPDCNISIHVMWGLNRQNTVFAVGKSILDRSARTNIGALMLQYGGGGHDAAGTCQVPSDRAEDVLDELLSRIRGLG

SEQ ID NO: 7559 - protein, 219 aa, Chromobacterium substugae
MSRSFDALLFDMDGLMLDTERISNETWRRAGAELGIEIKEEMLDAMVGLSFKDCVDFVAEYLDDAEAADRLQLGSDKHYQHILRHEPIPLKTGILELLRWAEQQGIPRAVATSTQRFKADLKLTRSGLDAFFDITVAGDEVPRAKPAPDVYHAAASRLGVAPQRCLVLEDSRLGLQAGVAAGARVILVPDLLTPSAEDRASALAVCGDLHQALELIRAL

SEQ ID NO: 7560 - protein, 215 aa, Chromobacterium substugae
MQSVLIANPKGGSGKSTLATNLAAYFAASGKKVMLGDVDRQQTSLHWLAQRGAGLPGIAGWEVAPNEPKRPPKGTEVVVLDSPASLHGKKLTSLLSQVGHVIVPIQPSPFDMWASEAFFEQMLEEKAIRKNKAYMAVVGMRVDPRTRSARELEQFLARHDVPVLSWLRDTQLYVQAAAEGMSLFDLPASRTLRDREAWLPILRWLGEDPSAWCDK

SEQ ID NO: 7561 - protein, 316 aa, Chromobacterium substugae
MIQTELNYGDVYLVPKKTVVDSRKECDTGVQFGPRRFAMPIYPSNMKSVVSAETCEFFARQGWFYTMHRFNVDAVAFTADMQGKGLFASISVGVNDDTYEQLAALQAAGLSPEYMTLDIANAWCVKAERMIKHIKRHFPATFLIGGNVATAAAARDLEAWGCDAIKAGIAGGRVCITKNKTGFHRPMISTVRDCVGAVSVPVIADGGIVEHGDMAKAIVCGAAMIMAGSLFAGYDESAGEIVEIGGKHYKEYFGSASQFNKGAYVNVEGKKILVEYKGSIPKLLRELQEDLQSSISYAGGRTLAALRDVEMIQVHR

SEQ ID NO: 7562 - protein, 154 aa, Chromobacterium substugae
MIYFEDLQPGQRFLSPTHTLSEAEIIAFARQFDPQPFHIDPAAAKDSFFNGLAASGWHTSSLSMRLVEGSALGQAANGLIGMQIDQMRWPQPTRPGDTLQVEVEVLDKRRSGSQPGFGVVKVRWQTRNQRGETAMQLECAIWLQCRDSQVPTAD

SEQ ID NO: 7563 - protein, 256 aa, Chromobacterium substugae
MQNFKLAQPDAVLRYHDLPGHGAPLLMLHGLGCASSFDYPRLLAEPALAGRRALLVDLLGFGFSDKPDDFRYDTGSQALALSQWLERLDLPAVDLFGHSMGGSVAIELATLQPGRVRRLIAAEPNLDSGGGSFSRALAAWDERDYIERGHAEIIAACRGDNPAWAGSMAAASPLAAHRAAAELVKGRPVGWREQLLALTMPRCLIFGAKSLPDPDTEWLPRHGVAIRIVADAGHSLAWDNPAGLAAAIAGALADPD

SEQ ID NO: 7564 - protein, 188 aa, Chromobacterium substugae
MDDILRDIPDQIESERLILRSPQPGDGPIVYSAVCASLEALRAFPASMPWALEEPSVDISETFCRQSRVDYLSRKTLTMLLFLKDGGHFVGASGLHDINWKHRRAEIGFWVHRDWQGQGLVSEAARAICAFARQELGLRRIACLADEQNVASRRVAERAGFTLEGIMRQERIAPDGSLRNTTLYALTN

SEQ ID NO: 7565 - protein, 856 aa, Chromobacterium substugae
MALAAAPLQHWRQTLADKRQQLAERYRAERNPQAYLRHYSQAVDEVLAELWREQGLDESASLIAVGGYGRGQLFPGSDVDILILLPEPTPAETADKASRFIALMWDIGLEIGHSARTPGECLREAAADITVETNLLENRLVAGPAEPWRALMARLEAQRDPLAFFEGKTLEQQQRHTRHFGVSNNLEPNLKESPGGLRDLHTILWISKATGLGDNWDALVRRGILTLAEARLIKHSEDQLLKLRIDLHLLARRREDRLIFDLQQQVALAWGLADTPAKRASEQLMQLYFRAAKTVNQLNGILLPNLRGRIYCQVPRVTQHINDYFHSVNGMLGIREANVFDKHPQAILEAFLTLQRHPELSGFAPRMLRALWHARSQINERFRQDARNRQTFMQIFREPAGLTRTLRRMNLYGILGQYLPNFGQIVGQMQHDLFHVYTVDEHILMVVRNLRRFAISAYNHEYPFLSRLIGDFEQPEVLYLAGLFHDIAKGRGGDHSQLGMADAETFCRQHGLSEENSRLVSWLVGQHLTMSSIAQKQDIYDPETVQRFADLVETPRRLAALYLLTVADIRGTSPKVWNAWKAKLLEDLYHATYRVLSRGGGMDINSELEARKNQARAQLRLHAIPDGAEAGLWAQLDTVYFLRHEAKEIAWHARALNRQLAPAQPMVRARLADDHEGIQVLIYSPDKPELFARACAFFGRTNYSIADAKVYTTRHGYALDTFHVFVPEHHDGDYRDMINFIEFELAASLAEDKPLQLPPPGRISRHLKHFPITPQVSMRPDDRDSAFVLSIVAGDRPGLLARIAKVLADYRLDVQSAKIMTLGSRAEDSFLIRGAALKDDKTALALETALIAALRV

SEQ ID NO: 7566 - protein, 358 aa, Chromobacterium substugae
MKLIHRYIVSTLTQSTLFTLLALLGLYGFFDLLGEVPALGTGNYTAGVMAGYVALLMPGHAYELMPLAVLIGGMVAMTQLASSSEYTVIRTSGVTLRQIAATLLKFGLGFAVLTILLGEFLSPWAMQEAERMKLSATHSMVAQEFRSGIWVKDNQNFINVHEMLPDNTLLGVRIYTYDQNFKLVRTRLAEKGTFLKNERSWQLENVKETEIARDHTASSTYPLLKWKSIVEPEILSVLLVVPEQMSALNLLTYIEHLKKNKQQTQRYEIALWSKLFYPLACISMALVALAFTPQQRRHGQLGIKLFAGICLGVSFHFVNRLFGHLGLLYDWNAILSATLPTLSFLLAGIAIIVKQERR

SEQ ID NO: 7567 - protein, 366 aa, Chromobacterium substugae
MVFQKSLTRELTLTALGVFVVLLAIIVSTQAINLLGRAAEGQIANEAVTALIGFWTLGFFPVLMILTVFVSVLVVLTRSWRDHEMVVWLSSGLSLRDWIWPIMRFALPLAILIAGVTLFVGPWADQRSQDYAEIIKRREEISAISPGVFKESASSTKVYFIENYSGLHSAATNIFMQDMTDGKVSTIFAKHGYISTKPDGERVLVLEDGQRYVGEPGKADYQVGEFKRYTASIGEGQAINSPASNRQSIPTSQLLGSGNPEYKAELAWRLSMPISCIILALLALPLSYYNPRSGHTYNLLFALLAFFVYQNGLTVARNWITQGKTGVWAVAVVHILMLLLALALLKHRNRPQIPFGQSLAQMLGKN

SEQ ID NO: 7568 - protein, 521 aa, Chromobacterium substugae
MEFNIKSGSPEKQRVACVIVGVYESRKLTFAADLLDRISNGFISDVIRHGDMEGKLGSTLVLHSVPHTLCDRVMLVGLGKEREFRAKEYREAVRASIKALTQTSAGEAVSYLSELTVKKHDVEWMIEQAAVVTLDVLYRFDRFKSKSDEPVREPRKLTLAVPRRSDLADGEKGLQRGLAIGSGMRLAKDLGNLPPNVCTPAYLGGEALKMAEAFGAAAEVLGPKEIAELGMHSFLSVAKGSSEEARLIVLKHQGAKDKNDKPIVLVGKGITFDSGGISLKPGEGMDEMKYDMCGAATVLGAFRAAVEMNLPLNLVAIVPACENMPNGNAVKPGDIITSMSGQTIEVLNTDAEGRLILCDALTYAERFGPATVIDVATLTGACVIALGHIATGLYSNQDSLARELLAAGEEVADRAWHMPLWDEYQELLKSPFADMANIGGRPGGSVTAACFLSRFAKAYDWAHLDIAGTAWKGGKEKGATARPVPLLVQFLQDRADIALGNVVRRGRPRRETPEVAEDDQD

SEQ ID NO: 7569 - protein, 150 aa, Chromobacterium substugae
MRRLKWQKMTRIDFYTNVADPQAFACRLADTVQRKQERLLIWLDSEREVEVFSNRLWSFGDTRFVPHCRLEAPEAGQTPVWLTARLPDDLAHPVLLNLGPQLPYAIERFERILEIVGRDPASLATARERFRAYREHGCEVQHHDMSQTSS

SEQ ID NO: 7570 - protein, 711 aa, Chromobacterium substugae
MTESPKANDADWNGLNLPVLTDVVEEPAVPVLAEEAPAVAAEVPEFDFSSELDVLAAELDGEAELEIPELSLADLLADDAPAADESASLGGLDFSNLPSLELSDADGADESADGLGFVLEPRDAQLPSAAPAAEDLTPSEPVEAKAAEAASASTASAEPELSWEDVVAASSQAAESALAEPMALDMATPEESGEAAPHSEPSPIAEPPAFTSISIDSLPSGVLGGGVGREPAPAETGLEWLSSLPKPEIPPASQEQVLQEAERVLADERAMQDAGQATAPELSEAIAEPEAPMPEELPAAEAAAQPEAAAAFEPVEAETIASFDMPVVTDAQEPEPAEAAAALEVGEAIAEPVAPMPAELPAAEAAAQPEAAAAFEPVEAETIASFDMPVVTDAQEPEPAEEAAALEVSEAIAEPEAPMPEELPAAEAAAQPEAAAAFEPFETEAIASFDMPVVTDAQEPEPAEAAAALEVSEAIAEPEAPMPAELPAAEAAEQLEPVAAFEPVEADVMESFDMTVVADALELEPEPAEAAAALEVAEAVIEPEAPMLEAQLVDEAAESGDAAFGVVEDEDLPALSGLLGGRSGHAAPEAAQPPAGDASVLPALAEPSPVAVVKIAAMAAAGSAGRGPAAPPFDEQALFNSLYEQMLPRMKVELSLWLQEAVEVQAKQMLSGMMHQLKEDYEMLFGDALKESLRQALGDVGASMKDGDGHG

SEQ ID NO: 7571 - protein, 183 aa, Chromobacterium substugae
MADRLSDIVTRTGDDGSTGLGDGSRVAKDSARIQALGDVDELNSVMGVLLAEPLPEPLPQWLSEVQHDLFDLGSELAVPGYQAISDSHVQALEGLVSFMNEELGPLREFILPGGLRSAALAHQARSVCRRAERAVVALAREEEPSQALRRYLNRLSDFLFVLARYLNRQGGVPDVLWQAGRQR

SEQ ID NO: 7572 - protein, 556 aa, Chromobacterium substugae
MASTVLLDLIGGVALLLWGLHMVHSGIVRAFGANMRHWLGRALRNRALAFLAGFGMTALLQSSTATALMLTSFSVSGMVELTPALAVMLGANVGTTLIVQLLSFHTSLFSPVLLIGGVIAFKRGSGTLTRDMGRVAIGLGLMLLSLHALMETLAPAENAPLTREVLAALTHDPMLNLLIGAFLSWAAHSSVATVLLVMSLSASHFIAPGAALALVLGANLGSAINPLLEAASGGNSAARRLPLGNLINRVAGCAIFLPALGPVAALLATVDPDPWRQPADFHTAFNLLMAALFMLPLKPLAGWLERLLPEQKAVDDLSAPQYLDASALETPTVALACAARETLHMGDIIEDMLRKTMTVLQTDDRKLMADVSRLDDAVDGLHEAVKFYLVRLTSNSLEEQEGRKAMEIMALSVNLEHIGDIIDKNLMELAGKKIKHKLQFSREGAEELAAMHRTLIGNLKLAFSLFLSGDIGSARRLLDEKAKFRELELAMSESHLARLREGRLESLESSSLHLDILRDFKRIHSHICATAYPILEEARELHPTRLKPLPLIGTDT

SEQ ID NO: 7573 - protein, 88 aa, Chromobacterium substugae; identical to SEQ ID NO: 5797

SEQ ID NO: 7574 - protein, 95 aa, Chromobacterium substugae
MPAAAAAILDIAENLKMKKLNAVLALALTLGAAAAQADDLAAIRKAGVLKIGTEGLRAAVGRRCGARHNECEWRRSRGFAAAPHDRLEGEGDKNR

SEQ ID NO: 7575 - protein, 226 aa, Chromobacterium substugae
MGAAFAQAADGVALPLALPAPGAGFAEQLAGVRGEVERFIADGDAAAPTALSPEAWRVQQQMKAGQAMPAVPPDRQAFVAELAPYAREAADRLGVAPDILVAHAALESGWGRKPLRRADGGDSHNLFGIKADSRWRGEVAASLTTEYLDGKRQSRVEPFRAYPDYRAAFADYADLLATNPRYRAALGVGSDARAFAGALARGGYATDPDYAGKLAGLVGRLRGESL

SEQ ID NO: 7576 - protein, 141 aa, Chromobacterium substugae
MDRQQDLRRLFATVADDLAAYPLLQACLERQFAAALAHDAQALSVCADEIGALCRRLELSRRERLGAAERLLPAGAELTMAAVLRALPERQREQGERHWLRLRGMVADCRELNLRNGQLLQQRRLLLQRVLEGESDVYAAQ

SEQ ID NO: 7577 - protein, 85 aa, Chromobacterium substugae
MQISSLSSWRADKAAPAKTDAAATADAPARPAPAAAEAPLAAALQAMPEVDLAKVDAVRAALARGEVRFDPQRLAGLIEQYHGGR

SEQ ID NO: 7578 - protein, 228 aa, Chromobacterium substugae
MNQEQVTQMLRQTPLFGHLADDTLDRALECCETVRLARGEALYEEGDASDAVYLLLGGCMQVYVADAVGKKYVLQMAMPGGMLGMESFVDGGGRGSSAVADEESVLLMFSREALSGLFDSEDGLPGCDKVRSSIMCYLVSLVRHMTTLARNLALLDVYGRVRILINQMLIEQDGVLILRKQLTQQEIADQIGSSREMVARILKELIYGHYIRMENRRIVVLKMLPENF

SEQ ID NO: 7579 - protein, 329 aa, Chromobacterium substugae
MAGLKKKDEHEGAVIKRVSRRHEEEGHGGAWKVAFADFVLALMCLFLVLWVLAARDQENLRQLLTTSGGSPLMQGDGKQIDHMGNPPGSLIPRDPIPGPTGSQAASKSALRDSDKRSAQDQPEMPRRSYDSEADLRKLAAQLSTMSQQAGLSSNLQTIITPYGLRVTLHDTDQQGMFERGSAIVEPRFRGLLQQMGAMLGEIDNQILLVGHTDAAQYHSAGGFAALSNWSLSSNRAMAARMHMLQGGLAPASVLQVVGMAERAPLDREHPLAAANRRIELLILTSGQAQAVVAMFGSAADGKTGLPGVASALPNEKDLQKLRENTIGIR

SEQ ID NO: 7580 - protein, 288 aa, Chromobacterium substugae
MQQLFGILIVLVCVFGGFMLHGGVLSVIWQPVELLIICGAALGAIVLGNPPHVLKEMGGQLKRVATRKKQGAEFQRQQLLLMYELLITASRGLKALDQHVEAPRQSPLFNRYPLVLESPKLLAFIVDNFRLMAMGKINAHELEGVLDQELDAIHEQLNQPSKSLHKIAEAMPGFGILAAVLGIVMAMNTVAQGASAGEIANSVAAAMVGTFIGIFFCYGVLDPISNVMSQLVKEELSNFESVKVVLTTHASGKPPLLAIDAGRRLVQLNTKPSFSQLESWITMLEGQG

SEQ ID NO: 7581 - protein, 231 aa, Chromobacterium substugae
MYAESYAPAPHAADESRQLALYAPLVKRAARQLASQAGGVFDREDMEQIGLMALLDCLRRYGGEPDERFAGFAMLRIRGAILDELRRLDWRPRSVRQEAHRVRDGLRELRRKLRREPSEAEAMTLLSLDADAYREALLAENAEAMASFDELVASGMELAAEDSPEARLERQSELARALTALNEREQQVIQLYYEFELSLKEIAAVLELTEARICQINKSALKKMQACLMAA

SEQ ID NO: 7582 - protein, 145 aa, Chromobacterium substugae
MNSKTLIVAALVAALAASAGVGGWWYYQQSAHAAPAKPKPMDYRFVSLDKIVVMLRSEAGGDPRYMAVDLVFRSSPESEPKVKEQLPLLKSVAVRALSQLSRERANALGIDDYQRLLDKAYRASAAREQNELPFSEVMVSKLIIE

SEQ ID NO: 7583 - protein, 331 aa, Chromobacterium substugae
MAPPQAGNALPAMADDVVGQALDIDSLSLPAGQPAQDFASALLALRQAPPADAAQPQLAPSQGAQPAAPALAAAVADEAKPSDGKQDQDEGGVAQVDVAALSPAMQPPLVWPQLQPAPLPAVAADAQPQPSEPAPRAIAAAAPSLLDAKALAALTADAAAPRADAQQTALLAALPLPAPHAADNAKPADTFSLQLPASQPDSWSGKLQAALGERLQVLSSQNQDRATLRLDPPALGTLEIAIRHQAGALTVELTASHSEVVKQLQTIGDSLRQDLGNRQYTQVAVEVKEGAPSGYGQGGRQNREQQPQQNPGRALREQGWQTAEAFELDQG

SEQ ID NO: 7584 - protein, 95 aa, Chromobacterium substugae
MPPFDAAAWSQAISQAGREQDWRKLAQLDQALRRLLSEGEPALDAGQRRLLTDAYRAALDCSQAEIDALRHKLAAMGQQREGQMAYAQFSEWEQA

SEQ ID NO: 7585 - protein, 130 aa, Chromobacterium substugae
MDYEAYRSYHAVNLEAQTHSASQVDLVLVLFDGLLEEIARARGHLQHRRFEQKGESINKCINILNGLSSALDFDNGGEVVTSLARLYDYCAHKLYQASVEMDVAALDEAEALLVKLKGGWIGVRDQDAAV

SEQ ID NO: 7586 - protein, 449 aa, Chromobacterium substugae
MAIDFNAMPPSTWADNLAKNSLGNMQTQLDNQTKAAKARSDALGQLQKALQDYKTSLGTLTNKKSLVAMNATALPDGAATVTAKGNAQPGNYSLFVEQLASAQQLAMGDLSGATAQAGDKFTVKLAGGDTFDVSMAGADRDGDGKLSPSELALAINRASGNGGKVNAMVLNNNGASQLVLSSGKTGLNGAISLDLSQVSDAGLKTGLSASRQLTQAQDAVVWLGGKASGVRMQQASNTFDNIDGVSFTVNKAMKDGDAPLQLAVSRSDNDTTANVQAFVDGYNKIYKAISDLSQPGINGATAGPFADDSSIRGLKSQLNAILRQSYDGITLGQLGISASRDGSLTLDSKKLGDALKNTPDALDRYFNGVGQSGALKQSSDYLDKWLNYSNGLIKQRKDSADRAQQDLNRRQDALQQQYQQTYQRYLAQFTQLQNMQTQMTQTMGMLGYN

SEQ ID NO: 7587 - protein, 145 aa, Chromobacterium substugae
MNTAIQQLNLLLQLRERDSRQLETELAGKRRLQERYRRNIARLEELNAASGASAAAGHPALALNCAGYKSHLAGLSQSQRQDLQLAEADAAVSQRQLLAARQRQEQAELLRDQSLLAWRDEQARTEQKRTDEAAGQAWLRGAAGW

SEQ ID NO: 7588 - protein, 437 aa, Chromobacterium substugae
MLRQALSQLSVPDAPVATVSGRLVGVSGLLLESVGCPLETGQRCLVETASGGWLQAQVVGFKREVSFLMPFKKPVGLATGARVLPAPESGGLSIGDGWLGRIVNGLGEPLDDKGRLGGDAPLAAHPPQINPLRKKPVDMPLDVGVRAINGMLTIGRGQRVGLFAGSGVGKSVLLGMITRHTEAEVVVVGLIGERGREVREFVEHALGPQGLAKAVLVVAPADESPLMRLKATELCHAIAAHFRDQGRNVLLLVDSLTRYAMAQREMALALGEPPATRGYPPSVFGLLPSLAESAGNGERGEGSMSAIYTVLAEGDDQQDPVADTARAILDGHIVLSRELAERGHYPAIDISRSVSRCMSQLVDAEHAAAARELRAAWGRYQEVRGLLPLGAYVPGADPATDRALRLQPGIEALLRQDAAEAASFADTRGRLQELARA

SEQ ID NO: 7589 - protein, 228 aa, Chromobacterium substugae
MKHWRPFRFPPLIDGAPLEPLAAAEAQASAADGFRQGMDAGYREGFDSGEAAGRDAGYQAGVALGRQEGVAAARAEELARFSSLAEPLDAAIEQLRRLCRDYQAAQRDEVVELVAKVARQVIRCELTLKPVQILDLVEETLAALPAASHSQGEVEVLLNPEECQRIRELAPERAAKWRLLADSGLAPGECRVRGAEFEADAGCQQRLAHCVDSLREQLQAEPAAQGEA

SEQ ID NO: 7590 - protein, 351 aa, Chromobacterium substugae
MDASNNFAPEAAPYVPAAAAGNGQMSAIEQAAVLLLCMGEEPAAAVLRCLSREELLQVTQAMSGMSGIKVDAVKTTMQKFFDEYREQSGVHGASRSFLKRSLELALGGDIAGSVLDTIYGDAIRPKMARLQWVSPQWLADRIAAEHVRMQAVFLAFLPPALAGQVVDALPAASRDSVLVNVARLTDVDRELLQELEELVNRCLESLHTQSTAVQGMQQTADIINRLPGDRSRMMELLRAHDPEIVDEIEVRMYDFFILSRQTETVLTRICEDVSLEQWAIALKGAEPAVRDAITQTMPRRQAQNFDATMRRSGPVPKSRVEEARREIMAQVRQLADGGEIDLQLFPEEVVE

SEQ ID NO: 7591 - protein, 557 aa, Chromobacterium substugae
MVKQLRSGFAAVQEKMAGRRLLPANAWRYLLPMVILAIGLSLALTLWLWRDDASYKPVFGAQEKVNSADMMAALDADKTPYRIHPQTGQVLVPEDQLGRVRMQLAAKGVVAQLPAGLELLDKNDPLGVSQFVQDVRFRRGLEGELVQSILALDPVRAARVHLSLPRSTSFVTAGTDKGSASVVVTLKPGQQLSSEQIAAVVKLVAGSVSTLDPAQVTLVDQAGNLLSAHVDLSDGGMVGSDNEAARRFREQALQNARDLLSPALGAGNFKVSVTADVDNDRVEETREKYGEAPKVTNEASREETSTERMALGVPGSLSNRPVNTDSSGPANEKSGNSKNAVTRQYAYDRNIMNIKKARGTLRRLSVAVVLNQAAAPSKKGWQPAELANIDKLLRNGLGISAERGDVLAVSTLNFAAPVAEEAFWQQPETWFEGARWLGYAIALLLAYLLLARPLLKIARQLAERKLGDYAPGEVDVTPEDPLLDNRPLREAAGQRQAALAAAPGDSPVVPLLENYDLPPAGSPVDVLVDHLKVLAAKEPERVAEVVKQWVQNNGRKQ

SEQ ID NO: 7592 - protein, 112 aa, Chromobacterium substugae
MANLGLMIHADRSQLLGEMAKLGQGAAAAPRPAADDAPAAQSFSQALVSAVRDVDQQNRLASDKMTEVDSGQSDDLVGAMLMSQEASLSFSMLMQVRNKVVGAVDDLIKMQL

SEQ ID NO: 7593 - protein, 280 aa, Chromobacterium substugae
MPKAKIVAPQEGARLQALDLRTLGRPIHLLPLFARALQQELGDFLERELNRRYHAAFRITALRQDLPAADELRWQWHALGDWQLGSHFDRSLLLGILDYRFGASAAPIAEDLPAETETERRLARNLAERLLPRLAAAILQLEQAPGAYGDKPRPQPFAGQPAWQLEIELSDGDAPRGALRLRLGESAFETLLQNLSGQRRKLAGDRAPGSFRDRLTLRLDARLLQQELPLGAILDLKPGSVLPVTLPPQAEVCVRGAALFRAHVAERQGKLCLSGFADTE

SEQ ID NO: 7594 - protein, 112 aa, Chromobacterium substugae
MDLKQDFDLDGILDSLEPEAAAAPAPAPRDMTPFLRKIPVKLTLEVGSADVSLADLCQIGAGSVIELDKLAGEPLDIKVNGTVIGRAEVVVSGENYGLRVVELNDLELDSLA

SEQ ID NO: 7595 - protein, 248 aa, Chromobacterium substugae
MKRYKLYAPLLAGLLLASPCGWADSLKLLTATSGGAAVDFTVKTQILILMTALGLLPVLALMMTSFTRFVIVLSLLRQALGLQQGLPNRLITGVALILTLLVMRPVGLQVWNEAMVPFDQDKITMPQALEIASKPVSRFMLAQTSKTALSQVARLSGEGDVARPEDHAFTVKLAAFVLSELKTAFQIGCMLFIPFLVIDLVVSSVLMAMGMMMLSPLVISLPLKLLLFVLVDGWSLTVNTLVTSIQAY

SEQ ID NO: 7596 - protein, 90 aa, Chromobacterium substugae
MLTPDIAVDIVNDSLRVVVTLVTLLVLPSLIVGVVVSLIQAATQINEQTLSFLPRLLIVLLTIALAGHWITGYLMDFCVAMFQRAASQVG

SEQ ID NO: 7597 - protein, 260 aa, Chromobacterium substugae
MSQGLFAQLLQLLPAIWWPFCRLMAAFSVAPFIGDAMVPLRARIALALLLAVACAPGMPAHSPIDPFSLHGVAASLEQAVIGLLFGFAFQLTMSILSLLGFLLSSQMGLSMAVMNDPGSGNTSDVVSNLLYLLAALLFFAMDGHLVLVQVVYASFRAWPLGGGIPQAALPVLAGSVAWVMAAAVALALPVVFATFLVQAGFGMINRVAPALNLFSLGFPVVTLFGLSTLTLLMQVLPPQYLSLSEQTLRLLDSLLELGHG

SEQ ID NO: 7598 - protein, 379 aa, Chromobacterium substugae
MAETRQGDKTEKATPQRLRKAREQGQVPRSKDLAAALGLILALKLMFWLAPDWLDDFRELFALAFAPLAGQGALENSWSKLFGGTLLLLLKMLAPLAVIPITMLLISLFPGGWVFVLSQLSPKFERMNPLAHLSRLASPKHASEIGKSIAKALLLGWLLYRIASSALQDFFALHGMPLLPTLAGAADLLLSCLLKLSAVFLLFALADLPLQVYLFMKQQKMSKQEIKEEYKNTEGRPEVRQRIRQLQQQIAQRGVRKVLPGADVIIVNPSHYAVALKYDENRAEAPFIIAKGVDEMALYIRRQAEELEIAVLPLPPLARAVYHTTQVNQQIPAPLYRAVAQVLTYVLQLKAFQTGSRANRPILPELAVPQELSDPKPAS

SEQ ID NO: 7599 - protein, 696 aa, Chromobacterium substugae
MNSLTKLLADIGRHKLAAPLFLLAILAMVMLPLPPLALDMLFTFNIVLAIIVILVSVSARRPLDFSVFPTIILATTLMRLSLNVASTRVVLLHGHEGTHAAGRVIEAFGNVVIGGNFVVGMVVFVILMIINFMVVTKGAERISEVSARFTLDALPGKQMAIDADLNAGLINQEQAQQRRRDIATEADFYGAMDGASKFVRGDAIAGILILIINLFGGVAIGALMHNLSMGDAFRQYALMTIGDGLVAQIPALLLSSAAAIIVTRISDDGDMQQQVGSQMLASPVVLMSAAGMMLVLAIIPGMPWPTFLGFAALLAYVAWRMHARRPVAASALNQTAIKAALQGEAEIELEWSTLPYSDVLGITLGYRLVALLDQGQGAPLLKRVKGVRQSLSEQMGLLLPMVSLRDDLRLKPSQYAIQLSGNTVAEAEVYADRLMAIPSPEVYGDIDGIPGIDPAFNMPVTWIAQADKSKALGLGYQVVDCASVMATHLNKVMREHLSELFRHDDVAALGERLTALSPKLGAALAAALPPVQQLKVYRQLLQDHVSLKDIVPVASALLEASETTKDPIMLAAEVRCALKRQIVQAIAGPRDEIRAFNLSAELENLLLAALSQAQQTGKPQLDSFPIDPNVLQQLQANMPVVRDQMKQMGQPPVLLVMPQIRPLLARYGRLFAPGLNVLSYNEVPENRQVSLTGTLG

SEQ ID NO: 7600 - protein, 42 aa, Chromobacterium substugae
MRRITISGAAPSLCAKRHPRVKACRTVFSACRLYAQGRIFLG

SEQ ID NO: 7601 - protein, 287 aa, Chromobacterium substugae
MANLKTANQIICDNIRIQLEQFRWPEAQQAGLIEQILGLSTSQAYRKLNGSSPWQLSQVERLAQYLNVPTSNLLVDHSQQHSQTPVDNELIPAILHLNNQSGEAHCWIQLGEPLADDSCAPLLLAKRLHDCWHVFPGTQFDAEDGYEVTYLTIRPPKRANTKRLLVAVLDDNDADLLSAILVQQGLFSLPYHHPKDLLEALPREDFDAFVLDWVLGEPTSCMDVIEAIRRHNPNVPIVVLTGYALEHESELSKALQMRGVYYIGKPTPGSILALQIKNMVTNGLEHA

SEQ ID NO: 7602 - protein, 539 aa, Chromobacterium substugae
MSKAFYITAAPVGAVPKYLDPQEPKFIPGLLLDNLVPNDALPEALQLLKREGWESVAAGGWLLQDGYEQAASREDICALSATQQAQSIKALLAAGWRLDNGVWRPQPSGHAASARRLPRALFDLLPSQALVRQLVQQLTTHGWECDERGDLVWTHPRLSSYLPPEMAAEIEAQSSEAASRFLACGWHASEAGMWQPGKARSPHLPITAERIVAESLHCAREGAAVIHLHTRDLADQAKLTIPGLGAPISAGQQRNQIVLDQYENIVPALRLSAPSVLLNLSTSARGDRAASQSALRRAHLKHYAGYAAPEIASLSPGPVVFQTGGGYDNPNGFLQAQLEHFQHAGVRPEIEVFNHIITENAVTLYRQPLLASGAPVLFMLVAGVDQHRRDPVSGEMDDDSLIDTASRKQIQAFLQQQDTVAAAKLAAECLRPTVKQLRQHFRDCRISLLLPGALHAILVDVAVALDLDGIRVGLEDGLNLIDPQAPGGIRKARSAEQVKALREELERRGHHVMSAEEVRRDLAMPRQTARAAQAEAAEA

SEQ ID NO: 7603 - protein, 568 aa, Chromobacterium substugae
MQAPWWLVASLLLLLLAAGWNFYRMDRASEALIGNGKSEQQYWTVAQLHVELERTRAELIGYAADEKQFPDLQQQLQVLQSRYQVFEAPDSVLVHRLLSRVSGFDALVGALGPLLGDKAWPHLTQAQARKMVVRIDALRPVLANFAVQTREAEVTARVARSSALASQRSQMLILQLVLCGGICGVLLMLMRYREVSDLAKARQSLLEQERLAHQATVALELDRTTFLGTLGHEIRSPLQSMQMCLELVEPAVSPHGPAQLALKRLKAGMAQLTSQVHDIMDVSAIKNMQLRLNPGRVRLAGALRTVVDVMQPLADAKGLALRYESEGLPEMVLMDEIRLRQIVGNLVSNAIRYTDQGAVAVKARGQMCQEHLELWLQISDSGIGIAEEDKQRVFQPFSQGRNRRPGSSGLGLSIVKELVRLFGGSIELESAVGVGSVFTVRLPLREVQEASASRSLLLVDDDEVIRASVAQLLAQDGFQIACASTLSQAADCLARQRFDILLLDMQLGEDSGYRLAELARKQPQRPLMLAMSADPEEFADVRAAWFAARLDKPFDGDTLRAALADLPL

SEQ ID NO: 7604 - protein, 150 aa, Chromobacterium substugae
MSACVLADSDPVVLTVSGKIGRFTDAKRGVYQFRDSDLARLRQMSFTTATSWTPSVTFSGPLVRDILAKVEAKGATVRVLAINYYRYDISVAELVRGKVVLARRIDNKPFDVAHYGPLWLMYPLPDMPDADKGPPLDAKLVWQVEAMEVM

SEQ ID NO: 7605 - protein, 285 aa, Chromobacterium substugae
MLSLYTNIAALNTKSNMNSTQNALSTSMTRLGTGQRINSAMDDAAGLQIATRLDAQSRGMTVAMKNAQNGISMMQTAEGALNEVTNILQRMKDLSTEGANGTATANDKTAMQSEYDALGKELNNIVSNTTFGGEKLLAKTGGKLAAAVNFQIGASSSEVMSTDVSTQITGLDTALQAASAQYKTPSATAGGEIGSAATIDLLNTALDSVGAVRSALGANSNRLDHVVNNLNNVNNNTLAAKGRIMDTDYASESSTMTAKQMLMQASTSMLKQSGSMNSLAMSLLQ

SEQ ID NO: 7606 - protein, 421 aa, Chromobacterium substugae
MNAQSNPFLFESAALTHLPNYGVVKTTQLAGYLSVGDAAGGWLYFCFSEASANPAQAPLLLWVNSHPRDSAPASLFDEHGPYLLDGNGRVYGNPFSWHHHVNYLVIDQPLGRGLSFSIHPRYLPESHDEACQQLYHALQEFLLRWPAYRQQDFYLFGSGAAGHTIARLANCILDGNGCGQPEIRLKGLGLGNGQVSPKIQLPSHIEYARQHRLINAEEEKRALEMLADFHDAHASPIPLRRSQASRSAREIEDYIQQCSGRDKHDIRHPPGDGRQRVDEYLAKPSAHQALHIDPRSRNELQPAPQQLSEAAWLDDSSHLFPRLLDQLKVLLYHGECCMEGNYLGMDAWLNTLLWQQAPDFREQKRQPWRPYGLPAGLIRRHRRLSQVIIQNAGLRVARDQPAIALAMLKNFLGEETDDAEP

SEQ ID NO: 7607 - protein, 338 aa, Chromobacterium substugae
MSSFKRLTIDDIAALAGVSRTTASMVLNGHAGRYRISQATVDRVEAVAREHHFNPSQQARSLRSRRSSSIGLVIPDLTNSTHAALAQALENGCRALGYQLLMVTSDEDPERESAGIGQLAARQVDGMIVVPCSGDAGRYQPWTRRLPLVFADRHIPGSGIPSTVTDAADSVARLLAPLLERDVAELAYFGGQPDLSASRERLAGYHQALRAQGMAPQPGWVAERDFQRESGYRLMADWHQRHGRYPQALFTASITLLEGVLSFIRERHRMREAPRYLLTFDDHPLLDCLPLAVDAIRQDSQALADASLRQTLALLHGEPLPAADIRIPASLNLRRLAG

SEQ ID NO: 7608 - protein, 310 aa, Chromobacterium substugae
MKRILTPLMAGMLAFGIAACSKQGPGASGGEASAPAAAGKATVGLAVSTLNNPFFVALRDGAAAEAGKEGINLITVDAQDDPAKQQASVEDLIQKKVGVILINPTDSAAVANVVKEATAKGIKVVSLDRSVNGAEVSSHIASDNIAGGMMAGQYLLGKLGGKGRIVELEGIAGSSAARERGEGFHHVVDKKAGVELLAKQPADFDRAKGLSVMENIIQGNKDIQGVFAHNDEMALGALKAIQAAGLKNVVVVGFDATPDAVASVKAGTLSATVQQQPALIGQYGVQTAKRLLDGQKVDKFIPVPLNLVKQ

SEQ ID NO: 7609 - protein, 312 aa, Chromobacterium substugae
MTPQQKANLQRLGPFIALVLVAIGLSVMSPDFLTVNNLLNVMRQVSINALIAFGMTLVILLGGIDLSVGSILALSSVLTASLLQAGVDPMLATLLGILAGAAMGLFNGLVISKGKVAPFIATLATMTILRGLALVFSNGSPITGFDSELFSMLGGGYIAGLVPVPVAWMLILFAGFWFLLKKTVFGRHLYATGGNEEAARLSGVKVDRIKLWVYTASGAMSAMAGVVLTSRLNSAQPTAGAGYELDAIAAVVLGGTSLTGGRGWIFGTLIGALLIGVLNNGLNLLGVSSFYQQVIKGAVILLAVLLDRSGKK

SEQ ID NO: 7610 - protein, 502 aa, Chromobacterium substugae
MQVTMRGIRKAFGPVTVLENVEFTLRGGEIHALMGENGAGKSTLMKILSGVHRADAGEILLDGRQAELRDTAAAEAAGIAIIHQELNLIPQLSVMENLFLGREPSRFGLIDYGRMRREARAQLSALGAEGIDPEQEAGSLSIGQQQMVEIAKALALNARVLIMDEPTAALTEREIDALFALMAQLKANGVAIVYVSHRMEEIFRICDRISVLRDGCFVGEREIAGTDFDEVVRMMVGREIGDRYPKREAVPGAVRLKVENLADENMIAGIRFEVRAGEVLGIAGLMGSGRSDILKTLFGAKRRTAGRVELDGEELKVAAPGDAIAAGLGFVPEDRKSKGLVLGMSLRENATLVHLDQYARLGVVQAADEKRAVDGLIAQLRIRARDAELDVKSLSGGNQQKVVFAKWLANPPKVLLLDEPTRGVDVGGKAEIYHIVNQLAAAGAAIVMVSSELPEVLALSNRILVLHEGRQAGIFDAAGCTQEILMAAATGGAVPTEIRKQA

SEQ ID NO: 7611 - protein, 132 aa, Chromobacterium substugae
MKKHGHLNRDIARILAGMGHTDSLVIADCGLPIPPGVECVDLALRLGEPGFAAVLDSVLADFQCERAVFAIECRQHNQAVQDKAEEMAQSGVALDFVSHEEFKQRCQAARAVIRTGECAPYANVILHSGVIF

SEQ ID NO: 7612 - protein, 296 aa, Chromobacterium substugae
MTRVLVVGSINMDLVVTAKRMPQLGETLLGDGFATYPGGKGANQAVAAARLGASVALLGCVGDDAFGRELLAHLASEGVDCRRVRSVAGSTGIAAITVSGGDNAILVAPGVNHQLTPADLDAAEQAFIDADVVLTQLEIPLATVRRAAELAARHKKPLLLNPAPAVPLPEELLQRVALLTPNEHEFLTMLAQPDADWRALLAERPGKLVMTHGEHGAYFALARGQLRHQPGFEVKAVDSTGAGDTFNGALAAFLPLGLEEAVRRAAAAGALSVTRPGAQGGMPTLAELDAFLEARA

SEQ ID NO: 7613 - protein, 247 aa, Chromobacterium substugae
MDWQQLFDLYWSAAKWQVNLLVVGNLLGGLCLGSLLGYERWYNGRAAGMRTYGLVCMASAAAITIIGYAGYWYGGAAPAAAPPDMTRVAQGVLTGIGFLGAGMIMKEGLSISGLTSAASVWMSSVIGILIGVGFYAAAIALTLMCMIFVTVVNRIENVLPRRVSLFVTVRLRPEHNWTVEALSDRLTPFGLQLHDESISIKAGPDCTEWNFMISAQNRRTFINVVDLARDIMAADHILELDVQPARN

SEQ ID NO: 7614 - protein, 387 aa, Chromobacterium substugae
MSQHTFSPDENVHCSPKDWYRMASEKPGFIHDEAQAAAIERLDSLWHQLVDFKSKRNRFLGRSLRSPQVPRGLYFWGGVGRGKSFLMDAFYACVPYRRKRRIHFHNFMAETHRELRKLAGSPDPLLAYADQIARATRLLCFDEFHVSDIADAMMLGRLLSALLERGVVVVTTSNYEPDGLYPNGLQRQNFLPTIELIKRELDVLNVDGGNDYRLRELTREPLFMVPADADSERRMAQLFKRVATGAELPQKSIQVLGREIAVKRMSPGVIWFDFAALCDGPRAQTDYLEIASEYHTVFLSGIPRLTAKQASVARRFTWLVDVFYDNRVKLIASAAAAPEEIYTDGVQAGEFFRTASRLTEMQSKSYLELPHQSMAQSHDQPPPGVAL

SEQ ID NO: 7615 - protein, 260 aa, Chromobacterium substugae
MSVAKTGARLWAGLLLACAGAQAQAAPRDLYFVTQLFPPFITDSADGKLDGALIAILREACRRADWNCKVQAMVWKRALLTVGQGGADGLVLAQDAPERRAVMELSKPVLASSYGLYVQSGSALRYRQPGDLAGKTMAVYGPSLSQASSERLVQGVSGVSLAVELDPETVLRKLAAGRYGADAVAFSNDDVARYWIKRDGLGNVRKLAEVKPLAYLYGFTRSRLKPGMLETFNRVLDDMCRDGSLARLAAPSGIRLATCR

SEQ ID NO: 7616 - protein, 294 aa, Chromobacterium substugae
MYKHLEDFVGGTPLVRLKRLPGDNGNVILLKLEGNNPAGSVKDRPALSMIRRAERRGDIRPGDTLIEPTSGNTGIALAMAAAMMGYRMVLIMPENSSAERVQAMRAYGAEVILTPAAGSMPAAIDLARSMEAAGEGRILDQFSNPDNPLAHYETTGPEIWEQTGGKITHFVSSMGTTGTIMGTGRFLKERNPAIRIIGVHPEPGSQIAGIRKWEDPYVPKICDFERIDEIQHVNQQDAEDTARLLARREGILAGPSSGGALAVALRLDAQLTGAVIVSVVCDRGDRYLSTGLFG

SEQ ID NO: 7617 - protein, 544 aa, Chromobacterium substugae
MHEIWTQQYFPAGGPALSALMAALPIVFFFVALAVLRLKGHVAGTLTVLIALAVAILFYGMPAKMALAAAAFGFGYGLWPIAWIIIAAVFLYKITVKTGQFDIIRASVLSVTEDQRLQMLLVGFSFGAFLEGAAGFGAPVAITAALLVGLGFNPLYAAGLCLIANTAPVAFGAMGIPIIVAGQVTGLDPFLIGAKAGHQLPILSVIVPFWLVMMMDGLKGVRQTWPAILVAGVSFAVTQFFTSNYIGPELPDITSALVSLVCLTLFLKVWQPSEIFTFDGRRAPSARQASGFSLGQVIRAWSPFLILTALVTVWSVKPFKAMFAKGGALEGWIWKLHVPGLDKLVLKTAPIVAHDTPYEALYKFDIVSAVGSAIFLAALLSMALLKFRPAEGARAFAETLAELRRPILSIGMVLAFAFVANYSGMSSTLALCLAGTGQAFPFFSPFLGWLGVFLTGSDTSSNALFSALQAATAHQLGVSDVLLVAANTTGGVTGKMISPQSIAVACAAVGLIGREADLFRFTLKHSLIFCSFVGAMTWLMAHMG

SEQ ID NO: 7618 - protein, 939 aa, Chromobacterium substugae
MTPAHADFLQDLRQTMPPARIFTDPLSTLAYGTDASFYRLRPQIVARVEDEGEVAALLRLARLHRVAVTFRAAGTSLSGQAVSDSVLAVLGDGFNRGQVLDGGARIRLGPGIIGAHANALLAPFGRKIGPDPASINTAKIGGIAANNSSGMCCGTRDNSYHTLQAIRLLLLDGAALDTADPASVAAFRESHADLLDGLAQLSRQLAGDPQLAERVRRKYRLKNTTGYGINALLDFADPVEMLAHLMIGSEGTLGFISEITFHTVAEHPHKASALVLFDDLDRCCRAVSALSAARDASGVSAVELIDSRSIRAVQGKPGLPDFLYQPVGLDSACLLIELRAESEARLDECSVQIEMLLAGFQPKVSSGFSRDARECETYWALRKGLFPAVGAARPLGTTVVIEDVAFPIHQLADGVARLTALFDKHGYDEALLFGHALDGNLHFVFAPGFESPAEVARYDAFMQDVSDLVAGEYDGSLKAEHGTGRNVAPFVRQEWGDAVWNIMRRIKALFDPEGLLNPGVIITDNDRLHLENLKPMPAADDLVDRCTECGFCEPACPSHGLTLSPRQRIVAWRRIRQLERDGEGAEELAALQAGYRYRAVDTCAATGMCATRCPVGINTGLLMKKLQGPSRRPALAGFAARHMQLMTAAARTGLKLAHVAGTQRLNALTRRRPGERKIIPLIPAALPRAAALLPKPGGEGEPVALFVSCVNRTLAEGEGGESVAAHTINLLRRAGFAPVYPPGHDGLCCGQPFASANAADALAISQASLNDALLQASGQGRHPVYLDNSPCAARVKQAQAEGLLDPRLQLFDAAGFLAEKVLPRLSIVRRLPQLALHIPCSATAMGAAGSLKQLAASCCDELTVPDIACCGFAGDKGFTAPELNAHSLRRLKPALPEACRHGVSMSRTCQIGLTEHGGIPYASIEALLDFCTTPINGPS

SEQ ID NO: 7619 - protein, 485 aa, Chromobacterium substugae
MSESKITVYPSRAFKDNARLALTDGKLRQSLRGSMDFLMAKRLAEFPDEAELSALRTLGEGIRQRCLSRLPDLLEQLEDKLAANGVKVHWAETAEEANRIIHGIVAARQGKLMVKGKSMVSEEVELNHYLADQGVEAVESDMGEYIVQLAGEKPTHIIMPAIHKTKQDIAKLFHEQLPDTPYTEDVDALIQIGRRVLRRKFLDADVGLSGVNFAVAETGTLCLVENEGNGRMCTTVPDVHVAITGIEKVVEKLEDVVPLYSLLTRSAIGQPITTYFNMISGPRKPGEKDGPREVHLVLLDNGRSQAYADEQLRKTLQCIRCGACMNHCPVYTRIGGHAYGTTYPGPIGEIISPHLMGLENTRDLPTASSLCGACGEVCPVRIPIPEMLMRLREESQRPAGERVAHPLRGQGAAASGAERMAWAGWRLVNASPNLYRMFGWAATRLRKHAPKNQLGWTQNHLPLTPAPKTLHELLREREANKGKSA

SEQ ID NO: 7620 - protein, 232 aa, Chromobacterium substugae
MSARASILQKLRAAPRQERARPDLAGHFQHFAAKDDEIARLRHWAAMMRSVKTDILWTREAEWDAALADWLAVHPQDSLLLSDTPHGRRLARRLEGVDEAPHIVWFDREVDGWKAELFDIAAGFTVARCGIAATGTLALWPDEAEPRTMSLVPPLHIALFDAATLYPDFYSALQGENWSAGMPTNALLISGPSKTADIQQTLAYGAHGPRDLLVLALLPPHIAIHDVEGDGR

SEQ ID NO: 7621 - protein, 247 aa, Chromobacterium substugae
MKTPADVYLFGTCLLDLFLPEAGLDAIALLEGLGVRVHFPQAQSCCGQPAYTSGHSKEALAVARAQLGCFPEDWPVVVPSGSCGGMIQHHWPKLFAGEADEMEACAIAGRVVEFSDFLLNHLDWQPQDLGPPTKVAVHTSCSARREMNVHKSSWALVDRLQNVERVVQDHEAECCGFGGTFSIKHPDIAGAMVADKAQSLQDSGAVEFVTADGGCLLNINGKLGQCGSGFQGRHLASFLLERTGGKR

SEQ ID NO: 7622 - protein, 128 aa, Chromobacterium substugae
MNQYFHNNGNMETLTAAERLAALGHESRLSIYRLLVEAGQQGMIASAIADKLSLPAATLSFHLSHLSRVQLVRSERESRFIRYFAEFDTMDALLGFLTRNCCQGQPCLPSASACSPRNAASAKGEDQS

SEQ ID NO: 7623 - protein, 137 aa, Chromobacterium substugae
MSRLKTVLVLCTGNSCRSQMGEAILNHELAGLARALSAGTAPQPKVADGAIEALRLAGLPTGDLYPKPVEAVMHEEIDLVVSVCDNARESCPVFPRPVKRIHVGFHDPHGEPLDSFIRVRDDIRERLVPAVREALGI

SEQ ID NO: 7624 - protein, 364 aa, Chromobacterium substugae
MATRQHAAATPAAQSAAMGRFERYLTVWVLLCIAAGIAAGQLAPGLFHAISRLEIARVNLPVGALIWVMIIPMLMKVDFGALHQLKQHARGIAVTLLINWLVKPFSMALLGWLFIRQLFAPWLPAEQLDSYVAGLILLAAAPCTAMVFVWSRLSGGDPLFTLSQVALNDAIMLFAFAPIVGLLLGISAIAVPWDTLLASVVLYILIPVILAQLWRKALLARGQAAFDAAMASIGPWSMAALLATLVLLFAFQGEAILRQPLVIALLAVPILIQVFFNSALAYWLNKKAGEQHCVACPSALIGASNFFELAVAAAISLFGFHSGAALATVVGVLVEVPAMLLVVKAVKASKGWYEGASGQRRDER

SEQ ID NO: 7625 - protein, 256 aa, Chromobacterium substugae
MAYPKVSLPKLSDVIVQQLEKRILDGVLKPGDRLPPERQLAEEFGVSRPSLREAIQQLASRGLLSSRQGGGTWVTDRLETAFSDPWEKLLGQHEELRGDLLEFRRVLEGTVARCAASRATQADLERLQRCVDRLQQAYRGGDLAEQAQADVEFHQAVAEASHNALFAHLSGSLLAMLHRHVKDNIANLFAVGEVAEALRGQHLAIWQAIRDGRPDEAQLAAERHLDFVSDTLQNQRQQAERDARARMRLAQDDAGR

SEQ ID NO: 7626 - protein, 340 aa, Chromobacterium substugae
MQNKDKHMTIVVTGAAGFIGSNLVKGLNQRGITDIIAVDNLSSGDKFHNLVDCEISHYLDKHEFLHLLLDGEYEGELTAILHQGACSDTMNHDGKYMMDNNYQYTLALFDYCQHEEIQFLFASSAATYGKGTVFKEERQYEGPLNVYGYSKFLFDQVLRQRMKEGLASQAVGFRYFNVYGPQEQHKGRMASVAFHHFNQYREHGKVKLFGGWDGWGDGMQSRDFVSVEDVVKVNLYFLDNPGKSGIYNLGSGRSQPFNDVAEAAVNACRRHEGKPALTLAEMISQGIVEYIPFPDALKGKYQSFTQADIGKLREAGYTAPMLSVGEGVDRYVDWLISRQG

SEQ ID NO: 7627 - protein, 195 aa, Chromobacterium substugae
MATLTPAQVEAVLEFWFGGSDDASLAAPREAWFRRDEAFDAAIRQRFAPLCRQLADGELEMADGDARAALAWLLAADQFPRNLFRGEARAFACDAAARQGAPRALEQGLDGGLPAVARIFLYLPFEHSESLADQELSLRLFEALDAEAGGNYLDYARRHHQVIARFGRFPHRNAALGRSSSAAELEYLAAPGAGF

SEQ ID NO: 7628 - protein, 317 aa, Chromobacterium substugae
MQELELDAVRLAESLARARVLVVGDVMLDRYWFGDVSRISPEAPVPVAKIGRSEERAGGAANVARNIAGLGGKATILSVVGDDEAAGVLERLLRDDGIATSFKRDAKIATTVKLRVVARQQQLIRLDFEDSPSHEILADKLQEFSAIVADHDVVILSDYGKGGLTHVARMIELARAAGKPVLIDPKGDDYSKYAGATLLTPNRSEFSQVAGSWRDEDVLVRKAQKLREELNLDALLVTRSEEGMTLFRADGALHQPTFAREVYDVSGAGDTVIGTLGLALAAGQSLPVAMSLANAAAGVVVGKLGTAVCSQQELFAL

SEQ ID NO: 7629 - protein, 439 aa, Chromobacterium substugae
MKVTVIGSGYVGLVTGTCLAETGYQVCCLDVDPRKIEILQNGGIPIFEPGLEEMVKRNVAAGRLHFTTDVAESVAFGEVQFIAVGTPPDEDGSADLQYVLGAARNIARHMADYRVVVDKSTVPVGTADKVRAAIAEELAARGAALPFSVVSNPEFLKEGAAIDDFMRPDRVVIGVDDERAAEIMRRLYKPFQRNHERVLLMDVRSAELTKYAANAMLATRISFMNELANLAETMGADIEQVRLGMGSDPRIGYQFLYPGVGYGGSCFPKDVKALVQTGKEHGHTLRVLTAVEEANDIQKLRLVDKVVGRFGSDLAGRRFALWGLAFKPNTDDMREAPSRVIVDELTRRGAEVVAFDPVATHEASRVMGGNARLRFADDMMAALEGADALLIVTEWKMFRAPDFDAIKASLKQPLIFDGRNMYDPSWLREQGFDYLAIGR

SEQ ID NO: 7630 - protein, 247 aa, Chromobacterium substugae
MNPLIAAADARIDSPVLVALDFDNAAKALDFASRLDPSECRLKVGKELFTSSGRNLVETLSARGFQVFLDMKFHDIPNTVAHACKAAADAGVWMVNVHASGGRRMMEAAREALAGYSQRPLLIAVTVLTSMDASDLAEIGIAVSPEEHVRRLATLTRDCGLDGVVCSAQEASMLKQALGQDFKLVTPGIRLAESGNDDQRRVMTPLAALQAGADYLVIGRSITGSADPLATLRQINQDIQQYRNQKP

SEQ ID NO: 7631 - protein, 385 aa, Chromobacterium substugae
MELDLWWLLLFPAFFGLGWFAARVDMRTVLKQAKAVPISYFRGLDALVDDKTDVAAQALSEVARQQGAALELQHVLGKLYRKRGENDRAIRLHQQMLDSSDLPGEHRDLVRNELAQDFRKAGLVDRAEEILLKLLDGNMALAARRQLLDIYQQDRDWKKAIETARELRSDAHSFQHEVAQFYCELAQGELYQSHYEQARQYVAEAIAANRKCVRASLILGDIEFAEGHVEAAMAAWQGIEKQNYEYLAMAAERLFDAYEKLGKPSEGIALLRGYQRTFPQLELTDLLYQKIATYEGEARALEGVREAVHARPSLSGVYRMIEAQMDELSPEGRMDAEVARALILKHSQRLSVHRCKCCNFRSRAFFWHCPACGEWESFTANRSEA

SEQ ID NO: 7632 - protein, 93 aa, Chromobacterium substugae
MRIVELALLLLLVAVTVQNSHAVEFKLFFGQSWSAPFIVFLLLFFVAGAVVGLLATFSFYLRTRRELSQLKKELRNRPPASKVVSDPSDAIAD

SEQ ID NO: 7633 - protein, 104 aa, Chromobacterium substugae
MTKSELIARLSERLAERNSQLVYKDAELAVKTILDAMANNLAQGSRIEIRGFGSFDLNYRPPRVGRNPKSGTSVSVPEKYVPHFKAGKELRERVDLSLLEQTQA

SEQ ID NO: 7634 - protein, 559 aa, Chromobacterium substugae
MENFAQLFEESLTLHDMRVGEVITAEVVAVDSNFVTVNAGLKSESLIPAEEFKNDQGVVEVAIGDFVTVAIDALENGFGETKLSREKAKRMAAWVELEEALEAGTILSGLISGKVKGGLTVMVNGIRAFLPGSLVDVRPVKDTTPYENKQIEFKVIKLDRKRNNVVVSRRSVLEETLGEERKALLETLKEGAVIKGIVKNITDYGAFVDLGGIDGLLHITDLAWRRVKHPSEVLAVGDEVEAKVLKFDQEKNRVSLGLKQLGEDPWVGLSRRYPSGTRLFGKVTNLTDYGAFVEIEQGIEGLVHVSEMDWTNKNVHPSKVVQVGDEVEVMILEIDEDRRRISLGMKQCLANPWNEFADNFHKGDKLKGAIKSITDFGVFVGLPGGIDGLVHLSDLSWNEAGEEAVRKFKKGDEVEAVVLSIDVEKERISLGIKQLEGDPFNNFVAMNDKGALVKGTVKSVDAKGAVIALDTDVEGYLRASELSRDRVEDARSVLKDGEEVEAVIVAVDRKSRNISLSIKAKDAQEENAAMKNLSTVDSASAGTTNLGALLKAKLSGSNE

SEQ ID NO: 7635 - protein, 222 aa, Chromobacterium substugae
MTVPVITIDGPSASGKGTVAALVASRLDFHYLDSGSLYRLLALHARRHGIAWDDEAALAGAAIVLPVEFSDGAVWLEGNDVSLDIRAEEIGIGASKVGALPEVRAALLQRQRDFRLAPGLVTDGRDMGSVVFPDAMLKIFLTASAEERAERRYKQLIGKGESANLPRIMQDIIDRDARDAARPVAPLRQEPDAFLLDTTELTIDQAVDKVLGWFEERQVSGH

SEQ ID NO: 7636 - protein, 70 aa, Chromobacterium substugae
MFHIDGARFIFGCVSRVGRKGERTLYPPPPPARNRRPRENGGIRSPARRRLALQCAVLPASFGAPTEPVA

SEQ ID NO: 7637 - protein, 429 aa, Chromobacterium substugae
MEQLHLLPCPRLAGAVKLPGSKSISNRTLLLAALSGGSTLVRDLLDSDDIRHMLGALKLLGVKIEQQGDSRDFRVHGAGGAFPVKNAELFLGNAGTAFRPLTAALALMGGHYQLSGVPRMHERPIGDLVDALNAAGARIAYLGQPGFPPLAISPADVRCAQPIQVKGNVSSQFLTALLMALPLTGGQAEIEVVGELISKPYIEITLNLMARFGVRVERDGWQRFVIPGGQHYISPGEVYVEGDASSASYFLAAGALAGGPVRVEGVGNASIQGDVRFAEALELMGATVSRGDNWIEARAEGKLKAIDLDCNHIPDAAMTLAVAALAADGTTTLRNIASWRVKETDRLSAMATELRKVGAVVEEGPDYLRVTPPAELTPNAEIDTYDDHRMAMCFSLVSLLGAPVVINDPDCVAKTFPGYFQALAALQAQ

SEQ ID NO: 7638 - protein, 148 aa, Chromobacterium substugae
MSDLFRMRRDFMRRFDIPSPSHPEYQPEQLAMWQTMLDEELDELKQALADYRELPAQSPEQQLRSRAELAAEAVDVLNVVCGLLLSQGLPLEAMCEAIHDANLRKCVDGKVVRRADGKVLKPEGWRPADKLEVIRQAQDRNNTSQSLS

SEQ ID NO: 7639 - protein, 181 aa, Chromobacterium substugae
MLRNSSQSYGRVARALHWLCALAVIAALVFIELKGNFPKGDPVRGGLSYAHIQAGLIVLLLVVPRLAWRLGNPPPGITPRPSPLMKLLAHAGHWALYALMLALPILGIAFIQARGGEVALFGLALPAMLAPDPAFGRQLKDAHELLGNVLLWLSILHAAAAVWHHRFVKDDTLTRLIGPLR

SEQ ID NO: 7640 - protein, 329 aa, Chromobacterium substugae
MTTSIKDVARLAGVSVATVSRVLGNGPVSPALRAKVEEAIAGSGYRPNLSARRLRSQSSLTVGLIVSDICNPFFTAVGRAVEDAAYRAGMRVILCNTDENPEKEAMYLRLMQEERVSGVILAATRATAARLDIAALGFPVVMVDRAGPGGGDAVLLDNAAAAGQLVAHLLEQGYRRIGGLFGNTSSTGAERHAGFAAALARAGLAADARFAAPSAAAAEQAVAAWLREDDPPQALIASNGLLLLGAVKAARALGVAVPRQLALAGFDNDSWTELAEPGMTVIEQPVDAIGREAMAMLLERLRQPERPPRKVVLSGRLVARGSSRRAESA

SEQ ID NO: 7641 - protein, 40 aa, Chromobacterium substugae
MIFAMLRLVSVTRKRLKIQQQHAALQYPYFIGTNELTEKM

SEQ ID NO: 7642 - protein, 833 aa, Chromobacterium substugae
MSDALLNPQLIRLGCRPADKDAAIREAGALLEAAGCIAPDYIDSLLRREAVANTYLGNGIAIPHGMAEDRAQVLRTGVAILQIPDGLEWNPGQRIHLLCAIAARSDDHLVMLRQLTRLLQDEARLLPLFTTTDSADLLAALAQPEAPLPPDAEAHDLDLCEEWRLDYPNGLHARPAALWVEAARRSPAQLQVRHGSQAADAKNLIALLQLGLRQGALLTVSARGPQAADGLKQLLRAMREASLAEQTAAAIAAQRAAAQRPRAGWQPSGQPVSLPGIAASPGLAIGTVRVLAGEQLRIVDRPVSLAEGGDRLHEALAATRRRLAALADATQATLGAAEAGIFRAQAELLNDTDLITLSCQLMVAGHGVEWSWHQAVERLAEKISALGNPLLAARAADLRDVGRRVLLELDPSLQGNAPGEFGPDTILLAADLAPSDTASLDLSRVKGLATAHGGPTAHTAILARTLGLPALVAAGPALLDVADGSPAILDGDAGRLYLNPSEHNLASARDWQQRQREAQQQQQQACLQPGQTADGRRVEIAANLNRPEQVAGALNNGAEGVGLMRTEFLFLERDAAPDEEEQYQTYLAMQQALQGRPLIVRALDIGGDKQVPYLNLPVEDNPFLGVRGARLLLRRRELLEPQLRALYRAAKAGKPLSIMFPMISSLKEITRLKGWCEGVRKELDAPPVPIGIMVEVPAAALLADQLAPYVDFFSIGTNDLTQYALAMDRQHPELAAEADSLHPAVLRLIRQTVRGAAAHQRWVGVCGGSAGDPLGAAVLAGLGVDELSMSPSDIPAVKAMLRRHDYARLQALAEQALSCDSAEEVRQLLEALA

SEQ ID NO: 7643 - protein, 318 aa, Chromobacterium substugae
MSPALHTITLNPALDQTVTLDELLPGGVNLARAAQLNAGGKGINVASCLADWGLPATVHGLLGRDNSGAFEQLFAAKRIHDRMLRLPGDSRVNIKLADLKSGRTTDINLPGLAAAEADLQALAARLAELRAGDSAALAGSLPPSLPPDALARLCRQLKRQGVWVLLDSSGPALASALANPPEALPDCIKPNREELAQWAGRELAALPDVARCAQGLQRRGIAQVVVSLGEQGAMLVDADCARLASLPPQRPLSTVGAGDALVAGLMAARQQGLAGGDALRLAVAFAAAKLQSVGPHLPAAEQIRQLADAVRLQDLAAA

SEQ ID NO: 7644 - protein, 555 aa, Chromobacterium substugae
MSIVAIIRSGERSTQARLAAEALRLAAQRRQLPIDIEIDGQPALSAGQIAAAGHVLLIGEEDDARLGRRAARRATLDAVLADPAGQLQVQEAGRALRIVAVTSCPTGIAHTFMAAEGLVQGAKALGHAIRVETQGSVGAQDALSDAEIAAADLVIIAADTQVAVERFAGKRLFKSGTKAAIGDGKALIRHAIEEAQPWAGASPAAAEAANQEKAKDGPYRHLMTGVSFMLPFVTAGGILIALAFALGGIYAFDDAHKGTLAWSLFQIGAKSAFALMVPILAGYIAYSIADRPGIAPGMVGGMLAASLGSGFLGGIAAGFIAGYGTRELNRRIKLGQHLDGLKPVLILPVLGSLLTGLLMIYVVGQPVAAVLAALTEALKGMQGSSALALGALLGAMMAFDMGGPVNKAAYAFATGLIASQVYTPMAAVMAAGMTPPLGLALATRLFRNRFSADEREAGKAAGVLGLAFISEGAIPFAARDPLRVIPALMAGSALAGAISMTMGVQLKVPHGGVFVLPIPNAVEHLGGYLIALAAGTAVTALLLGLLKKPLPQTAG

SEQ ID NO: 7645 - protein, 625 aa, Chromobacterium substugae
MSITRRDFLNGFALTVAAGLTPLEILRAAPRQISASYYPPSLTGLRGNHDGSFENAHKLGRAHHAYSLSGAKVEEHYDLVVVGGGISGLSAAHYYRKKHPQAKVLILDNHDDFGGHAKRNEFKVGDRLVLGYGGTESLQSPKHVFSKEALALMKELTVDIDGLASHFHRNFYPDLKLSRGVFFNKEDFGADKVVGGDPYLQVADDIDPKRLNARPIRDFINDFPMPKKDRDALIALHTSQRDYLGDMPKAKREAYLAKISYSTYLSRHVGLSATAIRFFQSRSNDFQAVGIDGLPALDARNLDLPGFHGVAGLGKISAEAEAELRDPYIYHFPDGNASIARLLVRKMIPQAAPGKDMNDIVLARFDYSKLDLPENPVRLRLNSTVVRVENGKSAVDIGYLDKGGQLRRVQARHTVMACYNMMIPHIMPSLPDDQKQALAMNVKAPLVYTKVVLKNWDSFMKLGVHELYCPSMPYSRIKLDYPVDIGGYQHPRKPSEPMCLHMVYVPTIAGSGLDPRTQWRMGRAKLLAMPFSEMETMVREQLQRILGPTGFDHQRDIAAITVNRWSHGYSYFLNSMYDDEDESKRIIAAARRPAGNVTIANSDSDWNPYTHAAIDQAWRAVNELS

SEQ ID NO: 7646 - protein, 408 aa, Chromobacterium substugae
MKLMKTLGLAALLAAAAQAAQANVDTDSVRRGAYLARVSDCIACHSAPDGKPNAGGLAMDTPVGKIYSTNITPDKETGIGDYSYEDFARALRQGVAKEGHSLYPAMPYTSFARINDADMRDLYAYFMHGVAPVAQENRDSDIPWPLSMRWPLTLWRWFFHDDSAYQADAGKSAEWNRGAYLVQGMAHCGTCHTPRGAAFQEVALNDKKAGYLTGSQLAGWYAGNLTGDAREGLGGWSADELVEYLQKGRNRYTAAFGPMAEVVHYSTQHVSAGDLAAMAIYLKSLPGAGAADVRPVRTGSALFFENCATCHQANGQGHDNVVPALAGSSAVMARDATSLIRVVLEGGVNVRTGHLPWEYSMPGYARQMSDQEIADVLSYMRQSWGNTASPVEADQVAKVRALSAQSAH

SEQ ID NO: 7647 - protein, 165 aa, Chromobacterium substugae
MHIILETIPPDELADIEKAATPRRLSGRVAEQALPPPEVAARARERLRAGQRPYWCLPFYMLDGEGRVVGACGFKGEPRAGRVEIGYAVAPACRRQGAAAAAVRLLLQRARDSGEVAEVLAQVNPENQPSLAVVGKLGFQRGGVLVDEDDEPLLQCVWPVRFGAI

SEQ ID NO: 7648 - protein, 139 aa, Chromobacterium substugae
MLIRGACHCGNISFELDWLPEPAAIPARRCGCDFCRKHGGVWTACPGDSLKVRVSRPERVSKYRFGTATADFHVCAVCGAVPLVSSRIAGRVYAVVSVNALDDAPVPVLEPAPVSFDGESEAERLARRASSWIADVSFL

SEQ ID NO: 7649 - protein, 153 aa, Chromobacterium substugae
MASWIVGAMETYCGAMERGQRRWLEVQEDACRTWLSSWSPGFPLSEGEMEKRIDGGLLVGASLWQAQADTQRELMLAAEKLLADVSRCLRQQLPDYDAAPVAAMRQALEVGWASGAAMSKASRQVGYFATTNLSATPLKAARDMRRVLQQRKT

SEQ ID NO: 7650 - protein, 299 aa, Chromobacterium substugae
MEIYQLRTFVTVAQQGHLTQAAELLHLSQPAVTAQIKALEEEVGMQLFERNAGGVSLTRAGQELLPEAQGVLGAARDIINHARKLKGQLAGQARIGVTLMPDILKLGPWVAALVEANPLLEVQLSHGVSVDVLNLVRKKELDAGFYLGRNPYMNVSTVPLQTLSFRVALPAAWAGQLDGGKLRELGKLPWVGISQFSSLSKITAELWRELNISPKKVAESDHLSVILELVASGVGVALVREEEALAWQAAGRVWLVPELRKNAELQFVYPADRAGDPVLETLLRELLAVWRLPRPQCVV

SEQ ID NO: 7651 - protein, 261 aa, Chromobacterium substugae
MARYLTLERLGKSAIITLSNLPANLLTTESLNELTSTLQALNADDSVRSVVITGAGDAFFSAGADLKQFAAGDKAAADILLQAFADALQAIRSYRGVTVAAVNGYALGGGLECALVCDYIIAERGSKLGLPEAKVGLIPAAGGTKTLADKVGVSWAKRIILGGEVVSAEKALSIGLIEEVVDQGFAKIVAVSLANKVATQGAAAVAVARKLIEDSPNLTLEQHLARERAATLGLVGGAEQVEGVAAFMAKRPPSWAQEDDD

SEQ ID NO: 7652 - protein, 225 aa, Chromobacterium substugae
MIETNFWILFLAGLLGGGHCVGMCGGIVAALTLNHPAGRRRWRVLAGYNLGRISSYALIGALLGGLAAAGLSLAASHPFQLALYALANLLLVAMGLYLAGWSAAIGSLEKLGQPIWRRLQPLVGRMLPIRGALGAAAVGAVWGWLPCGLVYSASISALASGSAWRGAGLMLAFGLGTLPNLLLMGVFADGLRRWMQQRPVRLIAGLGVAGLGAYRLAALLIGTIS

SEQ ID NO: 7653 - protein, 298 aa, Chromobacterium substugae
MKKLFGALLLLGMPAFALAKVPVVASFSIIADMTREIGGDRVEVVSLVGPDQDAHVFQPSPADIKKVSAAKVLVVNGLGLEGWMSRLDKAANFRGVTVVASKGIQTRQAPEEEHAEGEHDHDHGDVDPHAWHDPSRVQTYIKNISAGLIQADPAGKAEYQRRAADYAAKVQALDDWAKKQFATVPAAKRKMLTSHDAFGYMGEHYQLKVLAIQGVSTESEASAKGVAQLTRQVRKEKVTAVFMENMSDKRLLQQLSNEAKVKIGGQLYADALSSPKGPAASYLQLVRYNVDTIMKSFR

SEQ ID NO: 7654 - protein, 291 aa, Chromobacterium substugae
MQHLYDLLVSPFVEFAFMRRALAGCLALALGSGPIGLFLVMRRMSLMGDAMSHAVLPGAAVGFMFAGLSLPAMSLGGFVAGVLVALLAGLATRFTSIKEDASFAAFYLLSLSLGVLLVSRGGSNVDLMHILFGSVLAVDNAALYLVSGVASVTLLTLAVIYRPLLLESLDPVYLRAVGARGAWWHLLFLMLVVLNLVAGFQSLGTLMAVGLMMLPAITSRLWTERIEAMLALSVGIAFLSGLGGLLLSYHFELPSGPAIILLAGVVYLLSLLFAPVGGALPRYIRARHLES

SEQ ID NO: 7655 - protein, 247 aa, Chromobacterium substugae
MSIILNNLTVSYQRHPAVHHIGGRFADGDATAIFGPNGAGKSTLLKAMVGALAPDSGSVDLNGHRRSDIAYLPQQAEIDRSMPVSVLELVGTGLWHKSGPFGRVGRAGMERSLQALEQVGLADFALRPIAALSSGQFQRVLFARILVQDARLILLDEPFNAVDAKTTEDLLRLVAQWRGEKRTVIAVLHDAMQVRTHFPHTLLMAREVIAWGDSAAVLTDDNLRRAVETAAHWQAQAPVCGLDGVSA

SEQ ID NO: 7656 - protein, 60 aa, Chromobacterium substugae
MSGSHSHGHDHGHEHQHLTPATLRPPLSLLAMSAGQRVALTLLPLAGLWLLVWWALQELA

SEQ ID NO: 7657 - protein, 305 aa, Chromobacterium substugae
MNKTKVNLFTGFLGVGKTTALRHLIANRPQHEKWAVIVNEFGEVGIDGAALLNDELAVAEIAGGCLCCVAGPQMTATVATLLRREKPDRLLIEASGLAHAAGVIDELRAKPLGEALEVAAVLTLVDPRQFIQPDYHRQPLYRDQISIADVLVANKIDAADIPTMEAFRAQAAALFPPKSLVGEVRDGQLDVAWLDAERAAKPRYRPAALPDNSSAWQSAGWTFDPELNFDGERLTRFFDDLPAKVPGLTRAKGVFRVLDSWVWLNWAAGQWGAAQVSWRRDSRFELIAPAFEADKVEAWLKECLE

SEQ ID NO: 7658 - protein, 144 aa, Chromobacterium substugae
MDSSAYLAAAERHCASRGSKLTELRRQVLELVLSRRGVVKAYQVLADLQQQRGSAAPPTVYRALDFLVEHGLLHKVDALNGFIVCDHFDCQHESLILVCEQCGRVNEVDAAGGLASLRDMALAAGFTLSPQNLVLAGRCQSCAI

SEQ ID NO: 7659 - protein, 142 aa, Chromobacterium substugae
MKKMLLASLALLLAGQALAADPISQRKDALKQYKPVIGEMGKMLKGDTPYNKDEFAKLAVKLEQLSQQPWQYFPAGSGAGRTDARPEIWSKPADWQKAIERHKAATANLKQTAQGGDLAAVRKAFADTQQTCKACHKDFRKD

SEQ ID NO: 7660 - protein, 146 aa, Chromobacterium substugae
MNKTLTALLLAAIAIPAAHADTPAEIRSQAFKKMLLQSFEPMGMAVRGRAPYDQAKFAQQAEAMKTLAAEPFKHFPANSITGKSRAKPEVWSQAAKFQADRDAFLKSVDALAGAAKGGDLGSIKKAYGQVAQNCKTCHDAFRGPEK

SEQ ID NO: 7661 - protein, 218 aa, Chromobacterium substugae
MSQQVKVWDAPTRLFHWTLVLLFAAMWFCAEQGGDWLQYHIYCGVALASLLVFRLIWGVIGSQTARFSSFVRGPRAILRYLRGELPEREAPGHNPLGGWMVVAMLLALAAQVLTGLFAADVDSYLYDGPLAKHVDSGVAEAATGVHKLLFNGLLGLAALHIAAIVVYRVVKKQNLVKPMLTGYKQMAGEKPRLRFAHGALALAALLLSAGGLYFALLR

SEQ ID NO: 7662 - protein, 424 aa, Chromobacterium substugae
MTQTALLQDLEARGLIAQTTDMAALQALLNKETVTLYCGFDPTADSLHIGSLVPILMLKRFQQAGHRPVALVGGATGMIGDPSFKATERKLNTPDIIESWVEKIRAQVAPFLSFEGDNAALMANNYDWFGGMGALEFLRDIGKHFSVNAMIKKEAVQQRIAREDQGISYTEFSYSLLQGYDFSELNRRLDCKLQIGGSDQWGNITAGTDLTRRLNQAQVFGLTMPLVTKSDGTKFGKTESGTIWLDAKKTSPYAFYQFWLSTADADVYKFLRYFSFLSVDEIAAIEEADKNRDGKPEGQRILAEQVTALVHGQAALEAAQRITHSLFSNNLSSLTADDFAQLAQDGLPCVKLDAGHSGLVDALAAAGLAKSKTEARTFIQSGAVSVNGAKADSIELEIGQDQRLFGRYTLLKRGKKLYALADWQ

SEQ ID NO: 7663 - protein, 185 aa, Chromobacterium substugae
MLADVELAKAYRLLNHGPTVLVSSAAGGRRNVMAAAWAMPLDFDPPKVLVVVDKSTYSRELIEASGEFVLNIPCRAQAAQVVRVGSESGHELDKFAASGLEPLPARKVGAPLVAGCIGYLECKVVPEPRNQSQYDLFIGEVVAAQADDALFSAGHWHFDDDPARRSVHYIAGGAFFATGEAFSVA

SEQ ID NO: 7664 - protein, 120 aa, Chromobacterium substugae
MTIVKSLREYVFHAKFLCHFNHGIGVNAAKKIRLLLAQRVDQEQTEVLLQLAVDLQLGAPFDLRRLCQIDPQYFELGLALLKDWRAGHHIAARSRLFEDILARDARLQRRLCHLEAPALH

SEQ ID NO: 7665 - protein, 406 aa, Chromobacterium substugae
MNKMLAGWFALALVLGGCGGGGGGGGAISNGSNGSSTSNSVAMTVDTGPSGAQGQLNIPYVSVTVCAPGSASNCQTIDHVLVDTGSSGLRVLSSVLGSGLRSALGSQQVNGKQVVECAQFADGYTWGAVNVADVKMAGEVASSVPIQLVSDPVYTTVPASCSSVGSNEGNLAGLGANGIIGVGLNRQDCGSDCAGNANNGFYYLCATALTCQPGTVPVAQQVANPVASFAADNNGVLLQLPAIPVTGQASAQGTLTFGIGTQSNNAIASGVKAYPVSSDGFTITGVYKGQIYPSFLDSGSNILYFTDSSIATCTVGGGTWFCPGSQLNLSATLSSGGSSSTVNFSLISAQVLTRSNYAAFPSIGAPMTGSLSGDFDWGLPFFYGRNVYIGFAGSSNSLGRGAMYIF

SEQ ID NO: 7666 - protein, 148 aa, Chromobacterium substugae
MMKASSKILLLLLAAPLLARAELGQKLDAAQAASGGKQMTALAPAGGAFSVQQSQDAAGRLIKQYAAADGTVFAVAWSGGSLPDLQQLLGSYFPAYRQAQLANRNGLNVMRGQVGSFVVSSHGRMGAFKGFAYDSALLPAGVTPDQLK

SEQ ID NO: 7667 - protein, 124 aa, Chromobacterium substugae
MQKFRIGMVGVGETGTPLLKQLLDAPFVEMVGVADLDLQLPGVLLAKERGVAVTDNFIEIAEQGERVDIIIDVTGSRKVRDDLRRYMQFSGNTHTVIVHERVALLMLSLGAGQWVETRHDELTY

SEQ ID NO: 7668 - protein, 83 aa, Chromobacterium substugae
MNILRMLNESDYIQVNNQFVKPDFHAVSEEFSDDDDVVLEANLDGQELVLTVADLTDATPLADGGFWLEGLGYLRFLSQQNLH

SEQ ID NO: 7669 - protein, 224 aa, Chromobacterium substugae
MSIASWPESERPREKLLQQGAGSLNDSELLAIFLRTGIKGVSAVELARRLLQDFGSLSRLLTASLPEFKSMPGLGEAKYAQLMACTELARRALSESMRMGDALSSPEQVRDYLRLSIGRREVEIFVVIFLTAQNHLIEVEEVFKGTLTETRVYPREVLRRALRHNAAAVIVAHNHPSGVSEPSTADRVLTDTLKRALALVDIKLLDHFVVTGGHAESFAERGWL

SEQ ID NO: 7670 - protein, 393 aa, Chromobacterium substugae
MTAKRILLGISGGIAAYKSAELTRLLVKAGHQVEVVMTESATRFVTPATFQALSGNTVYTDLWDPRPSNAMAHIELSRRADVFLIAPATANLLFKLAHGACDDLISTLAAARACPLVVAPAMNLQMWQNPPNQRNVAQLRADGVAVFGPGNGAQACGETGDGRMLEPHEIFELLQGVFAEKTLAGRKVLLTAGPTYEAIDTVRGITNISSGKMGYALARACRDAGAEVTLVSGPTSLAAPLNVRRVDVASAAEMQQAVLTEVGRSDIFISVAAVADYRVRNRSEHKIKKGASVPVIELEENPDILATVASLPAAPFCVGFAAESQNLLEFAEAKRRRKKLPLLVANLAQQAMGADDNQVVLLDDAGEHPLPNMPKDEVAAAIVRHLAALLGRR

SEQ ID NO: 7671 - protein, 150 aa, Chromobacterium substugae
MPAQIDVKILDARLRDNLPAYATPGSAGLDLRAATEETMTIQPGETKLIPTGIAIHLDNPGLAAMLLPRSGLGHKHGIVLGNLVGLIDSDYQGQIFVSVWNRGQEPFRLEPMERIAQMVIVPVVQVGFNLVDDFAASDRGAGGFGSTGRG

SEQ ID NO: 7672 - protein, 339 aa, Chromobacterium substugae
MTQTPLPDQTESKLILDSLVELTSQREQDMLESSLLSTLVEVMRVDRVELFSCRWVNNAPYIRRRLEARSGAGKPDIRETSADSWQPPPVFLYELLDQLDRGDGIHRIPGGMCLPLRCMGSITSLVIIHAAGDAKINRAMLKAMARIHENFLRVLFEADRDMLTALHNRRKFDQRIYGLIAALQHPQAPPDPCVLALLDVDLFKRVNDLYGHMVGDEVLLLLAQLMQQSFGEDDGLFRYGGEEFALLLQAPDLEQAEAALERFRQRVALHVFPQVKNLTISIGYTRVNPAQLPGQLVEQADRALYYAKSHGRDQIRSYEKLVADGSLAAPQAGGEIDVF

SEQ ID NO: 7673 - protein, 564 aa, Chromobacterium substugae
MKLIPLSLCLSVSLALAACMSDSSSVGGRGENNNQQRQPAVAVKLIAFNDFHGNLETPGALSVPDPANPGKTIKVSAGGADYLAAWVKSLRDKSPNTVVVSAGDLIGASPLVSGLFHDEPTIEAMNLLGLDINAVGNHEFDDGQEELLRMQNGGCKPGSSTTCRNGGKFAGAKFKFLAANVRKSDGGTLFPAYEIKRYGNIPVAFIGMTLKGTPEIVSPTGIQGLSFQDEADTVNALVPKLKAQGVSAVVVVVHEGGYQSGSFNDCNGISGPIVDIVKKLDKAVGLVVTGHTHQAYNCVIDGRRVTSAKNYGQLFTEIDFKLDPATKGFVPGSIQAANRVVSQDIAPRADVASLIQTYQALVAPIANKVVGQASGPLTRASNAAGETTLGDVVADAQLAAGQAQGALAAFMNPGGVRADILPGGDGSVSYKQLYTVQPFGNTMMTMDLTGQQIDQLLEQQWSNPAQPKMLQVSAGFSYAWSQSAPAGSKVDIASIRINGLAVDPRQVYRVQVNNFIAGGGDGFTVLTQGANRVGGGVDVDVLVDYFQARARVDAPPLNRIVQLP

SEQ ID NO: 7674 - protein, 1603 aa, Chromobacterium substugae
MSLTNKTELASLIADIQAVAESKLSTKETQQLAAFFPIYFEETEHADLRQFSSLDLFGAAMAHYEFAGKRSAGQVKCRIYNPDFERDGWQSTHTVIEVVNDDMPFLIDSISMLLSRYNLNLHLLVHPVLAVGRDKSGALQEIKRTEDRSLPLESLIHVQIDRISDAALLQQLEADLKRVMADIRLVVSDEPKMREVLAGIGKDLAKLKGERAVEAKEAVAFLEWMAGRNFLFMGYCDYDLVKRDGKDSLKIVKKSGLGILQDQGDKEYSASFEQLPQELRELAHLPQLIILNKSQTRSIIHRPAYVDFVGIKRFNDKGEVIGERRFLGLYTASAYQMSPKDVPILRQKVGAVIKGCDFVDDSYKAKTLGFVLESYPRDELFEIPAEVLGPIAEGIVSLQERPRVRLFVRADRYHRYVSSLVYVPRDSFSTEVRLKIEKVLMNAFNGSSAEFSVQIGDGTLARVHYIIRTAAAKLPEFHTADIEAEIARLVRGWSEELHQQLVEAHGEERGNGLFNRYKDGFPLAYREEFAVRNAVLDVQHLEAIDASQPLAMKLYRPFHRGGAAFNLKLFRESEPMGLSASLPILENMGVKVRDEHPYCVKRGDGSQVWISDFGLDVGSFGEQMAQDQVQHDFQELLAQVFARRCENDGFNRLALVAALDWREISLVRALAKYLRQGGLTFSQAYIEQCVANYPAITRSLVELFYARLDPAGFDDDKAELLLAAVRGMLDGVANLDEDRILNGFLAVILATRRTNFWQKGADGEFKSYISFKLESNQIPFLPQPRPLFEIWVYSPRVEGVHLRGSKVARGGLRWSDRMEDFRTEVLGLVKAQMVKNSVIVPMGSKGGFVGKQLPAPSDREAFLAEGIACYKIFISALLDVTDNLVTGQIIPPKDVRRLDPDDPYLVVAADKGTATFSDIANGISEAYGFWLGDAFASGGSAGYDHKGMGITARGAWESVKRHFRHLGVNTQEQDFTVIGIGDMAGDVFGNGMLLSEHICLKAAFNHLHIFLDPTPNAKKSFAERARLFNLPRSSWSDYNRELISKGGGIFERSAKSIPLSPEVKAWLETDKDQMAPNELIHEILKAKIDLLYNGGIGTYVKASTQSHADARDRACDPVRVNGNQLQARVVAEGGNLTCTQLGRVEFALAGGRIATDAIDNSAGVDCSDHEVNIKILLGAVMQAGDMTLKQRNELLAEMTEEVGHLVLRNNVLQTQILAIKRQESAAMLTTHARMIAHMEKTGELNREIEYLPSETQINERRLARQGLTVPEIAVLLAYSKISLDQAILATDLPDDRDFLPVLVNYFPKPLQQRFGKQMEQHQLRREIISNQLANQIINRMGTTFVFRMQEESPFSAADISRAWWIASRVFDAESLWGQIEALDNKVPADQQMQLMVLVRTLVERVTRWVLRNKRPFGSVNAVIEQYAAKVQGLLAQLPKLVPSERYPAVAALEQRIAHANLPQALTQVLARLEFAVPLMDIIEISEGSKLTLEQVAANYFQLGSTLQLDWLRDAITSLPRDNRWQSLARSALRDDLYRVHRNLARQALLDGAATETFAVQWLEKQHAAVEVCGQMFAELQSFSALDLAMLSAGMRELNNHLLA

SEQ ID NO: 7675 - protein, 254 aa, Chromobacterium substugae
MKKALIASASLALFASLSAQAETLRFGIDLNYPPFSKQGADGKPQGFDIDMAYALCAAMKATCQIVPQDWDGLIPALNANKFDAIISSMQITPEREKAVDFTHKYYNIASRMVAKNGAKVDPASLKGKKIGVLRASTQEKFAKDFWGKSGASVVAYAKSPESFLDLKSGRVDAVFVDSAVGEQEFLKTPQGKGYGFAGPNYSDVKYFGPGCGIAVKKGNKALVERLNKAIEQIRKDGSYKKAQDKYFSFDIYGG

SEQ ID NO: 7676 - protein, 228 aa, Chromobacterium substugae
MLQGYLPSILEGGVLTLKLAGTALIVSVALGLVGALFKSSQSRVLTLLAELYSTVVRGIPDLVWMFLLFFGAQMLLNDVCGYFGWQSPNIDPFAAGVLTLGFIFGAYMSETFRGAMMAVHKGQMEAGLAYGMSPLRVFFRIQLPQMVRYALPSFSNNWLVLVKSTALVSVIGLNDVMYRADAAKSATQQPFDVYVVVGMLFLIVTGASNLLLHWMEKRYSLGAKESGL

SEQ ID NO: 7677 - protein, 243 aa, Chromobacterium substugae
MIDPKLIIERLPEFFGAHDGGPMLASTDGLILTLQLLGVSLLLGLALAIPLALARVSQNRPLSGAVWLFGYVFRGTPLLVQLFIIYYGLAQFDWIRDSWAWQYLQNAYACAILAFTLNTAAYTTEIIAGQLRNTHWGEIEAARAMGMSQWLMLRRIVLPSALRRALPAYSNEVIMMLQSTAIAGLVTLADLTGVARRIYSESYMPFEPFLTAAVIYLGLTFILVWLMKRAERRYLAFLAPRKS

SEQ ID NO: 7678 - protein, 77 aa, Chromobacterium substugae
MGQKQEAKAQGFAGLGRMTHGVIVCTRLAKRPPCREAWHGGVSCRALYDLFQPAGRRIAAACYRLQAYDLRGARKAR

SEQ ID NO: 7679 - protein, 315 aa, Chromobacterium substugae
MADFAAASEVLAHANLLAEKRLYETLLLSLDGGQVQLSNGVKLGVDLPLSYAPKLDYLLILADEIGNEFALEELSKGIAACNTDKLTLGGIGCGSYWLARAGLLAGQRATIHWREISRLTEEYPDVIVTSNLYESEGRYLSCAGGAATFDFMLDLVGKQQGHEFIAQLSELFSMERIRPGNERQRIPLATRIGGSQPKLTEAVSLMEANIEEPLSTDDIAYYVGVSRRQLERLFKQYLGTVPSKYYLELRLGRARQLLQQTSKSIVQIGLACGFSSGPHFSSTYRNHFNITPREERAQRTQTSALQRQPAQTERG

SEQ ID NO: 7680 - protein, 230 aa, Chromobacterium substugae
MVQCRPYFQSGEAGIMIKAVLFDLDGTLADTARDLGAALNRLLKEEGLPPQPYEAIRPMASHGARGLVRLGFGAGLDAERMESLRVRFMDLYDANLAEETTLFDGVNELIAELDKRGLAWGIITNKSMRFTDRLVPWLPFAIPPAVIVSGDTVGVAKPDPRPMLHATEQIGIAPEHCMYVGDAERDIQAGRNVGMKTVLVNWGYFSADDKPEQWGADADIDHPLQLLDHL

SEQ ID NO: 7681 - protein, 509 aa, Chromobacterium substugae
MSNTQDYLERILTSRVYDVAVETPLELAPNLSRRYGNKILLKREDLQPVFSFKLRGAYNKMAKLSAEQRARGVITASAGNHAQGVALSASKLGCEAVIVMPVTTPQIKIDAVKQRGGQVVLSGDSFNEAYLHAVKLAEESGRTYIPPFDDPDVIAGQGTVGMEILRQHPDDLDAVFVAIGGGGLAAGVASFIKRLKPEVKVIGVQPVDSDAMRQSIEKGERVELKDVGLFADGVAVKLVGEETFRICRELLDEIILVDSDAICAAIKDIFEDTRSIVEPAGALAVAGAKAYIEREGCAGQSLVAISCGANMNFDRLRHVSERSELGERREAIIAVTIPEKPGSFKRFCSVIGGRNITEFNYRFADPSVAHVFVGVQIAGKEDVERLLTDLRAAELDGIDLTDNELAKLHIRHLVGGHAPQLKDERVLRFEFPDRPGALMRFLEAMRTDWNISLFHYRNHGADYGRVLVGIQVPPGDAQAFQQFLETLGYPYIEETDNPAYRLFLGKTIR

SEQ ID NO: 7682 - protein, 381 aa, Chromobacterium substugae
MKKLTTALVAAALALPSLGFANTAFTPPAPDIAGKAYYLLDYNSTQVLAERDPDSRVEPASLTKLMTAYLTFKALKEKHLTLEQTLTVSQKGWKTEGSRMFLDPKVPAKVEDLIRGMIVQSGNDACVTLAEAIAGSEDVFAQMMTQQAQKLGMKNTQFRNATGLPHADHYTTVHDLGILAAALIRDYPEFYPIYSMKSFTYNNIKQPNRNLLLYRDPNVDGMKTGYTDSAGYNMVTSSHRDGRRVISVVVGTASPEARAVESSKLLNYGLQFFDTPKLYAANTRVSDVAVYKGSDKMVAVGFGSDVYATVAKGQAAKLKADLTTMQPLIAPIKAGQVVGKLTVSLDGKPLLERPVVALKAVEEGNFFSRLWDSLKLMLGWK

SEQ ID NO: 7683 - protein, 89 aa, Chromobacterium substugae
MSDEKQELMEFPCRFPLKIMGERHDEFVATITEVVRINAPDLAEVDIVLRESSGGRFYALTVTVTATSRQQLDNIYLSLTGHPMVKMVL

SEQ ID NO: 7684 - protein, 207 aa, Chromobacterium substugae
MQRIIKHLGLADYEPTWRAMQALTDQRDDDTRDELWVVEHPPVFTQGLAGKPEHLLQQNDIPVVKTDRGGQITYHGPGQLVIYLLIDFKRMRIGVRELVRHIEQAIIDMLAEQGIAANGDVDAPGVYVDGAKIASLGLRIKNGATYHGLSLNVDMDLSPFGWINPCGYANLKVTQLKNLGVNLTVAEAADKLLPHLERHLSTSKETA

SEQ ID NO: 7685 - protein, 315 aa, Chromobacterium substugae
MKPDNQAGVKHKGAAKTARIPIKIVPLDEKLRKPEWIRAKLPNSQRFHEIKQILRDQKLHTVCEEASCPNIGECFSKGTATFMIMGDICTRRCPFCDVGHGRPNPLDENEPKHLAESVAAMRLKYVVVTSVDRDDLRDGGAQHFADCINAVRAASPGTQIETLVPDFRGRLDIAIDILSGTAPDVMNHNLETVPRLYKQARPGADYAHSLQLLKDYKAKNPDVRTKSGLMVGLGETDEEILEVMRDLRAHDVDMLTIGQYLQPSDGHLPVLRYVHPDVFKMFEEKAYEMGFVHAAVGAMVRSSYHADVQAHEAGV

SEQ ID NO: 7686 - protein, 571 aa, Chromobacterium substugae
MRKAIPKIKEFPDDGRIWRVDWFGGVERNPQIPSEPKIQLIISPVVDGAIDYAASNSVNHEERSSISIGIGQLPLITIGSLWQNRHCLIESAGKTKVFENLVISPKTALLVKSDALVGGQPLVRKKYHQIGAGLAANCLAIEWQGDPYGIIIPTAEVIRFYYATSTDLAKAIFAGDFRHELGSIVNPTQCGYIKQENRCILKLRKEFADADAWTIGRILNSHEAFNGAVLVHDSMIKQAVQSKSRLYPEAAFPFVGETNLRVRMKAMRSPDEKRWRFIVFALEHCTGPFPFSAITCDRDNSNLRPEEGHDQPDELKAPAYPRKQQSGKDVTDGELQSNEDASKEIQSAVIDLPEGRFGALANMELEKPEKNICHYFNAGSAHPLELPSDVLGTSDGNYSGGIMTQTSIEVKHERQEALPASFANFEAMVRHLDGLPGYQAKIRPRSDATMHIPLTKPHRAWQWSYLDSGTRQRRAVVIADITHDCCVYSLVEFQWREEESFKLAMVSLSGGARLSDEQLHLLLRMLAKKEGRWGSTKPLPWNAKLITFKHTWPSVDAYAQAILARVSTFSN

SEQ ID NO: 7687 - protein, 483 aa, Chromobacterium substugae
MVNPGFRNQDEVSLNRLHLDTQNPRHDPLEDEDEIIAQLYKDEQVLNLAKDIVAKGTLSPLDRPGVIEMDDNPGHYIVVEGNRRTCALKLLHDPQKAPTPEVRATFEALSKRFEVPSSFSVVVFTDRNAARPWIGLRHLGAQEGAGTRTWDAAQKSRYAETESPNQLALALLDHAEKSGWIDADMREQLAITTLTRYLSSPLVRAALGLGNHRELLYTHDASEVEAALRQFLADAAPVHDGGVPRVHSRSRKLEREAYARELAVRGITPRSLLPFPSQPPEPGWQDDLSPDVVEPAPIHGVDPGPEPLDPGITPPQPEPDPLPPAPDPGKPAQPRPPRGKQHPDDRMYLMPTDFTFTHSDKSLRRLRGEFRSTPIDDHEFAVNYLLRAFIERVLVLYAKHRGVHRSKMADQKLVQVCVEELGKEGVPDNDLKLMRVAMSDENSAHSLHTLGTAVHTSLVATRKSLVGAWDNWEKALKIMLSRM

SEQ ID NO: 7688 - protein, 295 aa, Chromobacterium substugae
MSHLNDSTLKLLELSDPERIERIRAPRWIGYPQAKAILAKLDDLLTYPKSHRMPNLLVVGDTNNGKTMLVQRFCSQHPADDNPSGEGIRVPVLCMQAPPVPDEGRFYNAILELLFAPYKPNDRVDKKQFQVIKLLKYVGLRMLIIDEIHHVLAGNLNRQRAFLNVLKYLGNELQVPIVAVGTRDAFRALQTDPQLANRFEPALLPRWEFDTDFLRLLASFERMLPLREPSALHSTTLAAKLFSMSEGYIGELSRLLANAAEHAIKTGREQIDARALDGVGWISPSDRKRQAQLSN

SEQ ID NO: 7689 - protein, 610 aa, Chromobacterium substugae
MVYQNRLHRITHVLDLDEVLLADDETNQVSHAKVGDLEAVVGNSQPSARPDLLQVLDKDWEEAKRRYEIIRPLLDKADRSRQDVTDRGKAFGHHANTLYEWLRRYEDNHLLTSLLPRTRSDKGATKLTPEIEAIIQVVVESEYLTKQRKSQQKVCDEVRKRCLNAGIEPPHDNTVRNRLKLLAGEYVMAKRRGRKAADQAYSPIEGSFPGADWPLAVVQIDHTPLDIILVDDIDRRPVGKPWITMAIDVFSRMAVGFYVSFDPPGALSAGQCLANAILPKEGWLAKHGVKGEWPCWGIPAKLHMDNAREFRGNMLKRACDQYGIDIEWRPVARPHFGGHIERLLGTFANEIHTLPGTTFSNVQERGGYDSEGRAALSLTELEEWLVTFIVNVYHQRVHSGLRMPPIEKYRQGIFGTKDMPGRGLPARITDVDRLRLDLMPYEERTVQDYGVVIDEIHYYHDVLRRWINAPDPVAPKYKRKFMFRRDPRDISTIWFYDPEVDLYYPIPYRDTSHPPISIWEMREAKRRAEADGRRHVDERALFAAYDRMREIEQNAQAKTMSARRATQRRKDHQEVVRQPTPPVAQMVEHTTPQPQTVPAILPFDEMDDLA

SEQ ID NO: 7690 - protein, 218 aa, Chromobacterium substugae
MPVRKIPKNYRNVTGIAAHRKANGPAMFESTLERDFITLLEFDPVVETFEVQPLTLEWTDSDGKIRRYTPDALATFKLPHGQQSKTLYEVKYRDELRRDWQELRPKLRAAVHFARIEGWRFKIVTEVEIRSQYLDNAKFLLPFVRQGPAEEAHMDLLDDQLRLIRHATPAELLSAVFQDQWNQARLLPSLWYLVGTGQVGVDLTKKLTMTSPIWSLHK

SEQ ID NO: 7691 - protein, 98 aa, Chromobacterium substugae
MGRLRDSLALSMKSNGELEFCCLAFWLGVGEPRRKIHDSPVAWLKFKSDRLLSAAQSSVARDSLVARLAQPKFYQGEYAGGASYAWAPGVLVIEKPAV

SEQ ID NO: 7692 - protein, 44 aa, Chromobacterium substugae
MLFSRQAWRIRLFYIDLQYMDSAAFQPHAFALRLTCMDLSMLDK

SEQ ID NO: 7693 - protein, 125 aa, Chromobacterium substugae
MRALKLSQLLKFFTRGNTSAQVADFRLNIVCDKAVITTLRKRLFWEMHDLGLRASQVTIGPDSHDNQCKLSVVLNCPLTQRQDLDDMALRLSQLPEIRRVHWGRRLHSAQPHHRSLFGSRPRIAA

SEQ ID NO: 7694 - protein, 114 aa, Chromobacterium substugae
MQNLFTTPRNQQLYQLSIICPSMSLGAARREIRTLAQKHGLRIQQWQEQPQPAARESRHTLTPWLICADFRCGSEACMHFLQGIAQRLATMPLTRVKLDCLSLPPSGMRRPASA

SEQ ID NO: 7695 - protein, 913 aa, Chromobacterium substugae
MTKHNTQRSKNRGFIATPGKRQDKVAFRLADEARLPLEDTFKRVRSQPDGLSAMEAAQRLQQYGRNEVAHDKPPHPLVQLFLAFKNPFVMVLIVLGVISYVMDIAMAPPDDQDWTKVIILSAMIAISGLLRFWQEFRSAKAAEKLKSLVRNTATVQRRPAGPNPPLRLEVPMSELVVGDVIHLQAGDMIPADIRLLESRDLFISQAVLTGEALPVEKYDTLGAVAAKSAERDASHADDLLDLPNACFMGTNVVSGTARALVVATGADTYFGSLARNVVSHKRIETSFDKGVNSVSWLLIRFMLVMVPIVFMINGVTKGDWMSALTFALAVAVGLTPEMLPMIVSANLAKGAVAMARRKVVVKRLNAVQNFGAMDVLCTDKTGTLTQDKIILEHHYDIHGRKDESILQLAWLNSFHQSGMKNLMDIAVVEHADELGDRIKLRQYAKVDELPFDFERRRLSVIVEDGGQQLMVSKGAVEEMLAVCSHIRDGGETRALNAEERAALLRRSEEYNAEGYRVLVVATRDIPAAEQKRSYRTADEQGLVVRGFLTFFDPPKDSAAPAIRALKEYGVAVKVLTGDNPIVTAKVCRDVGLSPGLPLIGKEIEAMDDVALCTAVKHTTIFAKLTPLQKSRVVKALQANGHTVGFLGDGINDAPALRDADVGISVDSGADIAKETADIILLEKSLMVLEEGVIKGRETFGNILKYLNMTASSNFGNVFSVLVASAWLPWEPMLAMQLLLQNLIYDLSQMFLPWDKMDPEFLKKPRKWEAGNIKRFMLWLGPTSSVFDITTYILLWTVFGAGAAYHLHGGDGGQLIMNTGWFMEGLISQTLVVHMLRTRKIPFLQSTASLPVLLSTSVAIAIACYLPFSPIAASLGFIQLDASYFWWLLLTMAGYLALTQTVKTIYIKRYGQWF

SEQ ID NO: 7696 - protein, 635 aa, Chromobacterium substugae
MDETSGQKRWARDYVFDILSQLGIHRIFGVPGTNEIPIIDGTSYPENRVEYIECLHENIAIGAAMGSARMTGKPGVLVVHVTPGIAHSIGNLFNAWRSQAPLVILCCQQQNELVTQEPLLASNLVDLARQYTKWAHEVRTEQEFPMVLQRAFKEAMAPPNGPVFVAIPWEFTMRRIGGDDRIKGVTKISPHFTADPQAIEQAAKLLREAKNPIIVAGDAAGYAQAWPELQRMAELLGAPVLQQTFSSLANFPNNDYHWQGELPGSQAGVQQVFKDHDVAFLCGFSNQAQITVYKYSDGPLIPPHVTQVYLSNNTWDIGKNYYGEAALFGDLKATLPLINQLIGSQPSAAAAARNQQLREFAVKRAADWEVYLREAMHQNEIWAVVIADALRKEIGERKLEKQFVYVHEAVSDPAPFQFLLPFTDQAAQPISYYCVGGGSLGWSMPATLGIKLEQDGYQGIDTRFVVAATGDGSSLFYPQTWWTAQHRKLGVLYIITNNHEYHTLQMGLTQVESIYGEAPGYEWTAKTQDPEYLRIHRPKPDFVTLAKSFGGMEGEIVRHPEDVRAAVRRGIDHVLSGQAYVLDMHTVGLDQPTPDLQPSNARYEKQPRLDCVHFSSEDGLRAASAGQPGNVPVIF

SEQ ID NO: 7697 - protein, 532 aa, Chromobacterium substugae
MADENLDIAIVGGGVSGVYSAWRLKQERPNDKIAVFEASNHIGGRLLSVRPPDIPDMVAELGGMRILPAVQPLITRLIADLNRELPADQQITLYNFPVDEPQNIAFLRGVYLRLADLTHAPDKVPYQLNFLDHGESAGSLIVNAIEQIVPGITNPNLNEAQRREMAQQAEFGGIPLYKQGFWNVLLRVITGEAYHYAEDVGGYDSTLCNWNAADAIPWYLSDFGVSPEYKGFCNGFQQVPLTLAQFFQQLGGEVRLESSVSNIVSKGEGFEFQVKGRTIAAKSLILAMPRRSLELLSATSPVLQEIQPLIASVTARPLFKLFTTYNSPWWLNTGYSAPDGSYVPVQAGRSVTDLPVRQTYYWPKSNGEPATQGHAMLLASYDDGDNTGFWDGLRARRRQPRAVGLDVAPLADPFIGEDDNVRNDELTWHQYKAPRLMTEEVTRQLTVMHSLSYTPKVRNAAYRDWGDDPYGGGWNSWNIGVKSWEVKHRIVQPTDLPLYICGEAYSDAQGWVEGALQTAGYLLEKFGVLPFH

SEQ ID NO: 7698 - protein, 365 aa, Chromobacterium substugae
MYEMKKTLIALAVATLPAAAFADVTIYGQIKAGVENVDAGGMNKTNIDDLGSRIGFKGSEDLGNGLKAIWQVESGLDIDGSNRQGYGSFASRESFIGLDTGFGKVRLGNISTFSDSNMSVVNPWESSSNALQLNAFTRDDIRVKNAIRFDTANYGGFQGALLYGTKEVKNGTFANANTDSAQRETYNLGLSYENSGFFGKYQYIHETPVVVTVAGAGVKTQANDSHRLEAGYNANNLLLAVGYRNDRGDSTISPLSFLKDANVPTNGSKYKSQEYALTAAYTLGAFTPKFSYAQGQDVKIDGASSPDSGYKQFLVGVDYQMSKRTVVGLQYGEVKADQAIFSNAADGSSAGNKLRGLGLNMVHSF

SEQ ID NO: 7699 - protein, 487 aa, Chromobacterium substugae
MRRLPRTLYGQLLLTLLTSVLLANVIGIGLVLTDRERLTRTLRAEYVAQHLADMINLLDETSASNRPKLASALTSPSAQVLLDHPWVENRQSDLPEASKLCQLIRTDLNFPYRMQVLSFREDTPDAAEDLLRPFLEPGQHVFTAGKQFWVRALPSKREDGEEELKIQMATVQVKLRDGAVATFRIGQIASAVETPWRVTAWLLLVALVVAGVSAWAVRRLTRPLAVFSQAASGLAANLDQPPLPETGTLEVVNSTRAFNRMQKELQRYLQTRSQMLAGVSHDLRLPITRIRLRLEQLDESPARQAIERDLEDMDQLIGDTLAYLRMGQRSETCVLLNVDGMLQGVIEDVEALGAEVVYRPEPVKPLCARPQALRRCIANLLENARRYGSGPIEVRLREREGRLAIQVRDHGPGIADKDLERVFEPYVRLEDSRARHTGGSGLGLAIARAIAREHHGDIQLSNHPEGGLCAELSFPAERSQCVPLNTI

SEQ ID NO: 7700 - protein, 237 aa, Chromobacterium substugae
MSQASRLLIVDDDPDLRDLLSDYLSRQGMVVAAVGDGDAMNRILAEQSFDILILDLMLPGTDGLTLCRDLRSRSSIPILMLTARGDELDRIIGLEMGADDYLPKPFNPRELLARVRSILRRVEEKRSNSALRSLQFAEWRLELGAQHLVDSGGVVTPLSGGEFKLMQALAENPQRVMSRDQLMEAMNGKEAGPFDRTVDVMIGRLRRRLGDDAREPLLIKTIRSGGYMLACEVVSVR

SEQ ID NO: 7701 - protein, 330 aa, Chromobacterium substugae
MIEFLLSPALGYPLWVWLMFLAGVLALLAFDLGVLQKDGREIGVKASLKLSAFYIGIGLLFGCWVWWYRGADAGVQYFTGYVLEKSLSLDNVFVISLIFSSMAVPRAYQHRVLFWGILGAIAMRALMIGAGAALVAEFQWVLLLFGAFLLWAGLKMLFSGDDAATPLAEQKFYQWLRRHMRLTPGLHGNAFLLRGEKHGMARGWWATPLLLTLILVESADLVFAVDSIPAIFAVTQDPFLVYTSNIFAILGLRALYFALAAMVHRFHYLKYALALVLVLIGVKVGLVYLHDVGLVAFKLPTLLSLLLTVLLLAGGIGYSWHKTRRDPAQS

SEQ ID NO: 7702 - protein, 293 aa, Chromobacterium substugae
MKRVILLIATNIAVMLVLSVSVRLLGLDRFITAGGLNLGMLLMFSAVLGFGGAFISLALSKTMAKWSTGARVITQPKGQTEAWLLATVRRLADRAGLPMPEVAIYEGEPNAFATGPSRANSLVAVSTGLLSGMTEEEVEAVLAHEIAHIRNGDMVTLTLIQGVVNTFVYFLARVVGYLVDSWLKRDEENAAAGTGIGYFITVIVCEIAFGILASVVVMYFSRQREFRADAGAAELLGSTRPMADALRRLGGIEADGLPQSLAASGIAGGRGLLGLFATHPSLEERIARLEGRA

SEQ ID NO: 7703 - protein, 293 aa, Chromobacterium substugae
MEKLNYKHLYYFWAVARTGSVTQAAEQLGISMQTISGQVAKLEQQLGCALFRQQGRGLALTEAGRTAQGYADQIFMLGEALGEALADARLDQAVRLAAGVSDVLPKRIASHLLRPALQMGRKLRLSCSEGDFDELLGDLGRHRLDLILADRPIASSEQQQFQSWLLLRCPVLLYAAPELCRRYRPEFPASLEQAPLLLPSRDNVLRRQLDHWLESQGLRVEVAGEFDDGALMETFARQGLGLLPSPALPDAAQDLSGLELVGCLDGVWEHYYAVASRRKLQHPALQAILQAWG

SEQ ID NO: 7704 - protein, 185 aa, Chromobacterium substugae
MHPDNGFTLLELLVVMALLAVVLALAVPAYQSTIAVNAILSESNNLYGDILFARNEAIKRGQVVLLCPSSNGSSCNAASAGGANWASGWLVLVAATGSCADSTGTLLRQQKAFTSGDTANYSNSANPALCFNRMGYAPAANVGMVTFNTSSGLAADRRCVALAAVGHPQILSSGQTDTTGQYACP

SEQ ID NO: 7705 - protein, 180 aa, Chromobacterium substugae
MNRAAAHAGFSMLEVLVALVVISLGLLGIAGMQAAAINNTAIARTRSLGSIAAESMAAAMHANTAYWGNLSAAASNTWSVNASGVTGTPSLSQTVDCSASGTACSAANIAAYDVTQWGGNGGSLATLPGGSGQIACAAASASSPTACTITVSWLEKKSAVNAASVASGVAIQSYQMVVEP

SEQ ID NO: 7706 - protein, 227 aa, Chromobacterium substugae
MSRRAGQGGSGLIEVMVAITIGLFLLSMLIMIFTSTELTESNENGLAQLQDNQRTAMTMINAIVQSAGYYPSPQSQTAAAALPAAGGFGAGQSILGVSGPPDTLSVRFAAAPNDGVLNCNGNGNTGSANAVYINQFAVNAANQLTCSVNGGSAQVLVDGVSNMTVLYGVDGSGSGSVNHYYSAANLPAGAAVRSIQVTLTMANPLAAKPGQPASVTMSWLIGLMNQL

SEQ ID NO: 7707 - protein, 183 aa, Chromobacterium substugae
MNAAALRPARQSGFTLIAALMILIVITIIGLAMMRSVGLQERMAGNMREKGRAFEAAQSALQYAEWWLTQGSNAGGAAVSCSGALSSLQICSNALATPTTLSSWATSYTYSPPYLSVPANGAAGGSQTFYQPPQLYLQYLGLNAAGNGALYQLTALGYGGNAYSIVVLQSTFTLYSGVTNLGK

SEQ ID NO: 7708 - protein, 1095 aa, Chromobacterium substugae
MSPLPRPSLPLACLLAAALWPAACGAVTVGDNFTGASAQLNWLVFGGACMTAGNGSGSIPACGSKDPSGNTQVGGYAGSLPDSNGNGALRLTNSAGSQSGAIVYNSLFPSNSGLQATFTSYTYAGDSGGSAGDGADGMSFFLLTAIPSAVGSFGGSLGYSCSNVNSPYNGIIGGYLGLGLDEYGNFPNGGYNNDNTSSGPGAKPQNISLRGAGSVAASALASQFGGSFSASAVQNVCRNGSYAGHSVMNYPFINIPGASGGVYQLPGSQPMAAESAATRGQAVPISYKLKITTGNLLSLWYSYNNGAYVPVINNYDINNTAVSGPLPSQITFGFAGSTGGSRNVHELTCFQVQPSTQSASSSGLNSQQTSLIKTGTQQYVASYHSDNWWGEVASYALLGNSGTGQVTVSSTATWDASCVLTGGNCSATGASNMSAQSSRAILSWNGSQGIPFQWTSLSSAQQTALSPDGNGSARVSYLRGARGNEVTTLGAGLFRDRDSVLGDVVNSSPIWVGAPQNSYADAWKDKLYPSASVAENATGAQAYSNFKSSNQTRANIIYNGSNDGMLHGYRSGANDASGNYSTAATPNDGQEVIAYLPAAAQANTVQYSNPTYAHQYFVDATPAADDLFYNSNWHTWLMGGMGAGGQALYLLDVTNPANFAESNAASLVVKEISSATLSCVNKSSCGSDLGYTFGTPVITRFHNGQWGAVFGNGYNSGNGHAAIFVMLVNGSGVPSFYELDTGSGSANDPSGGGNKNGIYYATAVDLDGDGTTDYVYAGDLFGNVWRFDLTSNSPGSWAVSQYGTGAAAPLFTSQYTYCNATQAANGSCTRSLQPISSKLLVSAIPTGNSSPRVLVAFGTGQKIPFTTSAADIYAGGTQSLYGVWDWDMSGWNTLAGQSAYYPAAAAAIPASALRPANLTAQTVTASYNSTLSSVQGYRSLSSNTVCWQGNSACAVNTNTSYGWKLSLPSSGEQVVYNPVNELGTFTVNTTIPPNNNASSCTVASATSFSMSLNMKTGGATRLSFYANDQGNFNGISGSVINGIAINMAGSPNVVSYQNNFFAIGSSTNGGPIATPPQINPAAFDLHTRLNWIELR

SEQ ID NO: 7709 - protein, 144 aa, Chromobacterium substugae
MPSRRARQGFTMLELVIALAVLSILVAIALPSYRAFILQSNRTSAKTALQDLATREESYYSLQNTYASQLATLGYASNTVYVPGNGNNYYALTIGSATASSFALTAVPQGQQAQDSCQTYQLDNLGNQSNLAANGASLSVSGCW

SEQ ID NO: 7710 - protein, 86 aa, Chromobacterium substugae
MSDLQTLFTQAQADVKTLSERPDNQTLLQLYALFKQATEGDATGERPGMMDFINRAKFDAWEKLKGQSADDAKQGYVDVVKRLLAE

SEQ ID NO: 7711 - protein, 194 aa, Chromobacterium substugae
MKFRPWSLAERGLLALWLSLLLHAALLWLPARLGQPAAHAGLLVRLAMPAAAPARPAALPGARPASAAGGEASAPAGAAPREADGRLRLGADIYYPARELDQLAQEQGAITLPDVELDGQAPPALTVLVFISETGRVDGVRFEGAAPARLADAISPVFGAASYQPALKDGVPVKSYKRIRIEPQPAAALPPLSH

SEQ ID NO: 7712 - protein, 244 aa, Chromobacterium substugae
MKTRLKSLALASGMLMSLAACSQAAGGNLDAVKKAFAEHFPDKEVKSVSATPVKGIYELVVGGKQVVYTNSDASYLFVGDLIDTKTKESLTEKKMAELSKVDFNSLPFQYAFKDVRGKGERKMAVFTDPDCPYCKKLERESLKDVDNVTIYTFLYPLTQLHPDAMRKSKQIWCASDKPAVWTAFMRDGKPLTGPDNCDTSALDKIQALGEKLGVTGTPALVFANGRLVPGAIDGSDIEQLLNAK

SEQ ID NO: 7713 - protein, 382 aa, Chromobacterium substugae
MRDSQYHAIIVGGGLVGASLALALARAGKRVALLEARPPSFDGLDSGWDARIYAVSPANRRFLESLGAWPGMERISAIAAMDVCGDAGGRIQFSARDADADALAWIAENRWLLAALWRQLADSDVDCLHGGAQSLATTASEARLALDDGRQLSAELLVGADGANSWVRSQLGLAASVKPYGQSGVVANFACEKPHQGVARQWFTGDSILAWLPMAGNRISMVWSTPDPQSLLILSPEALAEKVAAAGGRQLGAFSTLTAAAAFPLRLIQPEAVVSERVALIGDAAHTVHPLAGQGVNLGFQDAAQLADLLRAAPDCGDWMLLRRYQRQRREAVTTMQLGCDSLYRLFHAKMPGLSWLRNTGLSLTNCCAPLKRQFARQAIGY

SEQ ID NO: 7714 - protein, 389 aa, Chromobacterium substugae
MRARTSEHADVLIVGGGPVGALAALRLARQGRSVLLVEARGRDDAVRDARALALSWHSRELLAEAGAWPDSLPATAIDTVHVSQQGSCGRARLDKDDLQLPHLGVVVDYPALVANLAEVLSQAGVQVLWRSRVRSVSSLREYACAEVETPDGERLLTARLLVLAEGGALAGALPGVRRLEHDYHQCAVLAEVETEWPADGVAYERFAASGPFALLPHGDRYMLVWTRSHADAERLSRGDEAELRAELQQAFGERQGRILSIGPRASFPLALRQANKVVSGRVVLIGNAAQTMHPVAAQGLNLGLRDAVGLAQALAGEADPGDPRALRRYAAARKLDSHAVVGFTHGLIKLFDGHHPLMNTLRGMGMTALDALPPLRRKFAGHLVFGVRG

SEQ ID NO: 7715 - protein, 430 aa, Chromobacterium substugae
MYQPHATRRNRLLSTLGDGVALLATAPEATRNADCLYPYRADSYFLYLTGFAEPEAVLLLDGRSGKSILFCRAKNPEMEIWDGFRYGPEGAKEAFGFDEAYALDEMAQRIPDLLADCRQLWWPLGHDEAFDRRVNGWLDGVRRARVGTHAPAHYGDLRALLDEMRMVKDEAEIALLRRAGEISAAGHVAAMRTVRPGQYEYEAEAELLRAFVRRGARYPAYESIVAGGGNACVLHYSANNARLQDGELLLIDAGCELDGYAGDITRTFPVNGRFSAAQRDVYEVVLEAELAGIAAVRPGAPWNAPADAALRVLAQGMLDLGLLAGSVDGVIESGDYRRFYMHGIGHMIGLDVHDVGQRKQNGQWRNYQPGMCTTVEPGLYIRPAPDVPEAFHNIGIRIEDDVLVTADGNEVYTAAAPKRVDEIEALMRGE

SEQ ID NO: 7716 - protein, 40 aa, Chromobacterium substugae
MRLIHVRLLRGVGAAMAKTPVYTLAGKRPSLPLPPATTPA

SEQ ID NO: 7717 - protein, 241 aa, Chromobacterium substugae
MAGHSKWANIQHRKGRQDAKRGKIFTRLIKEITVAAKMGGGDVNMNPRLRLAVEKAKAESMPKDNIENAVKRGTGQLEGVDYVECRYEGYGIAGAAVMVDCLTDNKTRTVADVRHAFSKYGGNMGTDGCVSFQFKHCGYLVFAPGVDEDALMDAALEAGADDVVSNDDGSIEVITGPYEFTDIKEALEAKGFKAEMGEVTMRAENDTELSGEDAARMQKLLDALEDLDDVQEVYTSAVLDE

SEQ ID NO: 7718 - protein, 258 aa, Chromobacterium substugae
MLTISDVQINALVGAFVWPFARIVGLFLAEPIFAYRGVPRSFKAGFALFLTVMLAPLLPPLPAVPLISAGGVAILLQQLLIGLAMGFVMRIVITAVELTGFIIGAQTGLGFAMFFDPIHAAQVPVLSQMLSLFTFFLFLSFDGHHVVLYTLVESFRVLPIGMPMPEQGIKALALWGRHLVEWGVWLAMPVIGALLVVNLAIGVMTRAAPQFNIFTFGFPLTIMVGFGTLYLTLPMMVPVIEQMYHAGFEMMLKMLQAK

SEQ ID NO: 7719 - protein, 89 aa, Chromobacterium substugae
MSPELIISIVQNALYILIIVSAPVLLTSLLVGLLVSILQAATQINEMTLTFIPKLLAMFLVLVLAGPWMLNTLIEYTTRLFQSIPNVIG

SEQ ID NO: 7720 - protein, 167 aa, Chromobacterium substugae
MTAMRLEDLSAADLPACHALFQASVQALAGGVYTAEQCQAWAPERAWDAEIDPHWRARLAASWGCKAMAGDGRLAGFAWLKRGGEFDMLFVAPWAGRQGLAGRMLGELEARAAREGVSALHAWASHAARPVFERAGYLLLRANRLQRNGVALDNWLLAKGGWREEEA

SEQ ID NO: 7721 - protein, 250 aa, Chromobacterium substugae
MKKNIVIALLSGGALLLPLLADAAGGLPLMTSTPGPGGGQNYSLSLQMLLFMTSLTFIPAMLLMMTAFTRIVIVLSLLRQALGTTQSPPNQVIVGLALFLTLFVMGPTFDQVYSKAWVPFSDDKINITQALDEASKPMKAFMLRQTREKDLAFFIEISQSAKPQTKEDVSMKTLIPAFAISELKTAFQIGFMVFIPFMIIDLVVASILMAMGMMMVSPVTISLPFKMMLFVLVDGWTLLMGSLVQSFYTG

SEQ ID NO: 7722 - protein, 157 aa, Chromobacterium substugae
MDMAKTSKVRLALRGAFCFMAAAPALAAPQLAPAAAAAPSPLASLVQVILGLAVVLGAIVGVAWLFRRLSGGMMGAAGRLRVVGGAMVGQKERVVIVELEGEWLVLGVTASQVNLLSKMPRPEGADQAPPEPAEPFARWLKAALDKSRPPKGPQDKQ

SEQ ID NO: 7723 - protein, 147 aa, Chromobacterium substugae
MSEEEQQAGAAGAEEEVSMDDWAAAMAEQEVAESAAPAADEAVPAQNLFQEIGAGAISGGPPNLDMILDIPVQLTVELGRTKIAIRNLLQLAQGSVVELDGMAGEPMDVLVNGCLIAQGEVVVVNDKFGIRLTDIITPAERIRRLQK

SEQ ID NO: 7724 - protein, 334 aa, Chromobacterium substugae
MGDDILSQEEVDALLRGVSGEDEDDDGSQDAQGVRGYDIGRQERIVRGRMPTLEIINERFARNLRIGLFNFLRRNAEISVGPVRVQKYSEFIRNLVVPTNLNLVHVKPLRGTGLLIFDPDLVFLIVDNLFGSDGRYHVRVEGRDFTPTEQRIIHRLLEVVFTECQKAWEPVYPIEFVYLRSEMNTQFANIATPTEVVVAMTFHIELGAGGGDFHICLPYSMVEPIRDLLSSTMQADRTEVDNRWVNLMTHQVQAAEVELVASLAHTKVTLGQILNLKNGDVVMIEIPELVEADVSGIPVFEASYGTVQGRYALKVEKILAGANEFMESPGDKEQ

SEQ ID NO: 7725 - protein, 173 aa, Chromobacterium substugae
MSDDKKAEKAEKKPGGGGNKLMLIVIVLLILVLAAVGGLAAYMFTNMGKAPAGAQAEQVKEKPKKKHDGPPIFEKMDTFVVNLAGNDGSLLQVDMQAELGDEEAKKKFADYGPKIRSAVILLLSSKSAAEVSTAEGKVKLKAQVKQIINESMDAGDEPVVDSVLFTSFIIQKQ

SEQ ID NO: 7726 - protein, 315 aa, Chromobacterium substugae
MTITVNTPVTNAASAATSAPGGAAPGAAGNGAASDLFASLLGIQMSAMGSTLPGISDQGDAKPASDKPAAKDESDGGDVPAAAAMPLLAALQASLQAQPQPVDSKAANQDLLAQQAASKPDLTALLQAKPAFNWQGNQQKLPAADADAAQFLPLQQLQPQQQLQNVQAQTNANMPVLTLPQTLNDPAWGKALGEQMLSMVNMKADKAQIQLNPPQMGPIEITLKMNGNDQAQVLFTAAVPATREALENNMHQLRSMMSSSGIQLTDSQVSSGQSGQQQQAYQQKKGRSEPVVGEVEGVDALSAIKAARGILSIFA

SEQ ID NO: 7727 - protein, 149 aa, Chromobacterium substugae
MSGKYQLLIHLAEERQQAAAERMSLAQNRLSEARARLEQLDAFREEYRHRLVGGGGKGMSIVQYQDFHRFLSRLDEAMIQQQQDLDRCTQRFVMERQAWQMEYKKLKAYEKLLQREQEREAREEARRQQKQTDEFATRQFWDRTHGEDA

SEQ ID NO: 7728 - protein, 464 aa, Chromobacterium substugae
MGNGLLERQRGWLAACAESAAAADLWQPCGRLVRVTGMVMEAVGIKLPVGSACQVALPDHGAVEAEVVGFSGDKVFLMPLTNVHGLQPGTPVTPVPAFRPPSYGRDAAPAHANGPVGRQVPVGASLLGRVLDSLGRPLDGLGPVHPDAWFPLYSQPINPLERTPVHDVLDVGVRAINGLLTVGRGQRLGLFAGSGVGKSVLLGMMARFTKADVVVVGLIGERGREVKDFIENILGEEGRARSVVVAAPADMPPLMRLHGAAYATALAEYFRAQGKDVLLLMDSVTRYAMAQREIALAIGEPPVTKGYPPSVFARLPQLIERAGNGEEGGGSITGFYTVLSEGDDQQDPIADSARAILDGHFVLSRDLAESGHYPAIDIEQSISRVMVDVVPQSQMDLARHFKQLYSRYQRNRDLISVGAYVAGSDPVLDDAMRRQLPMVSFLTQPMHESHDYASCCAQLANVLA

SEQ ID NO: 7729 - protein, 287 aa, Chromobacterium substugae
MKASSSNNPIIPGEELEGWTSWSPESLDGFTRALTPAQLVSMSQMRRPGASLAEKIAQAEAEPASEVSAPQPEAPEADLPPEEEEVSGIGYPTAAELEAIHQEAWQAGHDAGLDAGRAEGFEQGLQAGREQGMADVRAEQLPRMEDAWQGLCRMGGAFADELARVERELADDVLQLAWQLAQKLLQQKLRQDDQALLPLLQAALAELPSTLGNARLRVNPADLSAAREFLRQETPETVWQWIEDPAMARGGCVIDTASARLDMTLPTRLAAMSRALGLEADDGQRPA

SEQ ID NO: 7730 - protein, 327 aa, Chromobacterium substugae
MRKSAVLLFSLGQNEAVEVFKYLGPKEVQKISLAMAAINNLSYEQIDDVVADFRKECNARASIGASDEYLRNVLIEALGPDKAANLLDKIMQGNDHSGIESLKWMDPSSAADLIRHEHPQIIATILVHLEPDLSSSILSFFPERMRNEVLIRTATLEGVQPQALRELNDVLTQLLSGSDRIKKSASGGVGLTAEILNFMGGNVEASALSFIREYDPELAQRIQDKMFVFENILDIDDRSIQTILREVQSDSLVIALKGTSTELKEKIFRNMSQRAAEMLRDDLESKGPVKLSEVEAEQKEILKVVRKLADDGQIVLGSKGGDEGLIE

SEQ ID NO: 7731 - protein, 564 aa, Chromobacterium substugae
MNEAGDRFKTLPNNKKILFLTAIAAIFAVVVGAVALNRTPSYKVLFSNLADRDGGQVTAALQQMNIPYQLTDGGVISVPSDKVYDVRLKLAAQGLPKASGIGFELMDNQKFGISQFAEQVNYQRSIEGELARTIESVSSVQSARVHIATPKQSVFVRDQQAPTASVMLQLYPGRMLDGGQVAGILHLVSSSVPNLPVKNVTIVDQDGNLLSKQLGPDENSGLDQRQLGFVRQIEDGYVKRIEDILEPIFGHGNARAQVTANVDFSETEQTSETYRPNSSPNPSATRSQQISEKLANGAAQPTGVPGALSNQPPSAASAPITLPPGAAPGTANLSGQTISQNGTLQRDITTNYEVDKTIQHTKVPTGVVKRLSAAVVVNYRRMPDKNGEMKPTPLSAQEVQQINNLVKEAMGYNAPRGDTLNVVNAAFADNAQPVTMQDRVVDYVSDNGTSLVKYGLLAIAVLYLLFGVVRPIMRDLVKPAAAPDPGGAEGAAGAAAGGRLLGVAAEEGEMGAALAAGGAGGSSDDPREVQKRQYSSNLEAVRELVKSDPRMAAQIIKEWISADE

SEQ ID NO: 7732 - protein, 107 aa, Chromobacterium substugae
MSVNNIDQLLGELRSAAALAAGKQAPAAQQTSQVDFSDVLKSTIEQVNSAQQTSEEMQKQFQLGDNKEVNLQDVMVSLQKASLSFQTMVQARNKLVSAYQEIMNTQV

SEQ ID NO: 7733 - protein, 458 aa, Chromobacterium substugae
MKFLPILVVEDDADLREAIVDTLSLSGYPTLEAGDGTQALQRLRQEPVGLIISDAQMAPMDGYTLFEEVKKHYPGVPFILMTAYGVIERAIELLRAGATHYLLKPFEPPSLLAEVEKHILTMAGDEGGEVVAESAAMRQLFALAGRVAQSDASVMVSGPSGTGKEVLARYIHRHSRRKDGPFVAVNCAAIPDNLLESTLFGHERGAFTGAAQALPGKFEQAQGGTILLDEVTEMPLTLQAKLLRVLQEREVERIGSTRTIKLDIRVLATSNRDLQAEVESGKFREDLFFRLNVFPLRIPALADRPDDILPLARFLLKKHMEAAGRASLVFSRDAERHLTAYSWEGNIRELDNVVQRAVILAAGAEISAADLLLGDIAGVGQFTRAVSESDSSVSDETDMKTLEKRHILETLAAVGGVKKLAAEKLGISERTLRYKLQRYRDEDAADSGLDVSEGNGTE

SEQ ID NO: 7734 - protein, 231 aa, Chromobacterium substugae
MALTSRERASKTPLEIVPSHSADVILPRQPGKTPLASQTVIVIGSSTGGTEALRTLLTALPANMPPILIAQHMPEMFTQSFAQRLDSLCRLRVKEAEDNERLQAGMVYIAPGHSHLLIKNAPTIGYSTSLNNGPAVNRHRPSVDVLFRSAANLVGKNCIGVILTGMGRDGASGMLELKQAGAWNIAQDEASCVVFGMPKEAIALGAAHEVLGLTGIAQRLVTLAHQRQPSA

SEQ ID NO: 7735 - protein, 82 aa, Chromobacterium substugae
MVDADFSGFDLILAADASNLADLRRRCPKTLQNRLHLMLEPLGGEMEVPDPYYGGGKGFETVLDLLEQACAGWLSRLRPAGG

SEQ ID NO: 7736 - protein, 82 aa, Chromobacterium substugae
MEQQLQAYQVGGNDIVAAYSQEGALAVLEELAGETGLALEDVSPIEEAELDVPVEDEDGAACPTIRQMLAELSEPAYLFGWD

SEQ ID NO: 7737 - protein, 303 aa, Chromobacterium substugae
MKPSRLIARAAAVAALLPHFGAHGQELWDPHLRGVNIGLAAGALPPEGLYGVLNNYWTSVDKFDHNGNKTGLKVDALIELPEVLWSTGIKIWGADYAVAIAQPIDYTTLKGNGIPSNGRWGAFNTILIPGQLSWTLPENFHLKTGLAVYLPTGSSSPGRLPGGTFLGSANGFWSLQPSLAVSWLRAGWNLTMDATYSYNFQNTDTHYRSGPQLAIDYTAAKTIGKWTVGLGGYQENQLGDDSGSGAAACAQTGGCRASNYGIGPLLGYQFGSLKLMGVYTYGFHTRSDVGGNSFNLRLSFPFQ

SEQ ID NO: 7738 - protein, 501 aa, Chromobacterium substugae
MSDSPIQHIIVLMLENRSFDHLLGFSNITGADAKTGRATRAQGVPTPPPVNVFSDHGETHPYAAAAGNAPFQLSTDPGHEFQNTLTCLCGVDAWRQNTDAHGRLTGAAYPVPAAGQANSGFVANYAAGGANAPGLAMQSLTPEQLPVLNALAKAFVLCDGWFSSLPGPTWPNRYFAHAASSAGLDDSPSDGQIADYYVAGFALPNGTLFDRLDHHGLDWKIIEGDSFPQAFSLRGMTHAALNGHFRDLDDFGELINADDFNAAYLFIEPRYDVHNHYLDGNSMHPLNDARAGEALVKTVYETLRASRIWTNSMLLVLFDEHGGFFDHVFPPAATPPGDTQPGSEHNAHNFAFDRLGLRVPCIVASPWVGENLIDHRQYDHSSIVKTVCELFELGGPLTHRDRDANSLAPLIQSASRQNAPQTLPAPAAGPVGAAATLSGGAPPPSLRGFAQIALARQLSVAPPEQQQAIKDSFNAIQGDPDKAKAFLQAAHDAISAWKARN

SEQ ID NO: 7739 - protein, 281 aa, Chromobacterium substugae
MNPRYDASSAALLNPGLSDTLFQFDRSYSHPQLAAECARLAYIRFEDGDAERHRLASALSLAGLQLAQTFSVDNSHSHGFAAVLPSTLTIVAFRGTEVSQITDIATDLRASLTPWSQGGRVHLGFAAAAGQLLPAFSSWWDNHATPQLILAGHSLGAAIATLFASAHRQAELITIGSPRVGDQDFAAACAGQAICRYVDCCDLVARVPPETPDFPLYVHLPGERYIDKDGGIHDAPGFDIAADQAAAREEYLLQRAWKIDSVPLRDLADHAPINYLTALFP

SEQ ID NO: 7740 - protein, 311 aa, Chromobacterium substugae
MNVSLRQLRVFRAVAEQASFSRAGDQLGLTQPAVSRAVRELEQALELRLLDRTTREVVLTDAGQRLLPKLARVLDELDEVLLAARKEGGQAMGSVHVASSPTLSASLMPAIIAACRQRYPLLRLHLQDQVQRLNVAAVRGGEADFGLVVEPEPGDDLWQEEVLVDDFWLVCRGDHPLAAGAWVSWRQLDGEPLVLLDDSSGSRPLIDQLLLRHGLDCPVAQQLGHSHSVFRMAAAGIGVSITPGLAMPLPAGCGLVARPLLPRASRRIVLIRRRNRTLSPAAESLWRLVLEMRQPLQRLAEEIMERALSGN

SEQ ID NO: 7741 - protein, 330 aa, Chromobacterium substugae
MPKLLDSFTLALLSTVALASLLPCSGAAAQAFNLITNLAIGLLFFLHGAKLSREAVLAGIGHWRLHLTVLACTFALFPILGLLLKPVLTPLVTPELYLGVLYLCMLPSTVQSSIAFTSMAQGNVPAAICSATASNLLGIFITPLLVGWLVVSHGGVGQGMGSALDIVYQLLLPFIAGQIARRWIGRWVDRHKAMLKYVDQGSILLVVYTAFSAAVIGGLWRQTPPAALAGLLLVNVILLGLLLGLTTLAGRKLGFNREDQITILFCGSKKSLASGVPMAKVLFTGHAIGAIVLPLMLFHQIQLMVCALLAQRFRQQRQHTGRMQEKSPLA

SEQ ID NO: 7742 - protein, 670 aa, Chromobacterium substugae
MLLNFPDSPFQLNQPFPPAGDQPAAIEQLVEGLSDGLSYQTLLGVTGSGKTYTMANVIAQTGRPAIIMAHNKTLAAQLYSEMREFFPHNAVEYFVSYYDYYQPEAYVPSRDLFIEKDSSINEHIEQMRLSATKSILERPDCIIVATVSAIYGIGDPSDYHQMILHLKEGETTPQREIISRLTTMQYSRNDLDFGRGTFRVRGDVIDIYPAESSDTALRVSLFDDEVETLTLFDPLTGTTKQRVGRFTVFPSSHYVTPRDTVLRACEQIKDELRHRIEWYQKEGKLVEAQRIEQRTRFDLEMLYEMGFCKGIENYSRHFSGRGPGDPPPTLIDYLPKNALMFIDESHVTVPQVGAMYKGDAARKANLVEYGFRLPSAADNRPLKFHEFEQLMPQTVFVSATPAVYEKDHAGQVVEQVVRPTGLVDPQIEIRPVATQVDDLLSEIRDRMARGERVLVTTLTKRMAEQLADYYTEHGIKVRYLHSDIDTVERVEIIRDLRLGMFDVLIGINLLREGLDIPEVSLVAILDADKEGFLRSERSLIQTIGRAARNLNGRALLYADRITDSMKKAMDETERRRAKQMAFNAEHGIVPRGVEKKIKDIIDGVYSVEAERKKLVDEAAVAMMDEKTLAKEIKRLEKDMMEAARNLEFERAARIRDELKQLKEKAWLSDL

SEQ ID NO: 7743 - protein, 69 aa, Chromobacterium substugae
MAGAREVAKPLILRLLPANLTPGVRQADIRRRGDAPPWLFQPPENVFFVPRGGGTLFRIQAGAIPPHHP

SEQ ID NO: 7744 - protein, 289 aa, Chromobacterium substugae
MIKKIASLLISAALAAPVLAASPQGVMVASEMSGYTAPRLNSHSVLVLNGSTGETLYEKNTHQRMPIASITKLMTAMVLLDSGVSLDDEVTVSDAEIDRLKHTTSRLAVGTTLSRREMLLLALMSSENRAAATLARTALPGGSAAFVQRMNHKARSLGMTETIFHDPTGLDVRNTSTAADLAKMVMAAQKYPLIREFTTTERHQILSARNRVLQYKNSNALVREGDWDIAVQKTGYIQEAGRCMVLQAVVGSQPLVIVLLDAGASSARVNDAKNIKTWLEAHPGSWLAG

SEQ ID NO: 7745 - protein, 165 aa, Chromobacterium substugae
MTIQIHTAQPQDAAAIHRFITELAIYERAEHEVESSAADIEATLFGPGAKAQALLCHVDGRLAGFAVYFFSYSTWLGKNGIYLEDLYVTPQVRGAGAGKALLRRLAQLACENDCGRLEWVVQDWNQPAIDFYQSIGAKPQAEWVRYRLAGDDLRAFALDESAVNA

SEQ ID NO: 7746 - protein, 181 aa, Chromobacterium substugae
MRNTLLIASLLALPLAAHAAGFQLSSETIADGKPLTARQVYQGFGCEGGNVSPQLSWRGAPAGTKSFAVTVYDPDAPTGSGWWHWTVVNLPANVHALPEGAGSAGGQLPAGAVQGRTDFGESRFGGACPPVGDKPHRYQFTVWALKTDKLPVDANASGALVGFMLNANALAKASLTATYGR

SEQ ID NO: 7747 - protein, 266 aa, Chromobacterium substugae
MSDLALRECRIEAGEVRARLPQRIRRVPVFLPALCRVRHGLKRIWLGEREMSAGPAQLVLLPAGSELDIANLPGPAGYLADVVSLPPALLARFCERHGSLLLRQRAGNELCLDIGEPGHRAWQLLMDSLRGDTPPEMREHHAEGVLLALALAGQAGPLLQAPAAPVAQRIRQLLMLDPAAPWSVETAARRLNLGASTLRRRLAEEDSGFQRLLEDVRMGQALQNLQTGAKPIADIAAASGYASPSRFAARFRQRYGLSPSELRRTL

SEQ ID NO: 7748 - protein, 137 aa, Chromobacterium substugae
MAIQVCELHHVGFAVPKRQVDAMRDFYQQVFGLRADPSRWNIPDVPGCFLDVEDARQLHVLGSDGVSRYAQGPERDPVSNHVAFTVASLEAAAEELRSRGVDFFSQRSVVADRLTQLFLRDPAGNLLELRQAAPAAD

SEQ ID NO: 7749 - protein, 156 aa, Chromobacterium substugae
MRETASQDTDRDAAAAGLLLLWLGDDALQLVNASLSRHGLSENKLQVLLLFRLHEQGLFGEAPPTPSSIADYCGITRASATGLLDWLEKRDWVARAPHPSDRRSLQLRLTEAARTLLAEALPGFWRACARVTDALSAEEKSQLLRLLSKMQQAGLS

SEQ ID NO: 7750 - protein, 301 aa, Chromobacterium substugae
MVADAVSLTVAAGETLALLGPSGCGKSTLLKMIAGLERPDGGGIHFDGEDLCRQPPERRGFALMFQDFALFPHLDALGNVMFGLIEQGCAKRDAAAQAREMLARVGLAEHGGRKVWTLSGGEQQRVALARALATRPRLLLLDEPFSSLDADLRRQLLQTFRALLREAGIPAIIVTHDRDEAFALADRVAVLKAGRLLQCDTPARLLAAPADAWLARFIGYDNVLADAAVPPGALLLGDDQPPARIVELIWLPDGARVKVVAAAGELVLNLSGREAARWQASLFVGGEIGVGVAEAGLLRFN

SEQ ID NO: 7751 - protein, 521 aa, Chromobacterium substugae
MTQSGVRRLALASLPVLFLSALALAPLARLVAEGGLQFSPGLLADSYLRWRLLWSLLQAAASCLLCLALGAPLAWLLARYHFPGRGLLLRLLMLPFVMPTLVAAMGVLALFGPQGATGLHLQDTPWLLLYGNLFFNLPLVVRAACDGFSQVPASRLAAARTLGATPWRAFWRVEWPAALPWILSSLCLVFLYCFSGFGLALILGGQRYATLEVEIYSLVAYELNLADAGALALLVLLVCGAVAAVYAALMRRLATAAKVEPLPLRPARGWRARLALLAGLLTLLLFAGLPLLAVLWRGLAGGGGWLALWDEDVRLALFNSARFTALTVLAAGALGLCHALAAGRSLALRALIFLPFVASPVCVAFGLLLLYPQWSAALALLLAAYALLAYPFVAKALLTARDGQPPHWEQAARSLGAGPWRTFRRLQWPLLQPALRRGLAFAAATAVGEFAVTLFLSRPEWLTLTTLIYQRLGRPGAANMDAAMKLSCLLMLLALLAFWIIETAGGAGSWEDRRADAAKPE

SEQ ID NO: 7752 - protein, 182 aa, Chromobacterium substugae
MIADISSSRLILRHMSADFLQACLRGDIDDAAALLGSRPDAGWLAEAQLMAMRLDDMAEDAAYAPWSVRAMLRRDDLAMIGHINFHTRPGHPYLQGHGDVELGYAVYPAFRRQGYAREALLAMAGWAAGQGAGRMVLSIEPGNLPSQALAAQLGFAKVAQARDEDGCEDVLTADWPLSGANV

SEQ ID NO: 7753 - protein, 338 aa, Chromobacterium substugae
MKLLPTLVAAALSLAGLSAQAAELRVLAHSSFSVDKPLLAAFEKQYGAKVSIIKAGDAGEMTNKLILTKANPIADVVFGLDNSLIGKAEQAGALAPLPAELARGGKVSLPGAAAIDYGYVTLNYDKAWFAKNKLPLPKTLNDLALPAYKNLLAVENPATSSPGLAFLAATIHALGEEKAFALWGKLRDNGVKVSKGWTEAYYTDFSKNGGGRPIVVSYATSPAAEVFYSKEKLSDAPTANLLLPGTVFRQVEGAALVKGGKEPKLAQQFIAFLRSDAVQKDIPTRMWMYPAMDGVALDPVYKHAEQPAAHDTPDSATLAAKQRAWVGRWARVVLKSGV

SEQ ID NO: 7754 - protein, 207 aa, Chromobacterium substugae
MFLLFFFSLLALIFFLTWLFFFPLRALGDWLFIPLPRGQYLHLETNQVLNQPGFVLPLLFWVLALLGALSGWRDGFRKLPKRDKAKRRQKLAQLNQRCCRLLAICAGLSVLLSLPAMRSYTVVAGDGIHDMDFYRRHETVYPFSQLECIRRSVVRGAIFYDFYFDRKEDDSFTAAGLNPQALAWVECQTGKSFQSWMGACGGWRRGR

SEQ ID NO: 7755 - protein, 481 aa, Chromobacterium substugae
MLKKIILSSVLFSLPLCALADIGVDGARHLLLRTGFGANPAQIAAYAPLSREAAVDKILAGVRTQPATPPPGWANDPFERPGQPGLTEEQKKALQQERNQHAVELRSWWLAEMLATPSPLTEKMTLFWHNHFVSALDKVRSPQMMYQQNLLLRHYALGDFGQLLHAVARDPAMMRYLDTANNRKEQPNENFAREVMELFTLGEGHYSEQDIREAARAFTGWGLDHDDQFIVRPRLRDAGEKTIFGQRGNFDGDDVIDLLLQQPQTSVFITTKLWRNFVSPTPDAASINKLAADFRRGHYQLKPLMRALLLTPQFWHSQGQLVKSPVELTVGTLVTFDLTPPDWRVIAGLNRQLGQDVFAPPNVKGWPGGEAWINSATLLTRKQFLDRIAHDAAPARDTFAQADGSLNEMAGREARINRFVAKGVASMKLQPDEWAAIYDARSAADAARLLLAVPPANPLPQGESGAKAIAQLLLDPAYQVE

SEQ ID NO: 7756 - protein, 392 aa, Chromobacterium substugae
MFKRREFLKAAGAGLMLSVLPNLSWALAPAGYKRLLVLVELKGGNDGLNTVVPYASADYYRLRPGIAIAREQVLQLDEAISLNPALSPLMPLWRDQQLALLQGVGYPEPNLSHFRSIEIWDTASASQQYLSEGWLTRLFREQPTPKHFAADGVVLSSQVLGPLDGGARAVVLANPQDFARQAKLVADQQPGHAGSALEHILKVEGDIRQAAASLAPLPRTAPSESPTAGPKPNGGFGVAVRTLTDTLARGVDIAVARITLTGFDTHGNQQPAQARLLAELADGLAQLRGEMTRLGRWDDTLVLTYAEFGRRPRENANRGTDHGTASVHFAAGGRVKGGLYGQTPQLAGVSDGNLPHAIDFRQVYATAIDSWWGKDSRNVLGGRFAPLPLLRV

SEQ ID NO: 7757 - protein, 245 aa, Chromobacterium substugae
MAGGVCGKPIQVGWEERPPYHYQGRDGRPAGYSVELLNQAAARLGCRLAYRQMPWSRNLQELRLGTVDVAMQALKTPEREAYACFVPGYSSAQVRLWVRADRAARWPVAQLQDLGKLGLVRLGVTHGDSYGDAWDRWLKAPPATVRVDAGETLAGSLRKLQLGRIDLLLATMDTLPNELARLPQQPAIVALPPAWRAGGAFYVFSKRSVPAELCRAFAGALRDMKRDGVVDRLYRSRFNIAYPDP

SEQ ID NO: 7758 - protein, 277 aa, Chromobacterium substugae
MTSNNTKSTDHPQAATEDIPLPPPENELNLANLAIPLGETILTLNIEGAPIYGILQRSRAMTSQSDYFRLQFRGYARADSNQHWQMLEGDDSRFHAVYNVAWVRVDRPSKSVTFGPKSGVSCSPALMGSGLDAFLFASVIVWAKGVCPDYAITPGLVNTGQSSTEEERLQRHAFFAGQGFQFEWQDPTQRTALYFKDKVNKLLGVWNKDVIKEFGGEDMLKRLAGQDEARASLQQRIDQLEGAHDSLKRALQKERSTSQILTGVLVLAAIIGLWAVI

SEQ ID NO: 7759 - protein, 170 aa, Chromobacterium substugae
MTNDLPKIVSSQHLVSERSPELSEFEFSLTVVNNAFHRWMVRCMAAAGEKDMTPTEVLLVHHVNHRGRQKKLADICFVLNMEDTHVVAYALKKLVKMGYVRSEKSGKEVLFSTTENGRALCERYRQVREQCLLPTLSDGGIANPAIGEVAQLMRALAGVYDQAARAGASF

SEQ ID NO: 7760 - protein, 225 aa, Chromobacterium substugae
MPSAPLTSPAIHWLGSQALTLEMPPPATLDCQRRIWWLARQLQAGDGIREIVPGMNNLTLELSDDPALAAALPARLRKLWQQAEQADIPQRRVEIPVCYGGEYGPDLDHVARHCGLSPRQVVERHGASDYTVYFLGFQPGFAYLGGLDPRLATPRRATPRIAVPAGAVAIGGCQTGIYPSASPGGWQIIGRSPARLFDPAREPACLLQPGDIVRFVASKESPCWK

SEQ ID NO: 7761 - protein, 308 aa, Chromobacterium substugae
MLEVIKAGPQTTVQDLGRFGARHLGVCRAGAMDGLALGIANRLVGNPADAAALEITLPPACFRFLRAGQLALAGADCQALLDGEPVWPGWRVAFRAGQMLQLQAPRFGMRAYLALDGGIQAPAVMGSASTDLLAGFGGLDGRALRDGDRLALGPARPPAPRLGVWLPRPGSQIRVCPGPELKRLSKQAQERFWREPWQLTPNSNRMGYRLAGPALTGGETVDMLSHGVLPGLIQLPPDGQPIVLMADAQATGGYPRLGMVIEADLWQLGQARLGSQLHFIPTDPDGARQALRLQQRYQHRIERLLNAN

SEQ ID NO: 7762 - protein, 245 aa, Chromobacterium substugae
MQIDLNADLGEDCGDDAALLEHVSSANIACGWHAGSADTMLQVVRMALRRGVAIGAHPSFPDRENFGRREMQLPPDAVRAGVLYQLGALDAIVRAEGGEMRHVKPHGALYNQAARDPALAAALARAIRDFNPRLRVIGLAGSGFLAACRAEGLDTRREVFADRGYRADGSLVPRGAPGALLDSAEAVLAQVSDMALRQRVIAVSGESVPLRADSICLHGDGPHAAAFAARLRGHLEALGIRIAAD

SEQ ID NO: 7763 - protein, 238 aa, Chromobacterium substugae
MDPAVNLWPLLGIAVVIAGFLLRFNPLLAVCAAGVVTGLAAGMPALAILAKLGQGFMKTRNITLILLLVLPVVGLMERHGLRDQARAWIRRIRNATVGRLLIVYLLVRELSAALGLTGLGGHPQMVRPILAPMTEGAWEQRHGEPTPEQRQKLRAMCAATDNVGLFFGEDIFVAFGAVMLMHTFLQENQIPSEPLHIALWGIPTALFAFIIHAVRLMRLERQLLRQAAPAAHLSEKRA

SEQ ID NO: 7764 - protein, 318 aa, Chromobacterium substugae
MILHVEYLYWLAGAVLLLVAAGALADPGHPRRYGSAAFWGLFGMLFLAGDWLPAQLSGAIVLAMVLLAGLGRLGSGHHIALSAARLQDSLRRLGGKVFLPSLLVPLLTVALSLAAKDVKLAGAPLFDPKNVTLLALGVACLVSFIAACGLTRERPAQSIRETRRLLDCMGWAVLLPQMLAVLGLLFADAGAGKAVAHVATAYLSLDTRWVAVLAYVLGMALFTMIMGNAFAAFPVMTAGIGIPFLVGMHHGDAAVMAAIGMFSGYCGTLMTPMAANFNIVPAALLELDDKNAVIKAQVPTALALLAVNAALMNWLMFR

SEQ ID NO: 7765 - protein, 210 aa, Chromobacterium substugae
MQTVLLTGFEPFGGETVNPSWEAVRRLDGAELGGARVFARRLPCVFGAALAALDSHLAELRPELAIAVGQAGGRPDITVERVAINVDDARIADNAGRQPIDQPIAADGPAAYFATLPIKAIVAGLRAQGIPASVSQTAGTFVCNHVMYGLLHRRVPRAGFIHIPYLPEQAAGHPGAPSMALDDCVAALRLAVELALAHRHDLALAGGATH

SEQ ID NO: 7766 - protein, 479 aa, Chromobacterium substugae
MIPCIIAGGAGARLWPVSRQALPKPFIRMADGQSLLQKAFLRASRLDGVRRVMVVANRQLLFHVLEECGAVNAARLELEILLEPEGRNTAPAIAAAALDALARRDGARPILLVLPADHLMADESAFAEAAVRARGLAELGRIAVFGLKPVRPETGFGYIEPGEAIGRLGYRVARFVEKPDAASAERYLADGRFLWNGGMFCFDAETLRGELASHAPAVLAGVAACLEASPELRGPGRRQRELDPRSFGRCPDISIDYAVMEKSDAAAVVPCELGWSDIGSWESLAAEYPHDENGNASHGEALLRDTRNTFVQSGGRLVATLGVDNLLVIDTPDALLVADRRRSQEVKDIAAELKRRGHPAYLSHRTTPRPWGHYTVLEEGGNYKIKRIVVKPGASLSLQMHRHRSEHWIVVSGAALVVNGAEERRIEANQSTFIPAGEKHRLANPGRIELVMIEVQSGDYLGEDDIVRFSDHYGRDVVG

SEQ ID NO: 7767 - protein, 48 aa, Chromobacterium substugae
MHGRCLIPPVRRRGRRRSLLQCIQFVRSNDSHARAVDPTICCRGSRCP

SEQ ID NO: 7768 - protein, 297 aa, Chromobacterium substugae
MNDRADFVVPDITTRKNVGLSHDANDYTLPQPLDRYSAEDHATWATLYQRQCALLPGRACDEFLQGLEQLGVDADRVPDFDKLNRQLMAATGWKIVAVPGLIPDDVFFEHLANRRFPVTWWLREPHQLDYLQEPDVFHDLFGHVPLLINPVFADYLEAYGKGGMKAKELGALPMLARLYWYTVEFGLIDTPQGMRIYGAGILSSKSESIYCLDSPSPNRVGFDLMRIMNTRYRIDTFQKTYFVIDSFKQLFDATAPDFTPLYQRLSAAQPWGAGDIAPDDRVLNRGDQQGWADSDDV

SEQ ID NO: 7769 - protein, 163 aa, Chromobacterium substugae
MVHKMRKIELDRFDLEILQQLQLDARATHQRLAQDIPLSASQIGRRIQRMEQNGIIQGYQVALDPEQVGLSVMAFANVSLERHNEAALLDFAQSIHALPEVLECYAAAGEADYLLRIVVPDLPSLSAFVMNKLMQLSLVRSVKSTIVLNAIKQTMKLPLASLP

SEQ ID NO: 7770 - protein, 198 aa, Chromobacterium substugae
MRRYHMDSKEKSMETPNARAPIPAEISPGLLAALKRLEQFQARLSLEDIRGFHRSLRLGRADFAPFWLFGDSQYRRNRIYADDFCELLLLCWRSGQRSQIHNHRGSLCGVRVLQGVATETVFEETPAGLLASRETRELAAGSLVINGDQDIHQIANQQDGDLVTLHLYSPPLRQMRLLGLEPQHGRARLPDDCLEYQI

SEQ ID NO: 7771 - protein, 440 aa, Chromobacterium substugae
MQSAVSPRSARLLSLIVAGLFAAPAVQAAGFQLTEQSVAGMGRAHAGAGMAGDDLSAVFYNPAGMTLLQGTRAQGGFTYAEVDAPFEGSNTVSGSPDPRLNRTSQASDNGRAPGVAIPNAYFTHQINDQLYAGVGLTTPFGLGARYNDNWAGRDSGISSSIMTLDINPSLAYKLDERWSFGAGVSAQYAKAHLKKGAFLPGATGEIKADSWGFGYNLGVMYSYSADTRIGLSYRSKIDHKAKGDYINSGFVDLAPTMPLSRLNGTYAGSADVTTPESLLLSGYSKLNSKFAVGATARWTRWSRFDQLVIKGSPQFGGIDTTTRIDNHWKNSWMFSVGGDYFFNDALTLRSGLGYETTPVPNAEHRNPLIPDADRIWLSLGAGYKISKQATVDVSYAYLRAVGDRKIDNVSKSPFGTQSHLQGQYGSITGHLLGVQAQYRF

SEQ ID NO: 7772 - protein, 185 aa, Chromobacterium substugae
MKKLFCSLALAALPALAFAAPVVEMVTNKGNIEITLDSAKAPKTVANFVAYAKAGHYNGTVFHRVIDGFMIQGGGFDAKLNQKPTRAPIVNEAGNGLKNNVGTIAMARTNDPNSATAQFFINVRDNDALNYTSPNPQGAGYAVFGKVSKGMNVVNRIAKTRTGSMNGMDDVPFEPIVIQKVTIKP

SEQ ID NO: 7773 - protein, 163 aa, Chromobacterium substugae
MIKLTTNFGEITLELFHEKAPQTAANFEQYVKSGHYDGTIFHRVINGFMIQGGGFDAQMKQKPTQDPIQNEANNGLSNKTYTVAMARTSDPHSASAQFFINVSDNDFLDFKSESTQGWGYAVFGQVVAGQDIVDRIKTVRTGRSGMHQDVPLDAVVLEKAEII

SEQ ID NO: 7774 - protein, 241 aa, Chromobacterium substugae
MATHFISDLHLADDTPALNQLFLDTLQQWRGRIDALYILGDLFEYWVGDDDDSSYLEAPLAAMREFAAATPLYVMRGNRDFLLGAGFEARSGAKLLDDPTLTDVHGQRILLCHGDALCTDDAAYQQFRALSRSPQWQQAMLAKPLAERHAIARHARAQSEMNKQQTGLAAISDVTEAAVQALLAAHDWPTLIHGHTHRPARHRHQAGERGASRWVIQDWHGGRGGYLLLDDAGIRALPLGR

SEQ ID NO: 7775 - protein, 42 aa, Chromobacterium substugae
MDCFPKSGLCGGANIFCLENILEAANLVERHFIFKKPTLQKE

SEQ ID NO: 7776 - protein, 782 aa, Chromobacterium substugae
MKPSNYLRPVTLAVLAALGSPAALADSAQLETVTITGVGDKLGVGLLQQQEGVRARSDVSKASLEKQSPTSNIYQGINMLPGVNASSQDASGLFGGALTIRGFNSDQLGITINGVPVNDSGSYAVYPQEFIDNENLCQAFVTQGSSDTDSPHIGASGGNLGFVTCDPEKTRRFRMSQTMGNNHLHRTYLRGDTGLFADNKARAFISYSHTESDKWKGSGDVTRDHVDTGFRYDFDSGSYINASILYNRQLANAIYSPTLAELQKYGYNYDYSTSFAPGHLPPKNGTAQIESGPSPAYYQLAMSPFQNVIAKVDAVLKLGPDTRVKIEPYYWYGYGTGGSQQQLLSESGFLNPATHSNTASKDLNGDGDTLDKILIASSSVTRTRRPGVTVTMEQSLGNHLLQAGLWYERAEHVQTSPGVPVNNDGTSSSVWLNSNYITRPDGSRYQYRDWDTISTASQLFAMGTFNFLEDKLGITAGVRAPSINRDFTNYANEGCGATANCPAAYNYNINRTYRETLPSLGARYYLTPKQQVFVNVTKNYRAPPNYVYSSTNGNVQVVNGQVQLVNEIVPETAINTDLGYRLQSDYVTLSGSLFNVDYSNRQANSYDPVTLKSVNVNAGSVHTWGAEIELGTVPVKGWSAYASFTTNHSEMKNDINWQKNTVLATQGKDFPMTPQWMAALSLQYSPGAWYVRSDVKHTGKQYATLVNDEAVPEYTLVDLDAGYRFGNTSMLKNPTLKLNVGNVFNTSYRIPSGMKANASDGGGVRYYLGAPRSVAVSLSVDL

SEQ ID NO: 7777 - protein, 245 aa, Chromobacterium substugae
MVKEQEKVRLVLQKQDIPPAFKINVKLFADVSGSFRDEFTSPLPGGGYVVDPFFTAALAIAGEIDPDRNIQIIGFSDRALDTGDYSLDHAGNLRQEFLRRAQPILWGSTDYGRALQALLESEGMASKLGGLIKGLFGFGKKTPPPRKEAYLALFVSDGEDMGSHQYFLSQLRQLAEMGTFVVLIGANSDKKVQFERMREAAEAVEGCTFHRLTDLAALKTQQLYERIFDQEFKRWHAQLPAEYRA

SEQ ID NO: 7778 - protein, 193 aa, Chromobacterium substugae
MQKGGSLPLIKNSAPLNEIRLELSWSPPQHSAKGSYDLDTSAFPLNSQGGGPMGAIADVGHICYWGQQKTPSMEHLLGDSRSGDAKGPDEAILIRLHALPANCDVVALVATIDKATARGQTFAEVADASMRVYNQQTDELLCQVDLAALDAGSTGCLFASIRKQGQAWSVENVNQGYPGKELPDFFHLFGYQG

SEQ ID NO: 7779 - protein, 233 aa, Chromobacterium substugae
MSDYRGLFDAQPPRAQAAAPEAARPDPRALFDRMPGAPGAADARPPAAPASIATPTGLQRRYDELLRQNEGLAHRVIDLVQSLKLRETRLDQQFRQAQRQARELQQLMRPRWRLPWGQPAADKTRGHQLIDQLQGFLRSEMKPDVFISKDMDELQRQTGYLERLSATLQTDAGALLPPDAELRQRIGTQAHILAMQAASSRQLIEQLQRQLQDIEDWRANFLSLLVIDIQQRL

SEQ ID NO: 7780 - protein, 357 aa, Chromobacterium substugae
MPQYQNLFDRPAAAATQSAVPATTAAASAPDPILISQLRQLASDKLEEIGGSQTRQLLGLSDQLLAKTRAGDTGAFGRGMNDVLRLMSSVQFDQLGSPDGLSGLVDKVRRAFKLAKVDLAQAFDSAKGQIDKICADLRQRLQVLEGDNRWLNGAYAANLNDMQALEQLLPALEAVRDEEAAKLAAMNPAEPMPMAEQRQRVDRLGRRVEAIALQIHQSKLRAMQIKGLEDANRGIHDDFRALLENAIPAWSAEIGMGLLSLRQKANIEISNRVKDQIQASMKRAADQIHDNVLGAEKALQRQAVDVATLRHVQDKTVAMIQQKIQLAEQRDRQRLQTMEELARMEQELKQSLRQLGS

SEQ ID NO: 7781 - protein, 444 aa, Chromobacterium substugae
MPPDLIGRLIKHWPDELSGQCSFEVGLSGGLDSVALLSLLCGVREEMPGLRLSAVHVHHGLSPNADAWARHCEQLCAALQVPLRVARVAVTAAGGDSLEAAARDARYAAYRESAAGVVVLAHHLDDQAETVLLQLLRGGGAKALAAMPALRPLAGGKLLWRPLLALTRAELEAHVRRQSLAWVEDESNQDTRYRRNLLRLEVLPRIERGVPHYRRHLARAAALQADAAAILQEVADADLRACRCEAGLSLPALAALSGPRQRQSVLAWIESLGWSAPEPGALLEFLRQAHHAAGSPQLALPAGHLLRFADTLQAWPKVQLSHGSEVLPDCRGGRALSLPAWGGELSWEWRERGLPDAALAGLWLALRRGGEKLPAQVGRREVKDLLREAGLPPLLRQRWPLLYGADGQLLALPGIAISFVHSTGPGWWPRWTPVRAGHGDPARA

SEQ ID NO: 7782 - protein, 321 aa, Chromobacterium substugae
MKPTFLDFEQPIAELENKIEELRFVQDDSVLDISEEIARLQKKSLELTKTLYAKLTPSQIAMVARHPQRPYTLDYIQAIFTDFEELHGDRAFADDAAIVGGLARFNGQSVMVIGQQKGRDTKEKIRRNFGMPHPEGYRKALRLMKLAEKFGIPVLTFVDTTGAWPGIGAEERGQSEAIGRNLYEMTRLRVPIIVTVIGEGGSGGALAIAVGDHVNMLQYATYSVISPEGCASILWKTAERASDAAEALGITAPRLKTLGLIDRVVNEPVGGAHRDHAQMMTTIKRVLQDELKEVQSKPLEELLKQRFDRLMSYGRFKEDAA

SEQ ID NO: 7783 - protein, 514 aa, Chromobacterium substugae
MNKAILLAACLACPPAIASTTADTAIWQYRVQAGDTLWSVASQHLVSPSYVPKLQAQNHIANPYKLPPGSLLNIPYAWVKQDVADAVLDDMSGKVGAQGRNGATLSLVRGQHYPGGTRFSTGDDAMLRLKFQDGSMLVLNANTTLTLESQAYYPSTGAIQSQNKLENGSTGSSVIPNILMPSRYRIQTPSAVTTVRGTEFRVRSQSDDDTAAEVLRGTVNVNARQGEVDVPAGFGSRGKSGDGQPVALPPAPPLTGLPPSSAFNPPPLQWQAAPGEDGYHLSIHQQGDQPRLLQERDSAAPRFYPALPQNGAYRLTIRAVNAVGLQGFDSQRDFALRAYPLPPLIVASQGPQQQRGHTMTLRSSASATQPAWLQVARDAGFQQLLFNGRVDEPQKSLELPAAGAWHWRMASIAADGALGPYGDAQILDVTGWLGLPDLRAPALATRRYPLPGLRYTLSLIPAAGQAAAPAFQQTSDQPLWPLRDLPRGRFAVTIHIDDNTGYHAEEKYPSLDLP

SEQ ID NO: 7784 - protein, 533 aa, Chromobacterium substugae
MLLAILGLLLTGSQLLNRLDLWLYDGLSRSRLAHDDHAAITVIAVDEKSLAELGRWPWPRAYHAQLLDKLSQAKAVGLDIAIVEPSAQPEADQHLAAAIRRNGKVIGPVFPEMQGRRLVETRPLPLLSQAMAGLGHTDYEQDDDGIIRRVYLQAGLGGPRYLSFASALCQLASGGKPATPAAAPAGAAAWHRAQAVMVPFSSGNRPYQTVSYSDALNRLPPASFASRIVLIGATATGLGDSHPTPISANNRGLSGVEINAFMVHALLENLQITQLDTVWKGLLAGLILLLADWRLSRQRSPRRLLAHYALTALAMLLASAVALYLGRLWIGGGVTALLLLLAGMLRFVASLSRLHTLAMTDGLTGLHNRRHFDEAFAATLAAHQRQRRPLALLIVDLDNFKGYNDHYGHYAGDEVLQRTAGALRKCFRRKDETVARLGGEEFGILLANRRPEQALAAAERFRRYLEDLQLPHAASPLGKVTCSIGVAARPPADDTPRSLFEDADQALYLAKSEGRNRVCQAESGPAAPQASAP

SEQ ID NO: 7785 - protein, 164 aa, Chromobacterium substugae
MALNMTNRQGFLLVAAACAGAMAFALYAQYQLGEEPCPLCILQRIGVMAAGAIALLAALHNPGRAGAKVWGGLTVLAALAGSGVSLRQLWLQSLPADQVPQCGPGLEFLMESFPLWQVLSKVLKGSGECATIQGTFLGMSMPFWVAVFFAGVIVWTLWLVFRRR

SEQ ID NO: 7786 - protein, 379 aa, Chromobacterium substugae
MRRPGRIGLVLSGGGARAAYQVGVLLGIAKLLPDPAQNPFPIICGTSAGAINAVALASGAANYQLAVATLAKVWKQLHIQDVYDVSTSYFLKTFLHFGVSLLSAGHVWRNPQSFLDNAPLRDTLGRAMPFDAIGGAIDSGALQALALTASCYTTGMSVTFFQGQDKLEEWTRYQRLGIRERIGLDHLMATAAIPLIFPSVRIGEKFYCDGAVRQLSPLSPALHLGAEKLFVVGLASQRPDTIERRSSGAYPMPAQIFGHLLNSVFIDSMAVDMERLSRINHTVSLLQSSEELASRTQLKKVEIFQLNPSKSLEGIVFRHTHLFPPFLRFIMKGTGATRQRGTALATYLLFEPEYCRELIALGYRDTLQQKEEIRNFLEL

SEQ ID NO: 7787 - protein, 299 aa, Chromobacterium substugae
MPLLHCSIPLPPHFRPQDILAFHRRDGERLAEQVDGDGLRKGLSWRGAPACLALRFAGGEARLELALDGDGDGGDARLLEQTGRRMLGLAQPVEAFERRYRDHPQLGRLIAARPGMRVPQTATPFEALAWAITGQQISVQAAVSIRRRLLQLCGRRHSSGLLCHPDAAALAALDADQLGLAGFSRAKSRALLALSQGAAAGELPLDDWLADMPAADISARLLAVPGIGPWTVSYALLRGYGWLDGSLHGDVAVRRALQMVLATPDKVSAPDAQRWLEGFAPWRALVAAHLWALLQAGGF

SEQ ID NO: 7788 - protein, 215 aa, Chromobacterium substugae
MSASLFAPQGEPWAERLSAGAVLLHGWALPQDAELCAEVDAVIGQAPLRGMETPGGQSMSVATSSCGDWGWVSDRGGYRYSASDPQTGQAWPRMPARLLRLAGDAAAAAGFPGFAPDACLINCYQPGARMGLHQDKDERDFSAPIVSVSLGLPAVFLLGGLRRADRALKIALEHGDVLVWGGEDRMRFHGVQPVKPGVHPLLGARRLNLTFRKAR

SEQ ID NO: 7789 - protein, 447 aa, Chromobacterium substugae
MADKTFSFSADALSGIAGRVLELAGKLGASAAEADVSEGVGQSVSVRLGQVETIEYNQDKGVSVTVYLGQKKGHANTSDFSDQALADTVRAALDIARYTAEDDCAGLADPQLLADELPDLDLFHPWQLPVEQAIELARRCEDSARAVDARISNSEGASVSVQANQFVYANSNGFNGGFASSRHSLSAAVVAEQGGVMQRDYWYSAARHRDDLAQVEEIGRIAGERAVRRLGGRRLKTGQYPVLFEAPVAMSLVGHLIAAISGGSLYRKSSFLLDSLGKPVMSKQMVIDEDPFLLRGLASSPFDNEGVATQSRRLVDDGVLQGYLLGSYSARKLGMQTTGNAGGSHNLVVHSTGESFAELLGQMGSGLLVTELLGQGVNTVTGDYSRGAAGFWVENGVIAYPVEEITIAGNLRDMFLNIEAVGTDVLDRGGRRMGSVLIGGMMVAGEE

SEQ ID NO: 7790 - protein, 184 aa, Chromobacterium substugae
MSDYQNDGQDDGFVSKSQRKRDMDALQDLGSELVELSKDTLKKMALPEDLLSALLEHKRLTAHGAIRRQLQYIGKLMRNVDPEPIQQYLQILKGESSEHISWQKLLERWRDKLMADDANQPLFLQSFPETDPKQLHSLVRQSRKEKQDNKPPKAFRQLYQLIKEQIPEPGKPRIWQKDEAEDDE

SEQ ID NO: 7791 - protein, 192 aa, Chromobacterium substugae
MLKIGLVSISDRASQGVYQDKGLPALQDWLARALATPFETVCRLIPDEQPGIEAALKALVDDEGCQLVLTTGGTGPAPRDVTPDATLAVADREMPGFGEQMRQISLRFVPTAILSRQTGVIRKQSLILNLPGQPKAIQETLEGLRRADGSVEVPGIFAAVPYCLDLIGAPYIETHETVVKAFRPKSAIKPAP

SEQ ID NO: 7792 - protein, 322 aa, Chromobacterium substugae
MSYRAPRWLRGGHAQTIWPALAVKVAPPAYRRELWDTPDGGHIALDFVDGKPGAPLVVLFHGLEGSSASHYAKALMQALAARGWHGVVSHFRGCGGVDNPLPRAYHAGDAAEVRWILQRLSARFAAIAAVGVSLGGSMLLNYLAEEGEAALPCAAAAVSAPLDLVAASTRLDRGLGKLLYTRMFMDTLKPKALESLQRHPGLFDAGKLSRARTFIEFDDLVTAPLHGFGTALNYWRQASSKPRLGQILRPTLVLNARNDPFLPASALPDASQVSPAVTLDFPDDGGHVGFATGPFPGRIDWLPQRLLAFVEPHLAMRAAQTS

SEQ ID NO: 7793 - protein, 170 aa, Chromobacterium substugae
MQDPSTIERSLIVQWDDPMIGARAARTLSGLEYLREMEQGRIPPPPIMQLLGFEFVRAAEGEVEFAFRPHESHFNPIGSVHGGVISTLLDSAMACSVHSTLPSGRAYTTLELKVNFVRAVQPRHGRLVCRGQVIHAGARMATAEGKLLDAAGRLYAHATTTCMIFDAAAA

SEQ ID NO: 7794 - protein, 190 aa, Chromobacterium substugae
MLRSALLCLAFALLSGCASMADRLRGSLTPPPGRAYAILSLTGKAFNPDLATVGMSVRDAQGRVAAEDAASLLTDTVFGEEGMSPVEGKLVLLDLPPGDYRLAGVWGHWSEDGVFGSDLKMKQFRLDAPFHLDAGETVYLGQVQLEMSFLPEVKLGDEQKRDFGHMRRVWKIPDLSRVAVRPLRLAGPRP

SEQ ID NO: 7795 - protein, 386 aa, Chromobacterium substugae
MTDSSPKVKLPRNFLRAGQQTPVDVYAKNGVLLLKRGHYVLTEEQRDRLARLGHGESDEVEARLERERLERAAMREKEAEQQRNSSNPLQEMAFLLRRAEGVLLHGLAVRDLAGSLLDMADGLLNISRRHPDGVLASVFLLPYQDIGSAQSAHVAAILAVLGRRLGLSDAELRPMLGAALSMNIAITGLLNQLARQAEPMNADQQGLMFAHPALGSAMLREAGVVDECWHQLVQQHHEQLDGDGYPLGLAGDEVAPDALLLQMVDLVCGCVHQPQPQLPALVLGSLFRGELGRFPPQHVSLLVKELGIYPPGSFVLLASNEVAVVTHRGDKANTPRVAALRKLDGPPYADPLLRDSRQPAYQVLEPVAATAAATKPAYLYKLWYKP

SEQ ID NO: 7796 - protein, 281 aa, Chromobacterium substugae
MSQQDDILPRRSFLAGAGSLGFALAAQPIAASAILTDSQALQTGAPAIDTGNGVMAGYYAKPAHAAGPLPLVIVIQEIFGVHEHIRDLCRRLAKLGYFAVAPELYFRHGNPALAPDTDTLLREIVAKVPDSEVQSDLDATWRWAGANGADLKRAAATGFCWGGRQTWLYAARNAELKAAAAWYGKLEGPATANMPRYPLDIAAALKVPVLGLYGGQDQSIPLASVEKMRAALKQAGQDDDIVVYPDAGHGFNADYRPGYNRAAAEDAWHKMLDWFARHGAR

SEQ ID NO: 7797 - protein, 371 aa, Chromobacterium substugae
MAKQQQMPEIVDPIAFQEFHDAMLDYAPQLELLVCQLGDGSDNAEKIAQLFRILHSVKGDASLCQVHFVEPYAHALETLLDRVRQRELPYLEVIGDVLLLVMDRLVLMVEAVFNGEALDDLQLPTVLSALEKLPKLSADEVPQACAKLVSSMMGKVAAASAADSGLTSGTGSRSERRFADLQFFRSLALQLEQRLPPFFGRTERNLALALDTNQLMAQPLNVEQLAAAVYMHDIGMMLLPEALWLKVGRMSEEERRQMSAHPGWAAGLLERMPGWEEAAKMVRQHHEMPDGHGYPDGLAGGDICDGASLLALVDAFESVMLKHAQQGQRRSMLRAVVELNASERQFDPELLQLFNRVIRARLEARASVGGR

SEQ ID NO: 7798 - protein, 67 aa, Chromobacterium substugae
MATGTVKWFNDSKGFGFITPDEGGDDVFAHFSQINAKGFRTLAENQRVSFDIVDGPKGKQASNIQPM

SEQ ID NO: 7799 - protein, 183 aa, Chromobacterium substugae
MPDHETVIAATKTWLEKAVIGLNLCPFAKAVYVKNQVRIRVSEASTPQQLAEELADELQLLAQADPEEIDTTLLVHPKVLQRFLDFNDFQDIADAIVEELELDGVLQVASFHPKFQFEGTGINDVENYTNRSPYPTLHLIREESIDRAVAAFPEAEAIYERNIETMRQLGAAGWKTLFEHKAD

SEQ ID NO: 7800 - protein, 216 aa, Chromobacterium substugae
MFGACPDAGRASVAEPCTRSRAAAQGRHAFHYFDTPVIRELFRWLSLLLLKLSGWKLKGEFPALDKYVLIGAPHTSNWDFPITLGLCFAARAKIYWMGKHTLFKGPMGPVMRWLGGIPVMRHQNNSLVQQMVDVYGRSSRLVVAIPPEGTRKAVKEWKTGFYHIAHGAGVPIALAYLDYSRKEGGFGPMFTPSGDIERDMPLIRAFYADKVGRYPG

SEQ ID NO: 7801 - protein, 75 aa, Chromobacterium substugae
MNTTIAQPRIRLAAAALIAISLLSGCANMSHRQQNTAIGAAAGAVLGSVLTGGDAIGTIGGAAVGGVIGHQTGRH

SEQ ID NO: 7802 - protein, 449 aa, Chromobacterium substugae
MNWERLLSTRRFKIIQGEVKETRTPATQEGGSGLRTDFHIDHDRVVFSSAFRRLGRKTQVHPLARHDHTHNRLTHSVEVASVGRSLGNRVGVMLEHDGLLPPGYTPHDIGAVVQVACLAHDIGNPPFGHTGEYALRDWFRDDSNAHWLNGLSAAEIRDVQTYEGNAHGLRMLASLEMYSGEGGMRLTSAALGTLIKYPWTSDAPLARERDKFNLYRTELPYFERVAEELGLLRHSPLQWSRHPLSYLMEAADDICYAILDLEDAVEIGILDFKEFETLFSGFAEHERVWGVHDVRQKCGTLRGVAIGRCVTEVAEKFMMHHSSLLRGEFPAKDLINLCEPAVQDALLQAKDLASHKVYRHRTKLVTELASYPCIATILNVLVPAVHAFITKDSKDLTPREHLAMGLLDGHIQTGDSLYQAYMKVLDFVGAMTDNYAANLARELSGVGIL

SEQ ID NO: 7803 - protein, 210 aa, Chromobacterium substugae
MTRFCLVRHGETDWNREYRLQGHTDIPLNDTGLEQAIQLARAFSPGQHRFDALYVSDLTRTRQTAAPLADKLRLAALDTPQLRERHMGALQGLTYAEAAQRIPDIYQRQQTRDPDYDLEGGESLRRFRARVLDGMASIAALHPGEDVLIVTHGGVLDIMYRAATAKPLEDKRDFPIPNAALNWLDYQDGSWTLRRWADESHLSGALDEIQ

SEQ ID NO: 7804 - protein, 129 aa, Chromobacterium substugae
MTIEKTDAEWRAQLTPEQYRVARQSGTERPFSGEHYFHHKQGDYFCVCCGALLFHSDTKFDAGCGWPSFWAEAAGANIQRITDTSHGMVRVEVRCSQCDAHLGHVFEDGPEPSGERYCINSVCLDFKAK

SEQ ID NO: 7805 - protein, 64 aa, Chromobacterium substugae
MTLAFNQAKVVQQDLVSQRFFGQDREKPTCGFDQWRDHLETALVLRGVSFLLILDLYNGASTVA

SEQ ID NO: 7806 - protein, 603 aa, Chromobacterium substugae
MSLQIILESPEGLSGQEPLASAKQRPFDSHSSLAQTAALRRQAYTDAFNAQRSPCYTKHKLEAFIQDIAQRIGDSNPPSSSTLYRWHTRLQSSGGNPLVLVPNFDRRGGKGPRMEGELLLLAEAAIQTTYLTLKRPSIRLTYEKLLIQIAAHNDQAPADKQLKVPCYDTFRRLVRNQPQYEVDLARYGREYARKKYRHSSITPTTMYLLERIEIDHTPFNIFVIDEESMLVLGRPYITVIIDCHTRMILGFYLSFSPPSIEAVLRCLQHAISSKDYVKERYPDIQHDWPCLGIPTTAVVDNGLEFHSQDLLRATFELGINYQFCPPRTPWFKPMVERSLRTLAEQFAHQLPGTSFANWFDRYGYDPLKESIVTLSELVHALHIWIIDIYSQAYHRGLKQTPYAAWQRAAEIVTPRTIDPDRLRLVLSKQAERVLGHAGIELHGLRYNCKDLLPWRKQLGDRIKVQVRFDPDNLGSIFALHPQTKEAMPVPCLTPDYAEGLQLHQHKLIQASLRKEGLASADPLSLARAKVRMQEVVGQLLQSRKLADRKRAARAKGAHSSKVMTTGKLPPTISEDAELPPTDSWSPPSTLPVLAHDLEGDGHE

SEQ ID NO: 7807 - protein, 266 aa, Chromobacterium substugae
MLLSFAKQHPSYETEEATIRPVVYVQVPAHPTIRGLAEAILIALGAGVQLRGSTAEKTNQIVQLIRGGKTEALLLDEFHHFVDAGRRTFEEVTEWLKALIDQIAIPTVLSGLPECEWILRSNEQLRRRFAARVALTPIGFSCNEDKSLFRDVVHAWDTQINQGRPIWGLAEWDCVRRLHYASNGLLGYLSKVILGALECLIEQEQQDLDQSVLAMAFSNYIWRDSPPELNPFDANFVFRRLNQPDEPFEPTRFSRRNAPKAAIPAL

SEQ ID NO: 7808 - protein, 615 aa, Chromobacterium substugae
MTSPLLQIRPKPQAGESLLGYCLRLGHANGYPGQTWLPLFVKKHDAAKQNLTLLTGHDQTGLECLTGPAPASLGRHSHHRFGLKVTYWNHHHRRWCPVCLAEHGIWQTEWLLTLQIACPIHRLLLREKCPGCNQLIRWHQGTMFTCSCGADLRHAATRPGTAAELALAKLIAQAIRPLIGLPDLAVSNIPTPPELDHLHPAQLCDLLWFFGAYASHRPNTRPQKIADHGRIEIIQPYLQLAMQIAQHWPQRFHQLLEEYTLPIPGNTASLRVYLREIHQALYRLLIHPELLFVREEFERYVHARWPDKLILQQDLRQAHPIISLAKAAEQLNLSRGAVHKLIESGAIKGCQSSSAKGKATWMVERSSLDAYARNEHGTLTISEVERMLRITPKRIRLLIESGLLQPLPHDKKRTRWCFQLETINAFLEQLNHSQISPEPNNPELLSVWEITKRWMQGSQPFLAVVRALQDGSLEVVGRTPADHGLRALLVSRQQFTLWHEQYRRSRGFFTVREAAAAIQMDVNLLYHLIGAGHAHASQQQYGYEKRMLLGIEAKELERLTNNYIWGEHLAEMVNKPVRQAARHLVKQGLCPLYGPMENCGDEYVFWRADVAASLT

SEQ ID NO: 7809 - protein, 526 aa, Chromobacterium substugae
MPIEDSERRVANALKRLPDGWRILHHVSWQSKRGGRQGDGEADFIVLHPNKGMLVIEVKGGGIDIEAGRWFTTDRYGKRHSIKNPYEQAIISKHALVGWLREHGLGARVRVGHAVAFPHMDSLPFSGPAATAEISLAKPQLENICSAITNCFEHWELEAGISQEEADKLVALLAPTVSMLPKLSSQSSEAETEILMFTTEQIEAFSGLRASRGGLILGGAGTGKTVLAIARAQQLARDGFRTLLVCYNELLGRDLLARTENLPNLTACTYHSLCLREAHRAALDIPGHKPSHWWEKEAPNLLIEACAINGTLYDAVIIDEGQDFSPLWFNSLRCLVSTHPDAPFFTFADPLQDMWKRDWLRDMDYSFAWELTRNMRNTQPIATCVVATLNMECRGRGIPGPKPTWKISEGVPSEKDVISAVEGLLEEGFGPSNLVVLCGSAGLITRLHERSVGPYSFGKWGSRGIATETIARFKGLEAQAIILALPSITTANDRIEAYVGMSRARSMLVVIGRDSDRRLLNWPEPL

SEQ ID NO: 7810 - protein, 571 aa, Chromobacterium substugae
MKEKRSGSQILFGHLPEQTIDADGGIWKVKRWNDPKTESAIDVAALREEIIRAAYPWKEEKCDGGLVDDLYAQRTVRVRSLNREEGIWCEPFPRLYLCQICKRLHDEPLGLCECGSRRRRGQLPFVGYHDACGSIKTPYVKKCRTHGQRAVRFPGTASAAELIFYCPECNDIIQRGFGAACDCDQGGTLAFTVHRSGTVFKPRGISMINPPRREILNTIEQAGGGERALEWILDGMAGKRVTDSAPARNSESIKKLLEGRGFDTATIDAMIAAMPPAGQGNTRSPMAIDPQLRTDAERQAKQIALATFESRITLSDLLAQSEGFVTRQLYKDDYPLALARAGVERVELIDRFPVLTAQFGYTRGGSEPGKSRLRTYRDKNGDYSIYGELAQTEALLIRLDPMMLHRWLVRVGQAVGPATDKRGAAEAILSAMSPMDRPNEVTRRVTELVHSFSHAFIKRAAVYSGIDRNGLSELILPTAFSFFVYAAARGSFVLGGLQALLESELHILLDGLVDDEHRCALDPGCEDNGAACAVCLHLGEPSCQMFNAALTRRALAGGDGYFDVTTAAQAN

SEQ ID NO: 7811 - protein, 1029 aa, Chromobacterium substugae
MEFIGPMQTDESKYQAAERFVNWLQKRVLIEARGDDETTSPVDPTGRYWLGRLGPKDFVTRPDLRGDRLEPCAIGLRLRPAESGPWAFLVTVRFSLWLRRRSTEEKGLRWAYDKTPYIEVQVPVTVEERTGDQIFGEVAFSEAFSTWNANNLSAEVRVRLTGRTASSRAIEVTFVNTSREDVDLADGRFFEASLSVTGLKCVPFDLESLPDSFRFNRKVPAYGINCGVEIDGEAYRTSDGPNATRFRPNFSASSEKKVDVSFDGLAHDPCASATDLVGIFELWASDVWSEETLAQRAKDESWSAGMREEAAAARQEFQDELRRIKRGAELLATNPNLRLAFQRMNRSMTISARGRYKKWRPFQFAFLLANLECLVNHESESDIVDIVWFATGGGKTETYLGLILTAAFLDRMRGKISGVTAWSRFPLRMLSLQQTQRFANALAAAELIRREAKIEGDQFSLGFLVGGSSTPNRIKKESDKANEDVDKIEERTNPFKLLDRCPFCRERDVSTSFDRVYWRLNHLCSNGDCPSQGGPLPIYVVDDEIWRFLPTVVIGTLDKAANIARQTGMRGLLGSPKGKCTKPGHGYTYATRSDFPNGCLVPDCRGGAPEGLPMAEELYPAMFRLQDELHLLRDSLGAVDAHYECAMDGIQERIAGSKPKILASSATLTGYKKQVDVLYRRKARVFPLPPPVDGQGFWATDSDKLMRRYVALAPRRLTVEFVVDKLIVTLQNAIRSLLNTPGKICSELNIDPSYASLLVDLYGTNVVYGNTLQDIDAVVRSSETQYAELVPPPNVATLTGRTNFEEVRQTLDRLESPEPEFDKRLHIIAASSMMSHGVDIDRLNIMIMLAFPLGVAEFIQATARVGRFWPSLVLVIPKMTRERDASVYRAFPEFVTHGDRFVEPIPITRKSRRVLERTISGLELARISMIHEPSSAAPITTIRSLNAFVSANQGVLANDEQSIAEDLGLADEDEFMRKQLSQWFTDFSRNLREPPSDSKFLSDLCPTGNAMTSLRDVEEQVPIKGDSTR

SEQ ID NO: 7812 - protein, 561 aa, Chromobacterium substugae
MPRGARMNKKTKNLRAIDLYSGVGGWALGLRLAGIEIVASYERRGVANETNFKNNRHQAQTVDIRRLDLNELPKNIDIVVGSPPCTQFSFSNRGGNGDIEDGLQDIIKFLEIVDHVKPKMWAMENVPRVAKIIETELLPKGRLHRFKHLNIVPHTINMADFGVPQKRLRCIAGNFDFNLLSSYVPEVPKKTFGQVIRALASDSIVDPVYGLQLNRQHLRDHVAEEVLSAEEVRINKAAKVTHPVYNCMSFPDRLDRPVRTITATCTRVSRESIVIEDPNRAGAYRRLTIRERACLQGFPVTFQFYGETYGQRQQMVGNAIPPVFTFYLAQALKNVSADKLTKLSDAATGLECPIPLPVDAKPDRSGVKYPEKRKFRFAIPSLRLKSGVRFEMINTFEGSQPVWKVDFYFGTSKSIQSLRLDNTLHTFLIGKLPKTLRSKVEEKLASLLNFIRNADVAHMQRIWSHKGVGCTTPFMLLDRLDESGTDMVKLLGGDELLAQVLVSDAIMAEYGQAAGGLPGLAKLARNAPLILAGLLIGSLANMELSGHVDMVPRAQKKQVVG

SEQ ID NO: 7813 - protein, 248 aa, Chromobacterium substugae
MCERILALPQQAGTYAAMAPYQKPDVSVDIVLLTLFDNKLQVALHRRNSAPFQDRLALPGGYIHVDEDLTLEEAAIRTLRQKTGLSPRYLEQLRTFAGRDRDPRGWSVAISYVALMPVEELQSAGEGVFHFYEVDQLPDLAFDHAQQVAEAVQRVRNKASYSTLPCWLLPETFTLTQLQRVYEQIFGETVSRGTFRSRLGIRVGEVQAGEAADDANILVATEDFLGGSQRPARLFRVNQLSLFRRAWW

SEQ ID NO: 7814 - protein, 269 aa, Chromobacterium substugae
MKIFKIANGSHRLPVSLQSLVFPGGEVHVTVETDVPGEALLIDAHLPDSAAIMTLLLVTDALHHAYPGTPITLRLPYVPYARQDRVANPGEALSAKVFCQLINSQQYQRVVIQDPHSDVVSALLDRVEIEDPLPALREVIQQIGPVALVAPDAGARKRVLKLAKSLALDVVFADKIRDTRTGAITGTQIASPLPDLPLLVVDDICDGGRTFTELAAALATQQQTQNQDHPLYLFVTHGIFSKGLEPLLSCYHGIFTRNNWTQDNRCQLV

SEQ ID NO: 7815 - protein, 561 aa, Chromobacterium substugae
MNTNTPIAEKNALVPFNLADFYKTGHPAMYPQETTKLVANFTPRSAKYAPVLPELFDNKVVWFGLQGFIKEYLQELFQKEFFAKPKTAAVRKFQRRMDTALGPEAVPVNRLEALHDLGYLPLEIRSLPEGVRVDIKVPPIVFINTHPSFPWVATYFETLFSCESWKPSTVATIAFEFRKLLSYFAKLTGAPQEFVDWQGHDFSMRGMSGVHDAMRSGAGHLLSFTGTDTIPAIDYLEDFYGANADQELVGGSIPASEHSVMALRILLTQQRLARDPAHAHLDAKSLRRLAEREVIREFVTQDYPVGMVSLVSDTFDFWNVITVIAKELKSDILARQANALGMCKVVFRPDSGDPVRILTGYADDEVRADAEAGGYEVIATGQRITDAERKGAVECLWDIYGGTVTERGYKVLDSHVGLIYGDSITLQRGRDIMLRLADKGFASCNVVFGIGSFTYNMLSRDTFGYAMKAIYAEVDGECVDIYKDPATDDGTKKSAKGLLRVEQEGNQYVLYEQQTLEQFDSGALQTVFRDGELLITQSLADIRARLQASWTCPEPGAIAWG

SEQ ID NO: 7816 - protein, 902 aa, Chromobacterium substugae
MVSIHVDGEDKTAQISDWTIAWSKKDEALKLTCHFPSKKTYTRPLSDCRIVPTRELGEMLLKKRNSSVVKPIEKAMVYGERYALVYYPGTAKPYLHKLDSISFVAQTALKESSVFRYFANVAHARRDRASSSDQQTIAANVIRQLEKLPSCADTALHAYCTGQNGRQAPGEALIYPFGVNESQLAAVEQAFSAQISVIEGPPGTGKTQTILNILANILLRGKTVAVLSNNNAAVENVYDKLERFSLDHLVAKLGSQENRDNFFANQPPWPSAEPEAAPEMAEIQEMLARLKQHLHDHNRAAQLQAEIDELNIERRYLQHWQKDSGVYVSVPLDKYGLSPRKTADLMAYLSHLGEQRVRLRDRFELLFNFKIFRTKPFAQLDDRLSFFHALQMHYYDKALKDKEAALQTCRESLARGNFTALLQELTISSMHYLKQHLHTQDRGSDTFDAKTYRNHFDDFVKRFPIVGSSTHSIVNSIAPGTILDYVIIDEASQQDIVPGILALGCAKNLIIVGDSRQLAHIPVKLDLPAPADAYDCERYSLLDSCIAVFKDAVPRTLLKEHYRCHPRIIQFCNWQFYGNELIPMTQDKGEAPLRLVLTAKGNHTRENTNQRELDSLLKVLDGKGESIEWDQDGRGFISPFRAQVKLSSTCLPGDFVKDTVHKFQGRECDEIVFSTVLDKKRHNQERLDFVDDPRMVNVAVSRAKSRFTLVTGDEVFTANNGHIAALIRYVEYYAEDGQIARAPVVSAFDLLYREFDQSLARLQTRLRPEDSRFQSEQIVAQLLREALSKEPYRTLTCHAQIRLNQVASSLNPALTERELAFMRNRASCDFVVYFKVGKTPLGVIEVDGGSHDRPEQAMRDALKNSILTKSNIPILRLRTVESHIEEKIDSFLAQWASATTND

SEQ ID NO: 7817 - protein, 424 aa, Chromobacterium substugae
MILLLTLAVGGVSYWSAFKEANDMQDGMLNQAAWLLDQERVPPIETTAMHPVVLENESRVLIQFLAAHQAVPGRLPLPADLPNGLQTLQLNGEPYRVLVKTLFNGVRVAVAQERHIRDDIAADVAMRTALPPFLLLPFMIWLVARLIKNMLRPITELSREIDLRQVTELHSVEEERLPLEIRPFAVAINRLLDRVSQSVDSQRRFLADAAHELRSPMTALSLQAERLAAIDLPDNARERMATLRCGIERSRRLLNQLLTMARVQTTAAPQAGMAAPVSIQAVFRSVLEDLMPLAEAKGIDIGVEDGTDVAVKASELDLATVVKNLVDNAIRYTPSGGKVDLSAGVLPDGVFLVVADNGPGIPEPERERVFDPFYRMLGTEQQGSGLGLAIAREVAGRLGGSIALNWSEEAERLGLKVVVKLRAD

SEQ ID NO: 7818 - protein, 221 aa, Chromobacterium substugae
MRVLLIEDDPMVGEAVVSALRDASYAADWVRDGKRALLALENHVYDLLLLDLGLPGRDGMDVLAAVRRGGNPVPVLIVSARDSLDDRLKGLDGGADDYLLKPFDMAELLARMRAVARRKSGHAAACLGNGVVTLDPATREASAAGADPVLLSNREFSLLQALLARPGAILSRGELEERIYGWGEEVESNAVEFLIHSLRRKLGSAVIKNVRGMGWMVSKSA

SEQ ID NO: 7819 - protein, 56 aa, Chromobacterium substugae
MTFRGANAAAAYQPAAANGAPAQDQVRISSAGRAKQQEEAAESAAQAAQEAASGQS

SEQ ID NO: 7820 - protein, 198 aa, Chromobacterium substugae
MDDVNYTLFEWLNAPALPSGCLLALAKFLGEYLIALMPLLLAGCWLWGGARQRKAALEALAAALSALGLNQLIAWLWPQPRPFMLGLGHCFLNHAADASFPSDHLTLWWSVAASFWLGRAMRNCGYGLLAAGLPMAWARIYLGVHFPLDMLGAAAVAWFSAWVAYRLAWRYLPPVYCAALAMERQLSSYFSSHSGSVK

SEQ ID NO: 7821 - protein, 178 aa, Chromobacterium substugae
MSDNARYPLSVSLLHWLLALLVFLNFALGYLLDDEESLLAAHKLIGAWILLLALARAANKMRLRKRLPASLNPPGSWPYLAEKWAHGLLYLCMLGVPLLGWLKTNAAGHAVTLFPGLDLPALAATNRTLSHWFGGMHESLAALFALLIGLHVAAALWHRISHPGLGQARMLPMRGVKR

SEQ ID NO: 7822 - protein, 107 aa, Chromobacterium substugae
MLALTVPAQAGELKSLMKDMKTAMNGAMGSADVNEFSNCLQRLRLDVDRAAKLPYPDNPTDYREGMRTLSVDLNKAEQFARAGNLAAAKQSLQAANQTKKRYHHLLN

SEQ ID NO: 7823 - protein, 158 aa, Chromobacterium substugae
MGLAGGLLAATSAALASPPLKNWFDDPFFQARGRIAACPLPQGPFATEAEMKQQAHSRIERGTSCWLAKQCAKPNAYMYDADIAADLRRRFSQSRRFADASLWLTVQRRFVYVEGCARARRAVAGIESFIKRTPNVQLVIANIRVGAEKPGYAVMPAP

SEQ ID NO: 7824 - protein, 163 aa, Chromobacterium substugae
MNLPKSELDDVDRAMMALLQRDGRLSNAKLAEQVALSETPCWRRLKRLEADGYIEGYQAVLNRKKLGYGVLAFVQVGFGSHTGDAPLRFEAQLQAIPEVLSCHNLTGECDYLLQVVAEDLEAFGVFVRDVLRELPGVSSIRSSLSLREVKMSGRLPVAADRRG

SEQ ID NO: 7825 - protein, 205 aa, Chromobacterium substugae
MLPLSLLSLYLAALVAVYVLPGPDMALVMATSASRGAGAGLMTALGIAASRFLHVMMSGLGLAALMATHPLLFNAVRWIGAGYLLWLAWKVVSAKPAAENAPQVAESGRAAIARGFLTNLLNPKALMFCALFLPQFVSPAYGAALPQFALLAAILVAVGLCFDTAYAFAASGIARRLKTSRSTAKLQKGLLGGMFVAMAGRLIFG

SEQ ID NO: 7826 - protein, 310 aa, Chromobacterium substugae
MPLPLNLNLLRSLEALLETRNLTRSADKLGLTQSAMSRHLVQLRAQFHDPLLLREGQRFVLTERAEELRLGLKTVLEQVERLYQPPQFDPAVCEREFSFAGSDYLAEYMLPDILDQVLPQAPNMRLKFLPWQAGRFDMLVDGSADLVSTIADEIPDNIYGKSLGQDQPLCVMANDHPLRGKSALKQDDYLAWPHARVSSASDKDGFVDVQLAQNGLARQVRIATPYFVSALSIVSRSQMLLTLPEHLAVRFQRQFPVCAKPMPFIDYTYRYWLLWHGRADKDPAHRWFRGHVFDALHHSIHGVSNYAGDA

SEQ ID NO: 7827 - protein, 207 aa, Chromobacterium substugae
MTWTIWLQFAGVCMLGAMSPGPSLAMVLQQTTRGGRSSGLAAASGHALGVGLYALAAAQGLALLMAAHPLLFRIIAGLGAAYLVWLGVQGLRAAARPRAAAGATTAAAAPTSAWKAARTGLAVSLSNPHLAVMFVALLSQFVTVDMPASGQALLIVTAMGLDFGWYALLALLISQPAVLGGLHRKARWIDGCGGALMLLLGLRILMV

SEQ ID NO: 7828 - protein, 152 aa, Chromobacterium substugae
MKWNPQTFAALAARHGGELLEHDAPLRSAREGAAHFGIAMAQTAPTLIVEADGDIFACILSGGRNGVDWDKLARLLDRAHVRLLDRRRVRDITGCDAGAVPPLGLGLGLPCVMDRLLLAHDFVYGGAGDPLRTLKIAPRVLAELNRVSAWYE

SEQ ID NO: 7829 - protein, 259 aa, Chromobacterium substugae
MSKSIISDMDGVIYRGKQLIPGAREFIQRLIDTRTPFLFLTNNAEQTPLDLRLKLESLGIGGLTEDNFITSAMATAMFLRSQTRKAMPTAYVVGGAGLINELYNVGFSISESHPDYVVVAKSQTFSFEQIKKAVRFIDQGAKFIGTNPDMIDPIEGGGYEPAAGTLLAAIEAATGKKPYIVGKPNSLMMMLATRKLGVHPEEAVMIGDRMDTDIVGGLEAGMSTALVLSGVSSRESMEQFPYQPDYVFDSVADIDPQAL

SEQ ID NO: 7830 - protein, 113 aa, Chromobacterium substugae
MGMGVAAFFRMLARRGGAAPRERAALGFKLTLTCAAAELTSLRRQVMRELRSRGLCACRIVSMPACANDRACLQIVLSGSALGPQACNELALSISKLPEIDRIHWGRAALRPH

SEQ ID NO: 7831 - protein, 366 aa, Chromobacterium substugae
MGRLFWKFFLFLWLAQLLTMGGVATAVWLGHPDRPRPALAAGEGPPPDAGPPAHGPPRPPRHGPPPAGLSMLLLPLLAGSIASLLFAALLAWYFAKPIRTMRAAFDAAATGRLDVRAGAAMAGRNDELADLGDDFDRMAERLQKLLDAQRRLLHDVSHELRSPLARLQAAADLTRQQPERAAEFIDRIERDTARMDALVGELLTLARLDAGIADGVEETFDLAEMLADIAADAGLEAEAKACAISVDCAGHLSARGSRELLHRAIENVARNAVRHAEDGSRVEIAARADAGRLRVSVSDRGPGVFDGDLAAIFEPFFRSGSRPPAAGYGLGLAITRRVILAHGGSVMAANRVGGGLTVTIDLPSAG

SEQ ID NO: 7832 - protein, 227 aa, Chromobacterium substugae
MNVLLVDDDIELLELLRDYLAREGFAVSCAHDGPAGVAAALSGRHDIAVLDVMMPGMDGIAALSRIRAASAMPVIMLTARGDDADRIAGLELGADDYVPKPCTPRELAARIRAILKRVAGAAQLPAAPAIVAGALTVWPALRRVERGGQAVELTSTEYNLVEALARHAGMPVSKAELSQQALGRPLARFDRSIDVHISSIRHKLGPLADGSPRIQTVIRKGYQLIAG

SEQ ID NO: 7833 - protein, 163 aa, Chromobacterium substugae
MQTAKKRWTIRLAAGMAAAALAAGVMAHEPAGDEQPAECPPLPPLHGAGWLAVPGLPQAALRGIKLTEAQEDKLFELSQAQAPARRALAKQAARSHEDLRRAAETEPFDEARVRALAEVHAQAMARLFLMQAELDAKARALLTSEQRRQYAAARPAPCPPQAR

SEQ ID NO: 7834 - protein, 287 aa, Chromobacterium substugae
MENINFQSDAFYATNPSFTATNHIIEFTKPLKILKIDYFTFDRHFKDNSRVVLTNSIDWITHYWRNDMYQHAIFENNPLSFSDGHVFWNWLNREPIYSAASQFGIDNGITMIEKHIDYTDFFHFGSINDNSVNNNYIMSKMGILHQFISLFKYKMQDMISDAGKKRIYVPDFKKSLASIQEGEVNNEIVGLDFYKLINRRDVSRIYLGEEYNNAYLTKKEVELMKELTSGNSCQEASLNLGISSDAVNKHIKNIKDKLNCRTLCQLGFVMGKLSSKNIYPFLIGDRS

SEQ ID NO: 7835 - protein, 232 aa, Chromobacterium substugae
MKIWLDTIDFDIIRNAQALGVLAGVTTNPAILAAADLPAQTVIETLLDIQDGQVAAQVTRDDLPGMLAQARALARISPRMVIKIPAIRHGFQAIATLEKEGIATLATTIFETRQILMAGMVGASYAAPYVNRIEQSTGNAFAILSESQAILERYRYKTIIMAAAIKSVEQCVRCAQLGIGAATLPSDIYRGLFASNHDIDDSLAKFDAAWAASKFTSGSSLFHVPAAKEARL

SEQ ID NO: 7836 - protein, 407 aa, Chromobacterium substugae
MNRPDPALRKTIFLVTCTFFLWGMSYGLLDVLNKHFQESMHIGKAQSGLLQLSYFSAYFVIALPAAAINKRYGYKKGLIAGLLLFSAGALLFIPSLREGSFAGFICALFILACGLGVLEATANPYMTLLGDPRGSEKRLNLAQSFCGLGTIVGPLIGGALFFRIGGSDAQAQHGAVMQVYVWISAFVVLLAAVIARTDMPAAEQASERASDPGASLLGNGRFIGGVAAQFFYVAAQVGIGAFFINYAMENQASLSAKDAAWLLSAAMLLFMAGRFAGTYAIARLPSQRLLTGYALASIVLSLVVVFAGGRLAVFALMGLFFFMSIMYPTIFSLAIKDVGAKTKQAGSILTMAVSGGALYPYLMGYIADRQPIAHAYLLPLASFVAIFAYGLYLENKPAPLPAPAAAR

SEQ ID NO: 7837 - protein, 80 aa, Chromobacterium substugae
MELKNLVKKIEDDDFAVDSIQGDSVIITRPVILGEKDSEWEGSPIFNREYLIDLIAISLAYQVLDHSDLNTALSKANAFT

SEQ ID NO: 7838 - protein, 468 aa, Chromobacterium substugae
MFDTECIATAGRIAPAQHYLKAFWQAAGGDAALLAHVAMTGDGALPSAFAVTDFAAAAISAAGLAMAELLALAGGAMPQVVVDKRLASFWFTASLRPQGWALPPIWDAVAGDYRAADGWIRLHTNAPHHRDAALAVLGAAADREAVARAVAGWRADELEAAVVERHGCAAAMRTLAEWAEHPQGRAVADEPLLRWRAGIRAAAPAWTPTRERPLRGVRVLDLTRVLAGPVATRFLAGFGAEVLRIDPHGWEEPGTVPEVTLGKRCARLDLKNPAGRARLERLLIGADVLVHGYRPDALERLGLGAARRRELNPGLVDVSLDAYGWTGPWRGRRGFDSLIQMSSGIADAGMRASGAERPLPLPNQALDHATGYLLAAAAIRGLSGRLASGEGCSAQASLARTARLLTAHANPGDAGPLSPERPEDLAGAVESTSWGAARRILPPLAIAGAPMHWAHPAGALGLAAAEWQ

SEQ ID NO: 7839 - protein, 395 aa, Chromobacterium substugae
MARYLSSAAAAARLGVSRQTLYAYVSRGLLHADNSGGQRESRYLETEVEQLAAQRTRGRKPKEVAKATLSWGLPVLESAITLIEDGQLYYRGENALELAASQSLEEVAAHLWQCDAAAAFGVDAPPWPDTLPALMAHYRGRRAEETLLPLFTAASDDAPTALWQKSAPRQAEGCGAILRLMTACLLGTRPDAAPIHLQCARAWGVDAEGAELIRMALVLCADHELNASSFTARCIASTGASLRAAVVGGLAALTGGRHGATTARGEALLDEIGDDDSGQKMRERLARGEDLPGFGHHLYPNGDVRAIALLARILPHRPRLKTMVEQGLALTGQPPSVDFALVAVRRHLGLPPGSAFGLFALGRAAGWIAHGLEQRDGENLIRPRAAYIGKPPGIA

SEQ ID NO: 7840 - protein, 573 aa, Chromobacterium substugae
MRLSHIFIIATVSLFVLISLPLAWIISSEWAVFHATDDGLDAIQVAHLAMVTVEKIALERGPTNSLLGSPPDDGRRKRLQHARQASDHALLALRRELSSSASDDHRRAMGSVRQGEAILADARVRVDRVAGLPMRASTQIMDAVRRMYDAIPPVLQAVTALSFRAESIYPQLANPLAGARQATELREYAGRLGSQLTAALTENRPLTEEEIQAVDILRGRIEQLHSTLRLRINVPEASAATLQAAQAMEDHYFRAGLPMVEAILLASRQGRVYQVGPAGFAAGYVPTMATIVSLRDTMIAEAVASAQARHRRALVHLALAAALGLLALISQAGLFAYMRWQVAKPLLQASTLLTAIANGKLDADIPAGRRKDEIGEVLAAIEALRRNSVEKSRLEKEKQRLIEELTEVSSVDFLTGIANRRAFTQAAQAEIARAGRNAAPAALILFDIDYFKQVNDSHGHDAGDAVLKHVAAIAEQTCREGDLLGRYGGEEFVVLTSHSGGAGGVSLAERLRANLQASPLALPHGQALTVTASFGVAALNEERHSLETLLAAADHALYAAKRRGRNQVVVAEP

SEQ ID NO: 7841 - protein, 331 aa, Chromobacterium substugae
MSVSDLKNGLPLAEHWLPLAGVRLAAAENEVERSAFGYVLKVQTTMKAILLNEPENGEKLVRAKQLLSQSRYTWGDLFEMEELCVELARDDMLAMIRPADIDLSLDMSEGDGVASAQEAAKQPAGAPAVSRAALRAAVLLGQQRFFRALRRERALDRLRFRLGRFTLALLLLGACYYWLSVGRTDSSLAVAAIFGILGAYASILQRIQDVGNKTSGNGQSGASVAMLMDGSWSLYLALASGVLFGILGFWLFAAGLGAAFLSSGLAPQFGPHEPSSDVLPYLLRGVDYGKMAVWAFFFGFAERFIPDLLTQLAKSGSANDDAGSGSAKAGR

SEQ ID NO: 7842 - protein, 749 aa, Chromobacterium substugae
MHKIPLAALCAAMAAALLALPAQAAPKQKLQKTPHLAQARPQQAAAPRLWRQRPPTDAQARYRLPDNRTVIGKPQRKLARHAATPQCQDMNALASHSGADLANYLATLPDYTCGYGLFSLDKKLAATIYSAGNLNAVAGRFAQEAAGYNASSMALVNLTLYLRAGYYLASTGVLPALDANLQTVLRPGIKQLADGAALFAANAQAPTTANEVMTLITNMADEAYYLPSIRAIVQRYTNGAANPAAAQALRETTAAQGFTGALTVFFYAHGRANAAPLLQNDGSYSAALTQFVQADKASLIGTESAYQLGDATREGLRFMQYPALKPAIKPQAKAILAGSSMTGADNELWLAAAEAVKYYDNANCSEYGTCNFETRLADAVLANRYTCSPTIHIRAQEMTTEQMQSSCALLQKEESYFHQMLQTHNQPVANDNNTSLEVVVFDDYDNYSKYAGVIYGIGTDNGGMYLEGNPADPGNQARFIAHEASWLRPTFKVWNLEHEYIHYLDGRFDMYGDFAAATRQPTVWWIEGLAEYLSLRNDNQTAIDIAKTGTYKLSQIYGNTYDMADYVPRAYRWGYMATRFMFERHRADIDAMLPLWRKGDYDGYMGQMRQIGNRYDAEFANWTQNASTAGQPPLPPASGLPACDEGYPNRLGKNCSISGQASSSAAYLAILVPAGVRNLKLWTSGGSGDVDLYVAKDRYPTTGSYDFSSASAGNEESVAIAAPQGGHWYYLTLQAKQPFANVTVSASYE

SEQ ID NO: 7843 - protein, 275 aa, Chromobacterium substugae
MAHMLMQLPQPSIISDLPAARAMAALFDHLLDVVFSIKDTEGRYLAMSEGCVVRCALRHRGQAEGRTAHELFPSAMANRYRLQDLAVFAERRPLRNRLDLTVYADGAPGWCLTSKQPLYHPDGQLLGLVCISRDLAELTREKLLDERFAACVDHIQTHYHRPLRLEELCGLSGLSIGQLDRRMKRVFQVCAGEFIRRTRMEAACHAIQHSRQPLADIAANCGFSDQSALTRLCRQMLGLSPRQLRLRMPPGHATALVFAPSKTTRHIPRHKNIPL

SEQ ID NO: 7844 - protein, 498 aa, Chromobacterium substugae
MPRRRALFGASPHPMPNAPWGTTMSIIDNAILPGISESDACFRLLASCVDDYAIFLLDTEGRVRSWNAGAERMEGYRAEEIIGEHFSLFYPPGTDAEARAMSELAIARQDGRYAGEGWRMRKDGSRFLADILLKPLHDQQGVLRGYAKITRDIGPRRRLEERFHQVVQEAPNAMIMVNAAGTITLFNRLAESLFGYESHELHGMRMENLVPERFRSQHGQLRQNYLQRPEARPMGVGRDLFGLRKDGVEFPIEIGLNPIETEDGPMVLAGIVDITSRKQVQRQLEMALQEKTTLLNEVHHRVKNNLQVIISLLNMQTHYVEEESTRHVLQDSQARVRSMSLIHQLLYERRDFSKVDLGEYLQRINQLLLSSYGLLTSQLQVEQDAPEGLVYIELQRATPCGLLINELLTNALKHAYPAGKGSIDIRLSLLDDKHALLVVGDHGIGMPTPSGPGPSKSLGLQLVPMLAEQMGAELSLHDNQPGVRFEARFPVFGTMEPA

SEQ ID NO: 7845 - protein, 812 aa, Chromobacterium substugae
MNFRILIVEDERIIAMDLQLQLQALGYAVCAVVASGPQAIDKALELRPDLVLMDIHLEGAMDGVEAAREIHQRLRIPIIFLSAYAEDATLQRAESALPYGYLVKPVSPRELHATLQMAMVRFGIQRGSDEQVERFCKAMEAAQLEVWEWHVEIDQMNVFSLNDNDMRSLSSVLCESIRSFLQHIDPRDESEVASAINRTRQGGDSFNVSFRLRADDQADVRWMEAHGKRFDDGERGGRIIGVMQDVTERRRAEERLRQAVTVFESTAEGIAILDAGRKVISANPAFSQLTGYAEDEAKAWPSIDALYQVPHSSPFLEQLRHGERQMWQGNASYLHRNGAALCIWESISIVPGPDGTIGNYVLVFSDISSVLAVQEQLDFLAKHDPLTSLCNRRMLHDRLEYELAQAARHGSMVAVLLLDLDHFKTINDSLGHGVGDQVLALVARRLQSCMRASDTVARLGGDEFCIVFGGIGTLGDVDQVAQKALARLAEPIELEHMTCYVTGSIGIALSPADGASVDELLRNADQAMYGAKHAGRNRCCFYAPAMQKAAEVRLRISSGLHEALERKQLLLAYQPIVELGTGRVHKAEALLRWRHPQQGNIAPAAFIPIAEECGMIGELSEWVLDEALRAARIWRETLRPDFRISINVSALHFREKQNHQRWLRKLADSGVPGDALVLEITEGVLLGADYAVQEALERYHAAGIRIALDDFGTGYSALSYLKRYRLDYLKIDQSFVRQIAEDARDLALCEAIIMMARKLGLEVIAEGVETEAQAAILRANRCQYAQGFLYSQALPADEFSAWLQRSDGIAVP

SEQ ID NO: 7846 - protein, 67 aa, Chromobacterium substugae
MATGTVKWFNDAKGFGFITPDEGGDDLFAHFSAINTGGFKSLKEGQRVSFDVISGPKGKQASNILPQ

SEQ ID NO: 7847 - protein, 145 aa, Chromobacterium substugae
MKDDRLQISTDKHRLDVGLIHAFLRDHAPWAKGIARATVEQAIAGSLCYGAYLGERQVGFARVVTDLATFGYLCDVFVVPECRGRGYARQLMQRMADEPALRRLRRMVLVTSNAHAVYLPFGFTALEHPERYMELHRPDIYLKGA

SEQ ID NO: 7848 - protein, 307 aa, Chromobacterium substugae
MKTAHVLLAVLVAAIWGLSFIVVKIGLTQCPPLLLAALRFMVVFVAGVWLFPRPTLPRRLYLRAGLCLGVIQFAGLFSAIKLGMPAGIVAVLAQVQVFITLLLAAALLQENRSATQKAVMALALLGVLLLGYARYHDALPLLPLLLALMGAAGFAWGNIELKRSGKVDMFGFTVWMSAVPPLPLLVLSLALEGGPAAAWSALAHFSWIGLLALLFLALIGTLFALGSWGKLLSLYPASLVAPFSLLSPVFGLLGGYLILGERYDSLSILASALIVAALALNIYSGRLAACKSWLQRAHLAIKELPHR

SEQ ID NO: 7849 - protein, 415 aa, Chromobacterium substugae
MASGDAYEACVNPAWREILRQCGLDAQPAAADGSWLLLDDGRRLLDFVAGYGAAALGHNPPALSALLAQDLMDPTPNLHPLGWSASAGELAAGLLDLAGLAGGKALFASSGAEAVEGALKLARMACGRARAIVFEGGFHGLTLAATQLAGSDFWRQGLPEDEAVLRLPWGDLAAAEAALAANDVAAVMLEPVQGSAGARAWRADALHGLAALCRRHGAWLIYDEAQSGLGRCGAWFAYQALGGPPPDMLLLAKGLTGGIVPVSAILFRDAIYQAVFARPGCAKIHGSTFGGNRLAMRCGLHMLAALRGIDAPARAAARSAYLRRAWPDGLFALEGAGLMLALRATPRAKRRFGEQAAGALWLQLLSEGVLTAPAAHDADALRLLPPLTVGEDELDYFLDAYRRALAALEEEEEMP

SEQ ID NO: 7850 - protein, 498 aa, Chromobacterium substugae
MEAWRISHYRMPRLVPFSAHLAEDGQTVVLAADASEYEINFTGVDGGRVLDSVLAMANPGSEIWFDIHEGSAPSWQLSLARQLDELSLIRDAPADHSALEARRQELESLTQRCVARLLEATAANRGLYAPAALVMLNLLDEPAPQADAFTVDGIGAPEWSDNFALQTFYLQKLYLADNMPQLIGLWRRVLNGFADACGLAGRAASRPPPVERPDSLGFYCPAHVEAYLLCLMDLLLQAPLPDARRRLPSRPAATEPDSGVNFMRRAEQYALDSLAQLGESRYVRRLNADGAGFSPLVQGLFIEQYHVTQRFVEIIAPLMTKRLRTPLKQRVYRYFQEELGHEAFERATCEALGVPPAWLDQALPLPLFQAYVDAFTVLGRYDPIGYLGSIMVTEGMPGVDNPVHHRLEELVEGRADYQRVAKRHDDLNLELNHAALSRLFFREISVLAPLAQQRALGNLGYLLELNLRAMDQVADFYGAQSRLAICSLDSYAARHGQR

SEQ ID NO: 7851 - protein, 333 aa, Chromobacterium substugae
MRAPGVHDLFHRPALRAGVEIQEQEDGVALLYRDQSCDLSVADEGRRELLALLDDLQRAPASMPELRASHPRMAASLPGLLEELDRLGLVTEARFELPADAISGLEFNSRLRNLAQRAMRKRGRSRLYGMLADGSAPRNVLIGYALEYYCLVRAAPGLIASALSHADSRQNQRSLQRFLMSELDHDQMLADSLASVDMEVTGLEHLQPLPSTFALCSALGVFARQHLLSFKSVLFLFEMPGEQFNQALVRCCERQGLARTFWEPLLRHAHINDTLGHDDITGELLEDISAIGREEQLVVEKNLVLTVETMALQDEEIVDYYSRADAAMPRLYL

SEQ ID NO: 7852 - protein, 329 aa, Chromobacterium substugae
MIHQPEARYCLNGEVISQSPLVVKTAGDEELELSAGQASAAEVAELVARLGRGCSQAEVQGALPRQSADSIRQLLASLEDYGVIRSIAPAAGKTGMEILLEIEDLSNQLLYRTLYRNEFWVNCQNASRPGDIPEKVFHGMVIENYHFLFRESYFDAPVLSYVPNTRARLAMNAFFAEEYGHDELLLQALNRIGISREDLARTVPLPQTMALCNALAYWSHNDPLFFFTTLGVLEGKDIRQDSFLDAGYRLGLDPAFLRPVKAHSDINLKGEHGSLTRQIFSQIDVVDLETARRMHAQTHLFVELYDAFYSAVWRHYSGDGPLLRRIEDY

SEQ ID NO: 7853 - protein, 96 aa, Chromobacterium substugae
MVDHVASLPGQPAAGQSGGAAVRQTEGRIATPRPAGLQVNRHQDRTRIAGFDHHHRLLHAGLHLALLCLRKRNSAWLRRFLILCLTVRLRNIKYLS

SEQ ID NO: 7854 - protein, 279 aa, Chromobacterium substugae
MNLFQRAAAPLAISRNNLGPLAELAGNWVGHGYNMIAVPDHQNHKPFRLIVNATKETLAFTPIGGPVPNRGSLQNDIDIFGLTYLQQVNDAATDEGIHIEPGIWLHVPATSDPKKPATIVRQSTIPHGDSLLAGGESSCEKRAPHIAPASTEPHRVDGKPLPFGYTDPYQNGKFPPGFDMKNPNQALVDVLQYQQQQLELKVVETINLKVSTNDAGGITNIPFIVKNANATHMDAIFWIETVQRPDGSQFMQLQYTQTVLLVFEEIVWPHVSVATLLKR

SEQ ID NO: 7855 - protein, 196 aa, Chromobacterium substugae
MNQPIPQSAPPLLPQQWSSAYVSYWSPMLQDDQLSSGYCWFDYGRNICRIDGLFNPWSEEDTGYRLWMSETGNAASGRTRKQKVAYGREAMAYGTALCDIPLDDETGPFRQLFLPRDVLAAHDARYAGRHTVLGQEADAWTYQRAGKGPSTLYFQAGTNLLLRMVTGDDRQHASVRDFPNLSTAMIPGEIFSASDA

SEQ ID NO: 7856 - protein, 374 aa, Chromobacterium substugae
MKKILVIGAGPAGLVFASQMKLAKPDWQISIAEKNDPEEVAGWGVVLPGRPGQHPANPLSYLEHPERLDPQFLEDFKLIHHNEPNLMSTGVLLCGVERRGLVQALRERCQSLGIAIHYESPLLAREQLPLDDYDLIVAANGVNHKTSHFTEALAPKLEYGGNKYIWFGTSQLFDQMNLVFRTHGKDIFIAHAYKYSSRMSTFVVECSEETFERARLGEMSDEASAEYVAGVFRAELGGHGLVAQPGLGWRNFMTLSHDKSYDGKLVLIGDALQSGHFSIGHGTTMAVVAAQLLVKALCAEASVPAALASFDARAMPLVKLFSEHANSSRDWFETVDDRMHLSNAEFMQSFDARRKALPPLPEALARNLGYALDR

SEQ ID NO: 7857 - protein, 401 aa, Chromobacterium substugae
MVEKRGDPLQDLSSYVDAVSSRAIGVSMTVRGIKAVLAAGIPRAELDQCGEPIVGMAFSVGGKFRIRELQPLEGLSPLSLNRAAFQRLLNRHANRNGVRYHFEHKCLDVDLEGKSVLIQSKDGQLQRLQGDMVIGADGAHSAVRQAMQSGMRRFEFQQTFFRHGYKTLVLPDAEALGYRKDLLYFFGMDSGGLFAGRAATIPDGSVSIAVCLPYEGTPSLATQDRQAMKAFFQRYFGSLSDAVREEMLEQFLVKPSNDLINVRSSTFHYKGNVLLLGDAAHATAPFLGQGMNMALEDAHSFVTLLDQHCHDQELAFAEFTAQRKVQADAMQDMARANYDVLSCSNPIFFLRARYTRYMHGKFPELYPPDMAQKLYFTSEPYDKLQTIQKKQNVWYKLGRVN

SEQ ID NO: 7858 - protein, 998 aa, Chromobacterium substugae
MSILDFPRFHFRGCARVNAPTANRDPHGHIDMASNTVSAGGQPVDLARPPAEFHQYLRQLGPHFDSEGKPADDGVFSLALGHNANGNNHFSWEGAVVTAVEPRAGAAEADDSLIGAKLALWGHYNEYLRTSFNRARWVDNDPTRPDAVQIYAGQFVISPPGAAAHAPSLFTADIDQAHGARWVGGGHVCERSGHFLDDDFGRVRVFQFSLPKSDPYFLFNLGDDGSATLQALQRALEDDDALGLTVQYTLFNMSTPRQPDTPVFYDMVGTVGVWRRDELASYPAGRLLQPAGAGLGPLTLQIRDDRVSLNLCAALPFTTRAPRIDEPGRLTHALGPKLALGDLLLKDRGGALVARIPQQACLDYWRNHGIVDVPLLNPPQGSLSLSSELARWDEVDWVSQTDANNLYLEAPDAARGLSFPERVTVRSYYRGERRPRPAIPFKVVGDGQAAVEVRQRDGDAEWLITGLKPGVARIELDGGVQRVNLRILPDDWQLAEVPAEQVDYAFLYRHVMSYYELVYPFMSDKVFSLADRCKCETYARLMWQMCDPQNRDKSYYMPSTRELSRPKAGLFLKYLANVERAAPSAAPDGGAPARIENRAQLVEALKTAVDLELSIMLQYVYAAYSIPNYAQGEQLAQSGAWSQEQLELACGGGDRRRDGGLRGAILEIAHEEMIHYLVVNNLLMALGEPFHPGAARVGDEARRAFGLDTEFSFEPFSEYVLARFIKLEWPAFIPSPAKSIAAFYASIRQAFEELPDLFDGAAGKRGGEHHLFLNELTNRAFPGYQLEVFDRDSALFGIRFVTEQGEGGALDSPHFEHSHFQRLRSLAGRLMAQPAPFEPALPALKNAVLAPREGCNLVTEPQARALMRLYQGGYELMFAMMAQHFAAQPAGSLRRSRLMNAAIDLMTGLLRPLSTALMNLPSGVPGRNAAPPVPAAADCKVFDDYSLGCQMLAKRCQALADEAAGLEPGWVADAPKELLAFYCRQLMDLACGKLTREA

SEQ ID NO: 7859 - protein, 419 aa, Chromobacterium substugae
MKHSSDICIVGAGISGLSCATYLLESPACRGLSLRIFDMQTEAGGRIRSKNLDGKAAIELGAGRYSPQLHPQFQSVMQSYSQRSERYPFTQLKFKNRVQQTLKSAMRELSPRLKEHGKESFLNFVSRYQGTDSAIGMIKSMGYDALFLPNISAEMAYDIVGKHPEIQSFTENDANQWFSAVDGFDGLIARMKDKVKAGGAKFSLGFRLASVERDQDGYRLALVGDDGWQLTHHARHLILAIPPSAMAGLNLDFPAAWGHSRYGSLPLFKGFLSYDEPWWRDYKLEDQVLIVDNPLRKVYFKGDKYVFFYTDSEMAAYWRACVADGEDGYLEQVRVHLAAALGIGAASIPQPSQHVHKYWAHGVEFCQDAAAADRPPALLNRDSGIIACSDAYTEHCGWMEGGLLSARAASALLLQRMAG

SEQ ID NO: 7860 - protein, 61 aa, Chromobacterium substugae
MLHHEIPWFIQSTPAGGAAADGSKSEGEWLSSCSLSCRIGNRAPLWLPFPGGRQAARHQSF

SEQ ID NO: 7861 - protein, 578 aa, Chromobacterium substugae
MARRDGLAGFPGQFRKYAFDVLIFKKLTVLKTALSRLIRFSHHLRGCQMKAWRFLSCGALALSAAAHAAYPDDLKLTTWNAMLLPQALYPNYGQLRRVELMAAAPILQGQDVLVFQELQDNAASEKLLALLRPRFPYQTPVIGRAQLGWDGTEGWNALKPEDGGVAIASRWPIVEKRQYLFQTPGCSWDGQALKGFAYAKINVGGRFYHVLGTHLQSEDSGCAHHADIAVRQGQLREMAAWVQARRLPADEPVIIAGDMNTDRHKSAEYQAMLDILQASEPRYAGMPDSFDTRGNGIALERYGARSGDAPEYIDYILLLKGHRQPGMWHNLALDAPSPQWTAQSAVAKQTYAYADYSDHYPVQAFAWADASTPTRSLTAPAGGYRQVSLQNLASGRYVQSAGSNDGWLKAGAAEAGPQAQFNLSNNFSMRDNGCVRSGEYVRLERADQPGWFWTWWGGAGGNQYAYYTAQGPLSRSAELRLVNQSRADGCLQDGDVVSFKDWARAADYYLTAWSGGSHADQLYLWQPSVGDGERFRVRIGATRQYLDWRAQLVYAGQGLAARPEVLHFSNGKPVTRNR

SEQ ID NO: 7862 - protein, 41 aa, Chromobacterium substugae
MRIRPAARHTLSHPPCRFGRLRVGKEQTMHAAMVLQGGMAL

SEQ ID NO: 7863 - protein, 38 aa, Chromobacterium substugae
MWLGASRAGDSAREELPIFLPAFGVPAAVAAALSRKLR

SEQ ID NO: 7864 - protein, 192 aa, Chromobacterium substugae
MNKLTRLTLAAVAVAGFSSAALAAPETYVIDGTHTFPRFSYSHLGFSTQLSRFDKTSGKIVLDKEAKTGSVDVTIDMKSVDTGYPVFNGHIQGADFFDTAKFPTATFKSTKVLFDGDKPSAVEGNLTIKGVTKPVTLALSSFTNKEHPMLKKDAIGANASVKIKRTEFNAGKYAPYVGDDVTIDIAVEAIHE

SEQ ID NO: 7865 - protein, 187 aa, Chromobacterium substugae
MQINRTALLLAAALSAPLAAHAVEFTSIQQDKSNIAFGYKQMGVGMQGHFKKFSAQLNFDPAKPAAAKAAFNVDIASIDTGSAEANDQVADKDWFNTKQFPTARFVSSAIKPLGGNRFQVDGKLTIKGKTQAVSTTAVMTPQGNAAAFDGAFAIKRADFAIGEGDWKDFGTVANEIQIKFHLLARAK

SEQ ID NO: 7866 - protein, 180 aa, Chromobacterium substugae
MSQARYTSPAIFLHWLMAIGLVCLFSVGFYMHGLPFSPFKLKIYSWHKWSGVTLFLLVWLRLAWRFAHRPPALPAAMGGAVRAMAHAGHAMLYLLMIAIPLSGWLMSSAKGVQTVYFGVLPLPDLIAPDKALGDSLAGLHTVLNYLLAAVVAGHVAAALKHHLIDRDDVLTRMLPWRVKP

SEQ ID NO: 7867 - protein, 66 aa, Chromobacterium substugae
MPQDASKPRNAPLCLGCQHYFITYRPGFPYGCRAMGFASKRAPCVDVQEASGQPCIRFQPKAGKPG

SEQ ID NO: 7868 - protein, 251 aa, Chromobacterium substugae
MTNGLYEEQALAEVYDLLNGWGEDNDYYLGLTPRGGRVLDLGCGTGLLAAAMARHAEVTALDPAAAMLAVARTRPGARKVRWLQADARRFQLAERFEFICCAGHAVQVFLSVDDRRALWRNVKRHLAPDGVFAFETRNPHALAWLQWEGQAPRRAVHLRHGAVELSHRLLSERDGLVAYRSHYRFLDQGRERSVDAELRFCDAPTLTAELEAAGLRVIGVAGDWQGGEWRADSREIIMRLGHAQPGLPALG

SEQ ID NO: 7869 - protein, 102 aa, Chromobacterium substugae
MNEETLKKIQSNPKYLELVHKKTSLGWTLAIVMLAIYYGYILILAFDPALLGRPLYAGATMTVGIPVGVCIILSAFVLTGVYVRRANREFDPLTRQIVEESR

SEQ ID NO: 7870 - protein, 559 aa, Chromobacterium substugae
MQPRKLTLAAGAAMLAPALSWAAGAIEGDVKQQATNWHAIIMFFVFVAFTLGVTYWAARRTKSASDFYAAGGGITGFQNGLAIAGDYMSAASFLGISALVFDKGYDGLIYSMGFLVGWPIILFLVAERLRNLGKYTFADVASYRLRQGPVRSFAALSTLVVVAMYLIAQMVGAGKLIQLLFGMSYGSAVLLVGVLMVCYVLFGGMLATTWVQIIKAVLLLAGATFMALMVLATVGFNPEVLFEKAVAAHGKGIAIMSPGKADPIDSISLGLALMFGTAGLPHILMRFFTVADAKEARKSVFYATGFIGYFYILTFIIGFGAIMLVLNQPGMMETVMKDGKEVHQLVGGSNMAAIHLADAVGGNIFLGFISAVAFATILAVVSGLALSGASAVSHDLYASVFKHGKANEADEIRVSKITTVVLGVVAIVLGLVFEKQNIAFMVGLAFSIAASANFPVLFLSMFWKGLTTRGAVIGGLVGLVTAIALIVLGPAVWVEVLKHEHAVFPYKNPAIFSMTLAFVVTWLVSLLDSSQQAAEEKAKFDAQYVRAMTGIGASGASKH

SEQ ID NO: 7871 - protein, 654 aa, Chromobacterium substugae
MSTLDSILKETRSFAPSEDFRRKAQISGMEAYNALCEQADDHYLSFWGDLARELITWKKPFSRVLDDSAAPFFKWFDDGVLNVSYNCLDRHLATDANKIAIIFEADDGEVTRVTYAELHRRVCQFANGLKSLGVKKGDRVVVYMPMGIEAVVTMQACARIGAIHSVVFGGFSAGAVRDRIQDAGASVVVTANEGLRGGKSVALKATVDEALKLEGAESVKHVVVYQRTNGGADWTDGRDVWWHKLTEGQSEACEPEWMNAEDPLFILYTSGSTGKPKGIQHSSAGYLLGAINSFRWVFDYKPNDVFWCTADVGWITGHSYVCYGPLGNGATQVIFEGVPTYPDAGRFWRMIEKHKVSIFYTAPTAIRSLIKLGADLPKQFDLSSLRVLGTVGEPINPEAWIWYYETVGGSRCPIVDTWWQTETGSAMIAPLPGAVPTKPGSCTLPLPGVIADIVDESGAQVEPGRGGFLVIKRPFPSLVRTIWNDPARFKKTYFPDEFNGQYYLAGDSANRDENGYFWIMGRIDDVLNVSGHRLGTMEIESALVSNPLVAEAAVVGKPHDVKGEAVVAFVVLKGARPEGDAAKAVAAELKNWVAHEIGKIAQPDDIRFGENLPKTRSGKIMRRLLRSIAKGEEITQDVSTLENPQILGQLQQAL

SEQ ID NO: 7872 - protein, 310 aa, Chromobacterium substugae
MNACLAAACLLAAAHARADEGGMSYWQPGQIGTFAAVQNDPGLSWSFSAYHAEADTSKTRKSLRGRTTSTLLSTPSDLLFVSPTYTFATPVAGAQAAVSLTGLYGRTEVYTEADTTTARGKPRSQSSDDARDGFGDLYPMATLKWNRGNHNYLAYAALGVPVGTYNVDRDANLGSNHWSYDAGGGYTYLNTQTGTEFSAVLGLTLNQTNPDTQYRNGNDAHLDVSLSQFLNEDFHIGLVGYAYHQLSNDTAPGIGRKDLKSRVAGLGPQLGYFFPVGKKKWYANLKAYDEFDAKNRTAGWNAWLTLFVPI

SEQ ID NO: 7873 - protein, 186 aa, Chromobacterium substugae
MMAMRYRIALPADYPMEIIERRIAERGHLTDGLPGLGLKAYLYCRAGEDGAAANAYAPFYLWRTTEGMRDFLSGPGFAALCASFGRPVVQSAVAWFGGWQDNAAAARHAVIERLALAEGEDLAARRAAEDGWGRTQLLDGGALAAASAFDPAAWTLTRIALLREAPAAQAPGREHYRVGRVSPGAA

SEQ ID NO: 7874 - protein, 134 aa, Chromobacterium substugae
MPYARISLRKGKPPQYLRALADGIHQAMVECIAVPPKDRFQLIHQHEAEETIIDPDYGGGPRSDDFVLVTLHLGRPRTKEAKAALYASMAERLSVSPGLAPADLMVVLIDGEMDNWSFSHGRQASTLSAEELRP

SEQ ID NO: 7875 - protein, 104 aa, Chromobacterium substugae
MFTHADAMPRLAPKLAELTSQVLFDDVWRRPSLSPRERSLATIAALIGQARPHALDFHLRRGLENGLSGESMGELLTHLAFYAGWPSATAALEQLDAVLTSQTK

SEQ ID NO: 7876 - protein, 298 aa, Chromobacterium substugae
MRRTLLDLDVLASLASGVELGSFARAADRLGRSTSAVSAQMKKLEEQAGVAILRKSGRGLELTPAGEVLLSYARRLLELNDEAVEATRGASLAGCVRLGLAEDFGEGVLPLALGRFARACPEVRVEMRVARSQELQQSVMAGELDLALAWDSGPRAPHSAAIGRYPVHWIGSASGPLPPDPLPLALFDPPCVIRAQACGALDRAGRPWRMAASGSSLAGLWSAVRAGLGISARTAVQLPPGLRILDPAQHRLPPLPAIDLLLCRAEARPAAPAQRLHDILLAQLTVPGVEAEALNIDN

SEQ ID NO: 7877 - protein, 257 aa, Chromobacterium substugae
MPVISLVERIDALLPQTQCGQCGHAGCRPYAEALATGQDPLNRCPPGGEDGIQALAALLGKPAIPFDPAGPQPKPRALAVIREDSCIGCTLCIQACPVDAIVGAAKQMHTVIADECTGCELCLAPCPVDCIDMIPVADPADGERAQVMARAGQARLRYERRQARQARDQADKARRLAERAAVAAPAGPSPAPAAAQPAGAAADKNELIRRAMERAQQQAASAPPATAANDKMALIRAAMERAAAMRAAQDPADKDKK

SEQ ID NO: 7878 - protein, 210 aa, Chromobacterium substugae
MNAAKRKEIFQRLRDANPHPATELEYSSPFELLISVLLSAQATDVGVNKATRRLYPVANTPAAILALGEESLADFIKTIGLYKTKAKNVIATCRLLLEKHGGEVPQTREALEALPGVGRKTANVVLNTAFGHPTIAVDTHIFRVANRTRLAPGKDVREVEDKLEKFVPAEFKVDAHHWLILHGRYVCKARKPECERCIIADLCEYPAKPL

SEQ ID NO: 7879 - protein, 175 aa, Chromobacterium substugae
MSDSNRATWNFLADTYWYVTQPDLPALRFDPGDNALSWQSDQTVWHISGYRNGYFWGVCSALLTDPGAEGGTPQLRSLVGTVTADGALQISFVRDGALRDSVITGFGRLLQWDGEWACQMQMTAAASGGQTLHWANMRQTRPGDPSWDQLPGTDYSVPDMLEGASYPQFSTDQAT

SEQ ID NO: 7880 - protein, 170 aa, Chromobacterium substugae
MTAIALPPSLLPALGIAALVIWRLYSRIRRMVGRQRLSPIRPWLTVIVFPLLLAGLAQMSHAHPDKLLMLLAGAVIGALLGRYGIRLTQFETTEQGRFYTPSLHLGIALSLLFIGRIGYRLVSLYLSGGSLSAPPAGFIGHPLTLLIFAILAGYYVSYAIGLLRWARSTA

SEQ ID NO: 7881 - protein, 43 aa, Chromobacterium substugae
MTRIPVHGRMTKKGETVIGFAFFVSLREAVQAVERAQRSRPMA

SEQ ID NO: 7882 - protein, 465 aa, Chromobacterium substugae
MSLMRKKSVQGMLETAQTSRGLRKELSAFDLTMLGIGAIIGTGIFVLTGTGATIAGPGLVLSFVISAFACGFAAMCYAEFASMLPISGSTYTYAYATLGELIAWIIGWDLLLEYLLASSAVSVGWSGYFQSLLSGFGVTLPQALTAAAGSVPGKETLFNLPAFCIAMIITGLLAFGIKESKRVNNIVVLIKVAVVLLFIAIGVWHVKPVNWQPALPFGFSGVFHGAAIVFFSFIGFDAVTCAAEEVKNPAKDIPRGVIWSLAVCSILYVVVAAIMTGIVPYMQFAGVDHPVSLALQVAKLDWFAGFVDLGAILGMMTVILVMTYGQTRILFAMSRDGLLPKIFSDVNPKYGTPYKATWLIGTIIALLAGFVPLHTLAELVNIGTLAAFSLIALSVIVLRKREPNLPRKFVCPAVPTIPALAILCCGFLMTQLSLLTWTCFAAWLVIGLVVYFGYSRRNSLLHNPA

SEQ ID NO: 7883 - protein, 149 aa, Chromobacterium substugae
MKGVWMGGLAALSLLSGWSRAEDGAAAASAPRVQLECLPAADAAGGWQDWLATRLSLRGLEIGAPPLWRLCFTEEVERQWVERPVDWRYDGYWGQPPYRLESWPALALTVKNADGAVLWQGRERLGEGENRRQQLEQAARRLLERMPMP

SEQ ID NO: 7884 - protein, 422 aa, Chromobacterium substugae
MRTKTISWLCILLPLGHGLPAWAEDAPAAAPAPQISAEQLSGAVKKALDDMGFQFDGYLRSGFYGSSADNLPKGQYQLGGDLQHFRLGNEGDTYIEFGVGKKWTLGNGVSWGAYVMPTIYNGKTGASQVYGYISGLEFAPNLTLWAGQRYHRIQDIHILDNWLMQDGDNYGAGVDGIAVGKAKLNLSVSSSGSYANNNATPNNARRANFQLTGIEINPGGKLTLTGAAIGGDFAIGKPGAALGLLHNQKDFLAQGVNNSLFLQASSGHASLSGEFYNLDSNGAAQAGARQSRIAEVVDWQRGRFGGQAVLGWQSVAPDNAAKYRDATLGGRLSYGVAANVKLLTEIGLTSRDTDNQPLQRLNKATLALAFAPNTDFWTRPELRVYASHYNWNNAAAQANLTSFAVGGRTQATTFGVQIEAWW

SEQ ID NO: 7885 - protein, 549 aa, Chromobacterium substugae
MPKDMKQAVVYQIYPKSFSSHRNQATGDLLGVADRLDYLAWLGVDYLWLTPFYCSPQHDNGYDVSDYYSIDPAYGSMEDFELLLAEASRRGIGVMLDIVVNHTSTEHAWFQEARKGRDNPYRDFYIWRDAPNNWQSKFGGNAWEKDEASGQYYLHLFDKTQADLNWDNLALRQAVFEMMRFWRDKGVAGFRLDVINLISKDPAFSEDDSDGRHFYTDGPRVHEYLQQMHREVFAGHELMTVGEMSSTSLEHCIAYSRPDRRELSMTFNFHHLKVDYPDGEKWRPGEVDFIALKRILSDWQSGMHAGGGWNALFWCNHDQPRALSRFGDDRRYRTESAKMLATALHGLQGTPYIYQGEEIAMADPGFADIGQLRDVESLNAYRQLLAEGYADAEAMAVIRQRSRDNARTPMQWDDGPHAGFSAAEPWLGVAADAAEINVAAAIGDKDSTLHHYRRLIQLRKQYRVFADGDYRCLTPNHPSLWAYTRRCADEMLLVINHFGADNLHYQPPPDAVPEGWVLELLLSNYPPQATGQLRPWHSLLYRATPPAAP

SEQ ID NO: 7886 - protein, 484 aa, Chromobacterium substugae
MSHDYQAIAAQILQNIGGAGNIRQAAHCLTRLRIALHDESKVQGEALRQVALVKGHFSNAGVFQIVIGAGDVDRVYAEMVKQGGVARATIADVKASGDEKQNRLQQLVKVFSDVFMPILPAIVIAGLLMGANNLLGAKGMFIADQSLLDAYPGLSGLWGLINMMANTSFVFLPALVGWSAAKRFGGSEILGIVLGLLLVHPDLLNAWNYGKAAAGLDGASVPYFDLFGLRIEKVGYQGQILPILAAAWVMCRVELWLRPRVPNAVQLLVVPIVTIAVSGFLALAVIGPLARHLGIAVTDALVYVFNLAPWLGAALFGALYAPLVLTGMHHMFIAVDLQLISSQGGTFIWPMIALSNIAQGSAALAMFWLARNANDKNMASTSAVSAFFGITEPAMFGVNLRHKLPFYAALAGSACAAVLISLGHVKASAIGVGGLPAFISIIPQYIPLFLAGTLVALIVPFGLTWLLARRQLAAAAQEEAAQHA

SEQ ID NO: 7887 - protein, 78 aa, Chromobacterium substugae
MTHRLSPVPCRGGGFAPGTMPEIRLFVAIVRMTIAVKLTRTYKLVNTRTYEFAKSQNDCRHFATAKRRRPGRMTPRRA

SEQ ID NO: 7888 - protein, 234 aa, Chromobacterium substugae
MNKYHQIYSEIIADIDNQRFAQGDKIPSESELMRSYEASRGTVRKAVDLLQERGYVQKIHGKGVFVLKPGNIEFQLSGIVSFQEMNERMGRKVVSRVAELARAPADAALVQATGLAEGEEIVRIKRVRNIDGENVILDVNHFVAELIPGLTEDIAAGSIYRYIEQDLGLTISYAQRTIEAQPCNDDDRRYLDLNGMDHVIVVKNLTHLYDGRLFEYTESRHRLDKFYFTDIARR

SEQ ID NO: 7889 - protein, 298 aa, Chromobacterium substugae
MSELKQLETFVAVVGLGSLSAAARQLGVVPAMVGRRLDALEERLGVRLLARSTRRVAPTQEGEAFYEDCQRILADLTEAEAAAASGSGKARGHLRLSAPAGFGRRHVAPHVADFQRLHPEVKVTLDLSDRLVDLQRDRIDCAIRISDLADSGLVAIRLAENRRVVVAAPAYLAEHGVPRAPADLQHHQCLSLGESQSRGWSFAVDGRPVNLKVAGALECNDGAVLHDWALQGLGLAWRSLWEVKEDLSEGRLLTVLDDFASPDYPVCAVVQQRRLLPARVRRFVDHLRAAYAAPGYWD

SEQ ID NO: 7890 - protein, 531 aa, Chromobacterium substugae
MAVNLPQGVEIFADITPAYAEILTPEALAFVAKLHRRFEPTRRERIAARAARQAELDAGKLPDFLPETAAVRASNWKIAPLPQDLLDRRVEITGPVERKMMINALNSGAKSFMADFEDSNCPSWDNQIAGQINVRDAYRKTISYASPEGKQYKLNDTIATLLLRPRGWHLMEKHVKVDGEIVSGSLFDFGLSFFHNIRHLREHGSATYYYLPKMESHLEARLWNEVFVFAQNELNIPQGTIKATVLIETILAAFEMDEILYELREHSAGLNAGRWDYIFSCIKKFRQNRDFCLANRAQITMTVPFMRAYALLLLKTCHQRHAPAIGGMAALIPIKNDAAANEKALAGVKADKDRDATDGYDGGWVAHPGLVPIADAAFSAVLGDAPNQIAKQRPDVAVTAADLLNFQPETPITEAGLAMNINVGIQYLGAWISGNGCVPIHNLMEDAATAEISRSQIWQWLRSPKGVLDDGRKVTLELFRELQAREVAKLKDEYGSRWSKQYEDAARMFDLLTTSDDFVEFLTLPGYEYID

SEQ ID NO: 7891 - protein, 229 aa, Chromobacterium substugae
MKKSRLKPMLMCCLLAAALPAAAEGIQLNLSASAQRDIANDQISATLYVQQSNSQAAVLADRLNKATANGLAIGRGYKDVQLSSGSYSTWPSYDKNGKITGWQGRSEIQLKSKDFAQAAELIAKLQQTMLLEGVQFGVSDEARRNAEQGMIPEAIANLKNQAEVAARALGKNAVNIQQLDIGQQNHGFRPPVMMMKAAVAGAESNVSQPDLQPGQTQLQLQVSGKVELK

SEQ ID NO: 7892 - protein, 203 aa, Chromobacterium substugae
MKLIASLTSPYARKVRIVLAEKKIDCPLEEETPWSADSRVPEYNPLGKVPVLELDDGSTLYDSRVIVEYLDNSSPVSRLLPQDNRQLIGTRRWEALADGIIDAMVAIVLERRRPPEKQMEEVVERQRGKIARALATLSQDLGEKPWCTSHGYSLADIAVGCCLGYLDFRAPELDWRASHPNLDALLQRLYARQSFIDTEPPAA

SEQ ID NO: 7893 - protein, 228 aa, Chromobacterium substugae
MSLWFPVIRRFIVVRMLLARPRLVWSALFGALVILALPHVAAMHDVTRYIVGWNAGAWLYLALVAWMMFGPRQQQIRHWARLEDEGQWLVMLLVVLAAIASLAAIVLELAVVKDMKGWLRGAHILLAVLTLLSSWAFTHVMFALHYARTFYAEHARGGSGGLEFPGTRLPDYADFLYFAFIIGTSGQTADVSFTDSRQRRAGTAHCVLSFFFNATVLALMINIAAGLI

SEQ ID NO: 7894 - protein, 257 aa, Chromobacterium substugae
MANTPTAPRPQALQDRDAQLEALCRQMACRDFCLLPAALSRDLLLLQDPRALADWEAFQDSWNHLRQDKFMADGGSYRQRLHATLSAEPSARRARAEAHQPHYQSRQYNPLNGGVARHFEPIRNEILLGATMQSVLELGCSIFGKLSPYTRWHIEAHQFRIEARNRERGKPTPEGIHRDGVHFLLMMMVRRRNLVNGATELYDLEHQPLAEFTLSDPLDIALVNDERVLHGVTPVAQLDPSREGSRDVLLLSFRRHS

SEQ ID NO: 7895 - protein, 248 aa, Chromobacterium substugae
MARQIAMVLAAACCWCAAAVAAADIHAYTEDVPPLNYLENNNVQGYSTEVLRLVAKEAGLKLSIDVLPWLRAYAKVESTPDTLLYTIVRTPEREQHFQWVGPIGPRRIYLYRLAARDDIRIASPNDLLRYHNGALAGSAAASQLAALGLQAGSALDIGHSDATNLKKLQLGRLDLVAMLDWAMAWQLRLQGKTEKAVAPVLLLDGKLEYWFALNRATPPERVKQLQDALNRIRADGRLQAIRRRYRSD

SEQ ID NO: 7896 - protein, 542 aa, Chromobacterium substugae
MGKRVFGSIDSFVESSETDLKLGRLVANFGFLRALLRYAEFDEFHLFCPALDNLKLVQRRLEACVDDALLSRVVLSHHLNVPDALSRTDFSAFHLGDWYWYLPKMARLRARHASHPLPLTAPIHSLNGGDMFDKVAALTAAPLRPGDALFCTSTLGRGVVERHLDHALSSGAGNRPACRLLPLGVEEEYFVRRDRAACRQQLGLEAGAFHLLYVGRLSPATKADLVPLLYLLARLRLEAPRVDWRLLLAGGAAASDLDNLRQAAAELGLDGAVTVLGPVSDADKHALLAAADVFVSPVDNYQETFGISIIEAMAAGLPVVASDFDGYRDLVREGETGFRIPTLATQPPRVAGDMLEVLEDNLSSLLHAQGVALDMEAFGRRLLELAADPALRRRMGERARAVALAEYSWRAVIQGYDAAWRELKREADAAGLQPWTGTPRPDMRDIFRDYPTRHLEGGLALELTALAHAVLRGELPMPATYAEVALLSSGELLSHTLRTLLAGPQTVAAVRSQVQASLAVAADHVDYQLGWLLKYGLLRLLA

SEQ ID NO: 7897 - protein, 93 aa, Chromobacterium substugae
MHFDEIHSSHFVTLSRTPLPHTLIEQALVNIGGGGNDGMNFRKQALAAAGWSYDGLVPFAKHPDKAAQAFNRLRTALASYTSAEALMAALEAE

SEQ ID NO: 7898 - protein, 71 aa, Chromobacterium substugae
MFPEYRDLISRLKTEDPHFGRLFDLHNQLDQQIKNMEARIIQASALEIENLKKEKLKLKDELYVLLKAHTS

SEQ ID NO: 7899 - protein, 299 aa, Chromobacterium substugae
MQPLTRLLLKIAGGLLTLVILGNVLEKSVLSWTVINPGYTGIKINRLVDRGISKENVVTGFVFFNPIQSVVVVYPTFVQREVWTRSATEGSAANEELSFNTKDSVPVSIDVAVSYLLRADKVPEFYTRFRADDISNWTHGYLRDTARNIVVALGSEYSFDDVNGVKKEEFLGRVAAELNRRTMPIGVSIQQFGLVGALRPPPELANAVNAKTKAIQDSIRTENEVRAATAEARKKVAIAEGEAAANRALASSLDDRLLAWERLKLQRAYIDKWNGQMPSVVGGGEGGGMLLNLPAPTQK

SEQ ID NO: 7900 - protein, 345 aa, Chromobacterium substugae
MPSQPPQPKNHDSSMDSSAAALRQRLDHALQLLGMRGKGLLLLGGLLAAGWLASGIYRVEPDEQGVVQRFGRWSDTTSAGLHYHLPWPVETIQLPKVTQIKQLKLANLYEGSPPDAADPREKQMLTGDENIVEADCAVFWRIKDAGRFLFSAKEPEQALRITAEGALREVISHTPIQASMSNRRQQVAEETRGLIQQRLDAQQAGILITQVQLQRVDPPAAVIDAFNDVQRARADQERARNEAQAYSNDILPKARGEAERIRQEAEAYRSQVVNLAQGEAKRFDSVYQTYAQAKDVTAWRLYLESMDDMLKKASKVVIDGSGKNGSGVLPLLQLQDKPKAGKENR

SEQ ID NO: 7901 - protein, 292 aa, Chromobacterium substugae
MDKQWRGIGWVAGIAAVWLALSAQYTLNEGQKALVVRLGAPVNVDGEPGLKFKLPLIDSVQYYDTRLQMLAPPPEQVILGDEKRLEVETYTRYRIADTLRFYQALRTEEQARAQLTQLVSTSLRRELGKAPLSDLLSPRRLAIVARIQQEVTERARPLGLDVTEVQLHRADLPLETSQAIYDRMKSARQQEAKELRAQGAEWAQQIQAKADRDRTVILSEAQRQSAITHGEADAEAGRILAQAFSKDPKFYKFYRSLQTYRQSLADSAPVLVLSPDSALLRDLKNGPAGGKP

SEQ ID NO: 7902 - protein, 412 aa, Chromobacterium substugae
MSLPPSTLRRLRHLLAALGPGLVVMLADTETGSVIAAAQSGAHWGYRMLPLLLLLIPLLYMVQELTIRLALGTGKSYGELVRRRWGRRAERASASVLLLSCLGALATQLSGLAGVGQLFGIPVWQTISLLGALIFLMVCTGSYRSVERTAIALGVFELAFLAEAWLAKPDPAQMLAQLTQLPLGNHDFLLLAAANIGTCIMPWTICYQQSALLDKGLTLADLRPARLDTLLGAILCQVITAGILIAAAVAFGHGGGGASLDTIPQLAGGFTRLLGPAGGRLLFALALSGGALVATIVVCLTSAWALGELAGKRESLARRPLEAPWFYGSFALMLIGTGALVSSGVNLVKLSIATSVANALLLPAMLAGLYWLASRELPPALKPGRGYRLLLALLFLLIGGFSLYSGIAGSLD

SEQ ID NO: 7903 - protein, 361 aa, Chromobacterium substugae
MEPDSLAHAFGLTFQVSFLDLILSGDNALVIALACRALPQELRRRAVLWGTGFAIALRLLLTALTGVLLMVPTLKLIGAAVLLAIAIQLLLGDDSADDDGARLAEQAGHSRQLWNAVTLVVSADLALSLDNVVALAAAAQGSLLFLLFGLLLSVPLLMYGSLLLSRLMDDYPLLIPAGAAVLGWLAGSLAVSDPLWNDWVAAQAPALQIAVPLLATVFVLVESRIIREQRQRLPALPPLQLLAPLTRRLAMLGEAGIAGEPSPSPIAPPEPAIAAAAPPAACAETPAAAALEESAAVLQPRQPAAIDEEAGDDDASLSPPLKALVLAAAVIGALALAWLAWHLLSQGFLPTPSHHPAAPRH

SEQ ID NO: 7904 - protein, 789 aa, Chromobacterium substugae
MFLKGGLAAGALGGAALLASHGAVTGSPFQPTQASWLVKTADATCTDPAWSAATVYTGGQRVSYQNQTWQAKWWTQGNTPAAGDASPWQLIGQCGGGNPNPPPDPPLVQVPAPTGNALCRPEALAQTPSVDVPYCAAYKQGGAEQLANGSRRRIIGYFTSWRTGKDGSPAYLVNNIPWGKLTHINYAFAHVDGNNQLSVNDSAAGNPATDMTWPGVAGAEMDASLPYKGHFNLLTQYKRKYPGVKTLISVGGWAETGGYFDASGKRVASGGFYSMTVNADGTVNQAGINAFSDSAVAFLRKYGFDGVDIDFEYPTSMSNAGNPLDWSFSNARLGSLTKGYVALLQTLRDRLDRAAAQDGHYYQITAAVPASGYLLRGMETFQGLKYLDFVNVMSYDLHGAWNRFVGPNAALYDDGKDAELTFWNVYGTAQYGNIGYLNTDWAYHYYRGGLPASRVNMGVPYYTRGWKNVTGGSNGLWGSAVGSNCPTGLTECGDGAVGIDNIWHDLDDNGKEIPGGSNPMWHAKNLEKGIAGSYLASYGIDTSQPINQLTGSYQRNYNATLTAPWLWNASKNVFLSTEDEQSIAQKAAWIDANNIGGVMFWELAGDYDWNAQRNGGQGEYFIGNTLTNLLYNTFSQPAKVSARRADAAPAPTAAIDVGFSLGNFALGDNNYPINPKLTIVNRSQTTLPGGTEFQFDVPTSAPANIADQSGFGLKVISTGHSGSNVGGLKGDFNRVSVKLPSWQSLAAGQSVTLDVVYYLPISGPSHYTVGLNGKTYAIRDEAPYLPYLK

SEQ ID NO: 7905 - protein, 71 aa, Chromobacterium substugae
MNADDLARYYQDYLSRQPSRFGVSPLRALAQLREVMQWPQEAAAAEKKSGRESPAGTREQEKRGGPRLRAG

SEQ ID NO: 7906 - protein, 527 aa, Chromobacterium substugae
MRSLLAQMQQLGWLDWQSRAGRGQRSLLRFAQSLEQLRQNQAAQLLEQGRVEQAAALLGGDPRQLAPILLARLGRRWSQDRQVLGVPYYRPMPNLYPGTPLRRSERHLVSQIFNGLTRINEEKGEVEGDLAHHWQQHGDAEWHFHLRPAVRWHDGRELTQDDIAATLQRLRRWPLFSHLRGIRRLAPHSLALELERPDRWLPWLLADSAALILPADHDKHPGFASHPVGTGPYRVAANDAHRLSLQAFDDYFGYRALLDQVDIWMMPKLGDELEPGGPGLCDLTVEINPQPVRPQTEMSLEAGVYFLLCDGRAPAMRDSQARQWLAHVLAPLAIMQQTAPAVRQYWVAASGLLPRWHHAKPAAAPTRTPFSRLRLAFYEQHPEYQLIADAIARCLRPFGVELECRKYSYGDWEQGRGEAELWLGSVNFTRATDYAIPAWLLGTPLLRGCLAPELPLDGWLDGWRQGSENAQGLAAAVVQTHWLLPLFHNWLRLNGPGQIEDFRLNSLGWFDFKSAWLRPEDMSAAPK

SEQ ID NO: 7907 - protein, 202 aa, Chromobacterium substugae
MVSNNSQMSRIARRPWLAALSGLALAILPHGGAHAAEPLQPYRGELKCQAREMDDIWLDQRLACVSPGQKFIVNAAGASGAARDVAFVVNEAIYDKNFYPIQDRKVRYYQSFLCVRNAPADIRPLFLSGDLANALKLSNLDQKPEGVGPTSVNIAGGDRDGWEATPCDPARHPLIVDYRTGAVVSVNPAALAGLRIYQLPGR

SEQ ID NO: 7908 - protein, 71 aa, Chromobacterium substugae
MDLAGRDGAGDCFRMRRQVYPKGMLWRGEMRLGQRGRPAAGCAISVCGGQGRGAESAGLLLRRVLVSGRGR

SEQ ID NO: 7909 - protein, 716 aa, Chromobacterium substugae
MKLNSGRLWLRIATYGSLAVVLLLVLIRALIYWQFDEAAVRGALTHALNDTGRAVHIDGRITPSVFPYPGIDIEKVSISEPGKPAVFARVELLRVSLAWMPLLFGNREIKAVELYGPSASITRGLDGQLNISDLFQRRSPGAYSIKLDQLRIREGTLLLSDQPTHTDKRLSSISLDADDLRSTASVSAGAILDDDKRPVRLALNTPLAIQDDQVSLPQLEAVAISNIQGLGETKLSVTGQYKLNFASLQATGSDVTVSFSSDRPSSEVKLALPQINASLHELAMPSGSLSAKLIYARSQYQLQAQLENLKLSEGGLYADKLDGEFNWLAGSTKVNVKLNAPFSLAGMNQLLMQPLKLTSTIATPALPRGKLVTSMEGSLDGDIDEPRFNLRVAGKLDGSDVSATLSQYGLIKPRHEATLTIGKLDLNRYLPESQGDPVAIFQNTNEIPLDWLDFFDLNGKVAIGELAMGRFRINHISSNVRINPRALELDQMSADIYDGRLQGDASLSRRDVPRLQVKQTLQGMKIRPLLVDLFNFGRLDGKGNGKIDISADGKSFADLRNTLSGDAAFSLNNGALTGIDLVAALKNLPAELKEWNSAAQNDQKTTFSTLSTSFKLDKGIARNQDLKLASQLVNVNGGGKIDLKQSIVDYTMDVQANPQEFAQLKGVNVPLKITGPINAPVYALDFNAMVKGKKTEGEKKQALKQQLQKQITTILP

SEQ ID NO: 7910 - protein, 678 aa, Chromobacterium substugae
MHSMAPIVIVLLAAVLAVTLCRSLKVPPMLGYLVVGFLAGPGVASLIPQGKETAFLGEIGIVFMMFTIGLEFSLPRLKAMRQLVFGVGFAQVAVTMLLVAAAIAYLTGSPLTGFALGGALAMSSTAIVSKLLTERLELNQPHGQLAIGVLLFQDIAVVPLLILLPAFAGHSETLWLDLGKAALKVALVLALLLFFGQRLLRPWFHLVARQRSGELFMINVLLVTLGVAWLTELSGLSLALGAFVAGMLISETEYRYQVEEDIKPFRDILLGFFFITVGMRLELSVLFNRFGEVLMLLALLLPLKLAVVFGLGRLFGHRANDAMRSALALAQGGEFGFVLLALAMDLQLVATPMAQAAIAAILISMLIAPFLIMHGERITRRLVKQDWMLQSLDLHQMLVASMSKSEHVLICGYGRSGQALARLLEAESINMFALDMDPERVREAGEAGDPVVFGDAGKKEVLIAAGLMRARVVVVTFADTHAALRILHAVREVRPELPVIVRTIDDSEMDVLRQAGADEVVAEVMEGSLMLASQALMEAGVPPSRVLRRIRAVREERYDLFRGFFRGSSDEVESLDEALVPRLLSIQVCGGAAAIGHPLGALKLEALGVEVKAIRRHRHPLGALKLEALGVEVKAIRRHRVRRTDFDASFEIGADDVLVLLGTPEQLALAESRILQGD

SEQ ID NO: 7911 - protein, 326 aa, Chromobacterium substugae
MEKTHSTSRLEMAREVLQTEAAALVTLAERLNGDFLAAVDAILACPGRVIVTGMGKSGHVGRKIAATLASTGTPAFFVHPAEAAHGDLGMITGDDIVIALSNSGESGEVVSLLPALKLKGSRLIAITGRSESSLSQAADILLHTHVEREACPLNLAPTTSTTVQIALGDALAVTLMEVRGFSQSDFALSHPGGSLGRRLLVHVADLMHSGDALPRVAPGTLLKDALLEMSQKRLGMVTVCDADDTLRGIYTDGDLRRTLERSADVYSLKIDEVMGRSPRTIQAGKLAAEAGFVMKQNQITSLVVVDAAGKLSGVLHMHDLLQAGVF

SEQ ID NO: 7912 - protein, 172 aa, Chromobacterium substugae
MISEQARKVKLLIMDVDGVMTDGRIYYNAQGEESKSFYVQDGLGLRLLQSTGVQLAIISGRADRCVEHRARALKIDHYYGGVHDKGEALADLLQKTGFSADECAFIGDDLIDLPILTRVGLAVAVPEAPPQVRQHCHYVTGNPGGHGAVRELAELIMQAQGSFDAVVARYLA

SEQ ID NO: 7913 - protein, 189 aa, Chromobacterium substugae
MMRLLRSHRLFPVLLIGLTAMLTLWLDQISRWDTRHRELDPDKPEYVAENLVATHFDLQGKIADRLIATRMWQYPSKPDAYFENPDLYQYQQGALQYHVFGESGRYNNKNQQAFFDKKVTLIKPADSKQPETRLESSVMLVDSAKHIASTKAPSVVYHGKSVAHSIGFVYQQPLGLLNLLSTTKIIYAK

SEQ ID NO: 7914 - protein, 184 aa, Chromobacterium substugae
MPNKTRILLASLLLAASALTHAEQADSTKPMEITSDNGCTMDQIKGVSTCEGNVVVIQGTLRLNADKVVATQDKQGNQTLQATGRIVTFRQKMDNNGGWVEGQASKLDYSSAGHLAVLTGNARVKRNGDLAIGNVISYDTRSETYQVQGGGAGNAGKGRTTVILQPKNAASQPAAAKPAGAAKP

SEQ ID NO: 7915 - protein, 244 aa, Chromobacterium substugae
MNMKHSVLTISRLKKRFKKRTVVKDVSLQIESGEVVGLLGPNGAGKTTSFYMIVGLVGADDGDIRLDDASITRYPIHQRAQLGLGYLPQEASIFRRMTVEENIASILEISGRKGKELEKELDLLLDDLNIAHLRDSNALSLSGGERRRVEIARVLATRPRFILLDEPFAGVDPIAVIDIQKIISFLKGRGIGVLITDHNVRETLRICDRAYIISDGSVLASGEPEELVNNERVREVYLGEHFHL

SEQ ID NO: 7916 - protein, 467 aa, Chromobacterium substugae
MKQALQLKVSQQLTLTPQLQQSIKLLQLSTLDLQTEVERFLLDNPLLERGDEPRDAEAAPEGQDCRETAADEAPDSHDDGAGGELLEWGAGSRQGGDDDYDPMLNVPCQVSLREHLLAQLGEIALAGRDLAIVRLLIEELDDDGYLPLSLDELASHLPLELELESDELAVGLKLLQQFDPAGVGARSLAESLLLQLQRLAADEPGRALALAIAREHLALLGGRDYAKLKKALGCGDAELRAAQALIARLNPHPATGFSHGDVHYVIPDISVRKRRGRWVAELNRSAMPRLRVNRLYERMLADSRGQAGEMAGRLQEARWLVKNIQQRFDTILKVAEAIVDRQQSFFEHGEVAMRPLILRDIADELGLHESTVSRSTSQKYLLCPRGLFELKYFFGSALETDSGGECSATAIKARIRGMIDSEDSGKPLSDSAIADALGKQGIQVARRTVAKYREAMQIPAVNLRKAL

SEQ ID NO: 7917 - protein, 108 aa, Chromobacterium substugae
MNLKVTGLHLEVTPSLREYIESKLERITRHVDHVIDISVTLSVDKLVQKAEVNVHLSGKDLHLEASEADLYAAIDLLMDKLDRQVLKYKEKLTEHRAQSSGEVSQASL

SEQ ID NO: 7918 - protein, 153 aa, Chromobacterium substugae
MNLIGKILTPDHVLLDLDVSSKKRVFEQVGLLVENTRGIARSEIFDSLFSREKLGSTGLGQGVAIPHGRARGLKEATGVFIRLKAPIPFDAPDGKPVQCLFVLLVPEHATDLHLQVLSELAQLFSSRQMREQMLSIKMRDELYQLLSEWAPHA

SEQ ID NO: 7919 - protein, 318 aa, Chromobacterium substugae
MPSITVRRLYQENQQKLNLTWVAGTGGSDNVIGNDDQRPTLALVGHLNFIHPNRVQVLGLAEVDYLNKLEQSAAKTALDQLFHKSMSVVMVANNQPVPRLLRDYCHSHNVPLMCSSLESPYLMDVLRIYLARALAVSTVLHGVFLDVFEIGVLIMGDSAMGKSELALELISRGHGMVADDAVELYRIGPDTLEGRCPPLLRDFLEVRGLGILNIRTIFGETAVRPKKVLKLIIHLVKANDQAMQALDRLNIQSETQDIIGVTVRKVVLPVAAGRNLAVLVEAAVRNYILQLRGIDSTREFIERHTNFLRDQENAPDID

SEQ ID NO: 7920 - protein, 276 aa, Chromobacterium substugae
MISGLSGSGKSVALRALEDSGFYCVDNLPATMLPEAMSLYADFGYEQIAISVDTRSGPSLGALPDAVARMRAQNIDVRLLFLEARTETLVKRFSETRRRHPLSGAGITVEESIRLEQEMLAEVPELGTRIDTSELSANALRSWVRELVDADGSRLMLIFESFGFKHGLPQDADFVFDARCLPNPYYDPQLRPFTGRDQPIIDFFAKHGEVAEMIADIEAMVAKWLPCYGKENRSYLTVAVGCTGGQHRSVYIIENLARAFADRQVLVRHRQLYREP

SEQ ID NO: 7921 - protein, 205 aa, Chromobacterium substugae
MSRPKTITVALTGASGLPYGLRLIETLLAAGIRTWVLYSQAAQVVAKQEMQITLPSRPAEMKAWLLQRHAADPTLLDVYGREEWFAPAASGSNPPDAMVVCPCSMGTLAAIRHGMSDNLIERAADVCIKEQRKLVLVPRETPLSVIHLENMLELARMGAVILPPAPGFYTHPQSVDDMVDFVVARILDQLGVAHELTPRWGEAAP

SEQ ID NO: 7922 - protein, 488 aa, Chromobacterium substugae
MTSQPILSLDALRRLERAANAAGLQLMRRAALAAADWMGRHAAPGSRLLVCAGPGNNGGDALYAALELRRRGYLIDILLPVAPTGADSLAALRAVRAAGVALLSELPGGYPPPAWLIDGLFGIGLSRPLDEDWGRRMERLNALGCPTLALDCPSGLDAYTGRAAGPAIRADHTLTFLCHKPGLFCGDGADLAGVVELAELDCPRQLFPAAEGALNAPSAAGLARRRDSHKGSFGSVAVIGGAPGMLGAALLAGRSALQGGAGKVYLCPLDDRLPVDPVAPELMMRPLDETPELPAADVIAFGPGLGQQELAGKLLRQVAALPQPLVLDADALNLLAGDADAAERLRRRASPAVLTPHPAEAARLLQTDTAAVQRDRVGHARALAARYRCVAVLKGAGSLIARPDGHYQLNASGGPELAAAGQGDVLTGLIAALLAQGLPPFEAAALAVHAHGLAGDGYRRENGGPIGLTASATPARISQALNRMLAGG

SEQ ID NO: 7923 - protein, 304 aa, Chromobacterium substugae
MSSQKKAYAFGLAAVLAWSTVASAFKLSLQHLSPMQLVLYASGASLLSLLSILAWQGRLPELAATLRRHWKSSLLFGAINPFAYYLVLFQAYSLLPAQEAQAINYTWALTMTLLAVPLLKQKLHPLDAIAALICYLGVLVIGTRGQLLALHFSNQLGVALALASTLLWAGYWIFNTRDSREPVLGLALNFAFSLPLSLAWCAWHGQLAPPSWQGLAGAAYVGALEMGFTFVLWLSAMKLTRSTASIANLIFLSPLLSLLLIHLILGEAILASTLLGLALILGGLAVQKLPLRRAPPLPVADGPG

SEQ ID NO: 7924 - protein, 515 aa, Chromobacterium substugae
MKSIKTRLMLWLMAWITTILGSTGLYFYLHDYSIDQSDFQTQRAAVQSRLSLSLPHGIWQLDDENVRLALDSELSWPSVIAINVKGESGLNLGRTRDSGGSLRDMLPNERPKVDDMLSIPIVYQGKEHLGTATVYLSHDALRAREDQHLITIIAQIVLLDGMIFFIMSFNLQRFIFQPLSRLQQALNTAIRAPDATGAQITHLADDEIGAIVNGFNRIVARTAADLVKRTAAEAVAREEKEKAQLAYSQLMATQETLVEAEKMASLGSLVAGVAHEINTPVGITLTAASHLGTATSHITGKLDSGNVKKSDFQSYLETAQECCELILANSERAANLIHSFKQVAVDQTSEARRSFHLHDYLNEVITSLKPRFKHTKVGIDIQCEEDILLDSYPGALAQVLTNLVVNALVHGYEGGEIAGNIVIEAHRNDAQHVSLNISDSGKGIAPENLSRIFEPFFTTRRGSGGSGLGLNIVYNIVRQRLGGNIEVHSEPGQGTRFTLEMPCIAPTVQHKENVA

SEQ ID NO: 7925 - protein, 531 aa, Chromobacterium substugae
MSTETLPPDDDNWLLDDNDNEDNVRPSEMRKPWKVLIVDDEKDVHTATRIALRGISYKERPLELISAYSGVEAFQQLQQHPDIALIMLDVVMESEDAGLKLVHRIRGDLGNGVVRIVLRTGQPGQAPEQEVILNYDINDYKTKTELTTQKLFTTTIASLRAYENMVSLEKNRQGLAKILESASDLYQLHSLREFASGVLRQISALLDIGTDGILCVRNENHSGRPELEILAVSGSYEYLAEAGDLSSEPKLAEVIQRVFHEKRSIFQHPYDVLYISSRNRREFAVHFMPQWPLESVECDLLDVFCQRISAAYDNLYLYNQLRSAQEATVVALADLAEFRDTDTGDHVLRVQKLTDAIAQEMLEHNHYPELMTREFMDMVGMASILHDIGKVAIPDHILLKPGKLDPEERAVMEQHATIGAQILDKSARMVEGTSYLSLGSEIAGGHHEHFDGKGYPRQIAGQDIPLSARIVAVIDVFDALLNKRPYKEPWSMEDTMKYIGSRSGSQFDPLVVEALTRLVNENRLPVAPQQE

SEQ ID NO: 7926 - protein, 205 aa, Chromobacterium substugae
MYHGERFNGYSHLAGTLLAVAGLVVLVVEAAMQGDPWKIVSFSLYGGTLVALYLISTLYHSFTGKAKAILQKCDHSAIYLLIAGSYTPFALVTLRGAWGWTLFGLSWGLALFGIVQELTLGRRTRLLSMILYVVMGWLVLIAIKPLIDALAPGGLFWLGLGGLLYSVGIYWFLNDEKIRHGHGIWHLFVLGGSICQYVCVLNYVA

SEQ ID NO: 7927 - protein, 218 aa, Chromobacterium substugae
MRLILLGAPGAGKGTQANYIREKFGIPQISTGDMLRAAVKAGTPLGLEAKAIMDAGGLVRDDIIIGLVKERIAQADCANGFLFDGFPRTIPQAEAMIAAGVDIDYVVEIDVPDAAIVERMAGRRVHLASGRTYHIAFNPPKVAGKDDATGEELVQRDDDREDTVKKRLAVYHEQTAVLVGFYGKLAAAGDAKAPKYVKIDGTRAVETVRDEVLASLGA

SEQ ID NO: 7928 - protein, 252 aa, Chromobacterium substugae
MSGFTVVIPARMASSRLPGKPLADIAGKPMVVRVAEQAAKSRAGRVIVATDHADILAACAAHGIEAALTRADHASGTDRLAEVAAQLGLADDAVVVNVQGDEPLIQPELIDQLAELMLAGDAPMATLAHAIHDAADHFNPNVVKVALDKHGRALYFSRAPIPYARDAYAAGRDSLPAGLPVYRHIGMYGYRAGFLAAYAGLEAAPLEQYEALEQLRVLWHGYAIMVAVADEAPAAGVDTPEDLERVRRLLDA

SEQ ID NO: 7929 - protein, 60 aa, Chromobacterium substugae
MDAKFLEILVCPLCKGPLLFDKSKDELVCKGDRLAFPIKDGIPMMLEAEARELAPEEEVK

SEQ ID NO: 7930 - protein, 339 aa, Chromobacterium substugae
MSLIERHWYRPLGWLTALLAPLEGLFALLAAGRRLAFRRGWKSSETLPVPVVVIGNINVGGVGKTPLTLALLADFAARGVKAGVISRGYGGSAAGPTEALQGGDPARVGDEPLLLAASGAPVVVGRDRVAAGRRLLERHPDVQLILSDDGLQHYRLARDLEIAVLDGRRGVGNGRLLPNGPLREPLSRLRTVDAAVVNGSGADLALPPGLARFDMTLRAGACHALGDAARLRQADGFAGLKVVALAGIGHPERFFDTLAGLGIAVERRLSFPDHHAFCAADIPADADAVIVTSKDAVKLERVLHDAAQRARLWVLPVQATLAPGLCDWILARLKMEHGR

SEQ ID NO: 7931 - protein, 138 aa, Chromobacterium substugae
MNFRRGRGREEPEINFIPLIDVLLVILIFLMVTTTYSRFSELKINLPSAQGEQLKNKTVEIRVAVAADGAMAVNDARIAAADKSGLLARLKAAAAGKSDVVVVVNADARSTHQSVITVMEAAREAGLSQLTFATQNLK

SEQ ID NO: 7932 - protein, 204 aa, Chromobacterium substugae
MWAIVEAAGWPIWTILAASVVSLAIILERLYSLRRGVVVPEGLLAQTLQEYRRVDLRDELMHRLARHSPLGRLFAAGLRNVSGSREVMKESIEDEGRQVAYQLERLLTTLGTIAAMAPLLGLLGTVIGMIEIFGSQNGSGANPQQLAHGISVALYNTAFGLIVAIPSMMFYRFFRSRVDGLLVEMEAQAIKLVEVVHGERRNGS

SEQ ID NO: 7933 - protein, 157 aa, Chromobacterium substugae
MNLPIWLIKLLLNLWPPFLGAGIRVHRLSADFRQAEVRLKLGVGNRNYVGTHFGGSLYAMTDPFYMLMLLRQLGGDYYVWDKEGRIEYIKPGRGLVRARFELSDALLRDIREQTADGGKYLPEMKVEIRDGDDELVATVHKTLYIKRKPERRQAKPI

SEQ ID NO: 7934 - protein, 98 aa, Chromobacterium substugae
MLFNDDQIEQTSRAMKAMSHPLRLKIISVLEDREVSVQDIVEQVGTSQSNISQHLAIMRDKGVLRTRKDANRVYYRVGDIRTLEVLRMMREVFCGFGE

SEQ ID NO: 7935 - protein, 507 aa, Chromobacterium substugae
MKSITPVLLLILDGFGHRTEGDDNAILHANMPTWNRLRQRYAYGTINASENFVGLPSGQFGNSEVGHLNIGAGRIVQQDISRIDCDIEDGHFANNDTLQQAMSKAQGSALHILGLLSDGGVHSHENHIHALIRAAQAAGVAKIYVHAFLDGRDTPPRSAETFLKRLDAVLAECPNARLVSVTGRYWAMDRDKRWERVEPAYRLLVEGEGLFHAETGLEALAAAYERDENDEFVKATGIGAPVKMQDGDALIFMNFRADRARQLTTALTDPAFDGFQARQPKFGCYATLTSYGEAYSALPTAYAPQKIHNGMGEYLSSQGLKQLRIAETEKYPHVTYFFNGGEEQVYPGEDRILVPSPKVATYDLQPEMSAGEVTDKIVAAIQSGQYQAIFCNYANGDMVGHSGIFDAAVKAVEALDGCIERCVDAMLAAGGEVLITADHGNCEQMYDGAHHQPHTQHTTNQVPFLYIGRPATIRGGGSLRDISPSLLAMMGLEQPAEMTGQSLIDFQ

SEQ ID NO: 7936 - protein, 446 aa, Chromobacterium substugae
MKPYLLLALLAGAAQAANTNASSTSLSAAPHQQDLKNVRKEIDSLKKDLAQKQTVQKEAQSAIKESEQAISQTRQTLATLEQKQNRSAQQLADLNAQIEKSRKSLADVRQRVGQMLVRQYKNGQHDAMKLMFNDSDPNQSSRDLAYYQHIARADQQLAQQLVAQQQQLQALSAQLEEELARLNSLSSRKSQEKSELEKDKSQQQQQLNKVSGEIKQGQSKLTQLQEDEKHLSNLIAQINREIQRRRAEAARKAAEARKAKLAAAREAARKENERRRQLAAQAKKQGKPVPEEAKKPVIVKEEPAEKVDDVADGSASGRAFASLQGKMKLPVAGQIAGAFGKMRREGTTWKGIFIRTAGGQPVHSVADGTVVYADELRGFGKAVIIDHGGNYMTVYTGLSAIAKSSGAGVKAGETLGNTGTLDNGEAGLYFEIRHLGRPLNPQAWTR

SEQ ID NO: 7937 - protein, 435 aa, Chromobacterium substugae
MLTREFVLTFREAAPYINSYRGKTFVLAMGGESLLDGDFSSMAQDINLLVSLGVRIVLVHGIRPQIEALLKRHGIARMFHRDRRVTDAGTMDVVKQAAGATRHDVEARLSMGMPHSPMHGAHLRVAGGNFVTAQPLGVLDGVDMQYTGQVRRVDAAAIRQRLDAGELVLLTPVGYSLTGESFNLAMEELATHAAIALKAEKLIFVVEGRGAVEQDGQLISSLTALQAEQLLEAGSLPEDVAAYLPYAIRATREGIPRAHLISRHEDGALLLEHFTRGGNGTMIARDPLVRVRNASIDDVGDILALIRPLEEQGVLVRRSRERLEVEIGEYSVLEHDGKIYGCVAMHPFPEAETAELACLAVSPAKRDGGFGEMLLRHVEYQARTRGLQSLFVLTTQTSHWFVERGFAEADRSSLPLARQQFYNYQRRSKVFVKKL

SEQ ID NO: 7938 - protein, 90 aa, Chromobacterium substugae
MSRTVNCVKLGREAEGLDFPPLPGELGKRVYESVSKEAWQGWLRYQTMLINENRLSLADARARQYLAAQLDAYFFGQGADAPAGYTPPQN

SEQ ID NO: 7939 - protein, 691 aa, Chromobacterium substugae
MSQPQDLLLNRELGLIEFNRRVLAQAEDANLPLLERLKFLCIVSSNLDEFFEVRVAWLQDAAHATPERILADGSTPEQALAKVARASHQLVKDQYAVMSEVLFPALREQGIVFLRRGEWTQQQKDWVEAFFFRELMPILTPIGLDPSHPFPKVLNKSLNFTVELEGRDAFGRASGTAIVQAPRILPRVIKLPAEVCEGRPHCFVFLSSILHSHVHELFPGMTVKGCYQFRVTRDSELSVDDDDFKNLRTALQGELRQRQFGDAVRLEIADTCPQHMESFLLTQFNLQPRDVYRVNGPVNLVRLMQVPDLVDRADLKFAPFSPTLPPPLQKKAQLFEAIRKGDILLHHPYQSFQPVIDFLTLAATDPHVVAIKMTVYRTGTDSVLMESLIAAARAGKQVTVVVELMARFDEEANISWASRLEDAGAHVVYGVIGYKVHAKMLMVVRREERGLHRYVHLGTGNYHPRTARLYTDFGLLTCNEEIASDVNDIFVQLTGLGRAGSLKQLFQSPFTLHSMIMQAIERETEHAQAGKPAQIIAKMNSLLEPQVIHALYRASQAGVKIQLIVRGVCALRPGVPGLSDNISVRSIVGRFLEHPRVFYFYNDHKEDLLMSSADWMSRNFFRRIETCVPIIDGKLKRRIIKEALRLYLEDNVNSWDMQPDGSYKRRGSRGKPHCAQRQLLESYSAQPQEDK

SEQ ID NO: 7940 - protein, 159 aa, Chromobacterium substugae
MAMVGYLLAVVMMLAGLAGTVLPAIPGLPLLFGGMLLASWLDNFQHLGAISLTILAVLAALGLLIDFVAGLLGAKATGASRQALWGAFIGSLVGMFFGVAGVILGPLLGAIIGEFIARKDAFQAGKVGIGTIIGFIVGAVAKVACAFAMLATAALALAF

SEQ ID NO: 7941 - protein, 141 aa, Chromobacterium substugae
MPLQHLIYVSTARQELSHAEQEALLESCVRHNLQNDISGVLLYGPGNFIQVLEGEAAAVAETYQRILDDPRHHNLIEILLEDIEQRSFSNWRMGFTRLDDDTISKHPGFIDVYGPDFLPQRLAQRPTLAMNILLSFRANCR

SEQ ID NO: 7942 - protein, 555 aa, Chromobacterium substugae
MAQYVMSMLRVSKIVPPKRQIIKDISLSFFPGAKIGLLGLNGAGKSTVLRIMANVDKEYDGEVQHLAGVKIGYLEQEPKLDNDKTVREEVESGMGDVMGAQKRLEEVYAAYAEPDADFDALAEEQAKLEAIISAGAGDNVALQLELAADALRLPPWDAKIGPLSGGEKRRVALCKLLLSKPDMLLLDEPTNHLDAESVEWLEQFLVRFPGTVVAVTHDRYFLDNAAEWILELDRGEGIPWKGNYSSWLEQKEERLAQEAKSEGARMKAMKQELEWVRQNPKGRQAKSKARIARFEELSSYETQKRNETQEIFIPVAERLGNEVIEFDGVSKGFGDRLLIDNLSFKAPPGAIVGIIGPNGAGKSTLFKMIAGKEQPDSGSVKIGQTVQMAFVEQSREGLDGDKTVFEDVAAGADILTVGRFEMSSRAYLGRFNFKGADQQKKVGMLSGGERGRLHLAKTLLKGGNVLLLDEPSNDLDVETLRALEDALLEYAGTVFVISHDRWFLDRIATHILAAEGESQWTFFDGNYQEYEADKKKRLGEEGAKPKRIRYKPISR

SEQ ID NO: 7943 - protein, 244 aa, Chromobacterium substugae
MMKWVGLALAWFGSCQAWAAPAGDVVNLYTLDYPPFVIRDTPQSPPHGIAVELVSQALARAGLRGQFVDLPWKRAQLQVTNEESGCLMPLTRSPKREGQYRWVGLIDDSSQSLFVAAGSKAQIRTLADLKGLRVVTLLGSSMAEWLRLHQVGFSELATTEDAYRELSLGVADAWAVHSPVARYLVKKQGVSATPIREILRLQETGIYLACGKHMPEEEAQRLGAALKQLRDEGVAAKVMSRYLD

SEQ ID NO: 7944 - protein, 225 aa, Chromobacterium substugae
MYLRTLILCSSLWLAACATPRAADAPAPAGYYRVQSGDTLYRIARKHRQSVGNLARWNQLSDSSNIQAGQLLRVQPPSAGKTAGNASRPPAKPAEKPAPPPARLDIKLQWPASGALIAGFDGNRNKGIDIAGNAGDKVQAAAAGKVAYAGKGIRAYGNLLIIKHSDDTLTAYAHNQQLLVNEGDQVSAGQTIATMGDTGANRVKLHFELRLRGQAVDPAPYLPPR

SEQ ID NO: 7945 - protein, 399 aa, Chromobacterium substugae
MKRTSLLLLAALLSACAGPRPQPAPAPIASAPAVQLPPETASPTPAAPASNPVPQAPPAKAAPASRELIARAVPPQARDRQGWIADIDAALRHLRIPASADNVCALAAVIEQESSWQADPVVPGLPGIVWGKIEEKAHRYLVPLSVVKTALLKGSPNGQSYKARIDNLRTEREMNLLFEDMAREAGKMGLPDMKNPIRTGGPMQVSVEFAEAHAKVWPYPYPHSDSIRHQVFSRRGGVYFGAAILLQYPAPYQDMLYRFADFNAGRYSSRNAAFQAALSRLSGRKLALDGDLLNYQGQTASGSQQAALSLSGRLAMGAAAIQRDLRQEKSVGFGQTQLYRQVFALADQQAGRPLPRAAMPQIDLKSPKISRKLTTEWFANRVDGRYRRCLVLLRQTPAP

SEQ ID NO: 7946 - protein, 342 aa, Chromobacterium substugae
MRSTFSYFRGSLAFSVAVLAIVAWYGHAQGGVEQAGAFLVTAAVLAVLETSVSFDNAVVNATVLKAMSPRWRQIFMTVGIAVAVFGMRILFPLLIVSTAGGVSLAEAFAVATKQPERYQQIMHDSHLMIMGFGATFLLMVVIEYFVQHEKDEHWVPGIEPLLARLGSVENAQSLVTILVVAAIAALLPAGQKMPFISSCFWGYVVFMALHMFKQLFGGMDIQTAAAKNGLIGFVYLEVLDASFSMDGVIAAFAITNDFWLIAAGLGIGAMFVRSLTLYLVERNVMSQFKYLEVSAFWAIAALVAIMYAAALHVELGEVTTGLISVAIIALGILTSLPSRGKP

SEQ ID NO: 7947 - protein, 237 aa, Chromobacterium substugae
MDQFFKESIMSVGSLGNSSISLQYTQVDIQESFSSDQGQSSGGGAVQGTGGGGHHHHGGGGELTQSVLQALQQSGLLQSGSSSSGTDSSSDGDSGSTGAVDATGGTQQQAVHAFIHSLFQALQQEGAASGSQSGSSEAGSSDQSGDATTAASGSGGYGNLQNNLQQLLQDIANGTQNSATSTLSSAFQNLQQALGIGGSGQSSQSSLQSFLQNLTNNLQQNQFGSSAGVGALLSTSA

SEQ ID NO: 7948 - protein, 213 aa, Chromobacterium substugae
MSLGSVTGSYSIAPQYVPATAPGVLAPSGNQGQAAASRRQDNGPDGGFGQEVALALQQSGLNLAAAGNYNNAGERTGDAGPQNNAIGALSGSAGSNVQQALHTFVHAVYQAVQAEGLSSSTAGAGQGPASSGYGDFQSNLQKLLQDVSNGSQNGATTSLASAFKDLQQSLGSGNGTGGSQQASLHTFLQNLLTLQNDQALSAGGVGSLLNTSA

SEQ ID NO: 7949 - protein, 122 aa, Chromobacterium substugae
MSKRQLKRSHAPIFWGLFGAGGMLAALFGPMLVWITGFAAPLGWLPAKAASYQGALALAQSLVGKAALWGLVSLLLWHAAHRIYHSLHDIGVHGGPAAKALTYGVAMLGTLLAAGLLLRLGR

SEQ ID NO: 7950 - protein, 122 aa, Chromobacterium substugae
MGGWWRKSPYFIEYMVHEGTALFVAAYAFALLFGLWRLSQGEAAWNGFIAALRSPWSVLCHLILFLMIGYHSYTWFKIMPRTLPPLIIGGKRVSAAAITAGGFIAALLASLALLGIAWGISQ

SEQ ID NO: 7951 - protein, 248 aa, Chromobacterium substugae
MTDKTMIIEVMRYRPEQDGEPWPQSFEVPYSDDMSVLQGLQYIRDYLDGTLAFRWSCRQAICGSCGMMVDGVPKLACKTFLRDYPGRVRIEALHHFPIERDLVVVLDDFIEKLESITPYIVPKENKPLSEGEYKQTPAQMDWYAQFSGCINCLLCYAACPQYGLNPDFLGPGAIALLHRYNQDSRDGASEQRMELLAAQEGVFNCTAVGYCSEVCPKAVDPANAVNLNKTAVAKDYFLRFARPKGACK

SEQ ID NO: 7952 - protein, 591 aa, Chromobacterium substugae
MKTYQADIAIVGAGGAGLRSAIAAAQADPGLKIALVSKVYPMRSHTVAAEGGSAAVKQEHDSFDAHFHDTVAGGDWLCEQDVVEYFVRQCPQEMVQLEHWGCPWSRKEDGSVNVRAFGGMKIERTWFAADKTGFHMLHTLFQTSIQFPQIQRFDEYFCADLIVEDGQARGVLAIEIASGESLLIETGAVVMATGGAGRVFRENTNGGIVTGDGMALAYRHGVPLRDMEFVQYHPTCMPRTGLLFTEACRGEGGVLINKDGYRYLQDYGLGPAEDKPRNKFMELGPRDRLSQAFWHEQQKGRAAQGPWGEAVYLDLRHLGHDKLRERLPQICELAEEFLGIDPAQAPIPVRPAVHYTMGGILVDGSCASPLPGLYAVGECSSVGIHGANRLGSNSLAELAVFGKAAGEAAARFARDNPPAGRGVLLEQARAAEARLLALRDRQGSERIADIRGEMAQAMEQGCGIYRTAAGMQAACDKLADLKQRFHYLNVEDKSSVWNSDWLLAIELGYQLDVAEAIAHSALQRKESRGAHQRLDGYEQRDDANFLKHSLAIHQPDAAPRIAYGAVKITTSPPGVRAYGAAGAAAERGETA

SEQ ID NO: 7953 - protein, 206 aa, Chromobacterium substugae
MLDKLIVELDKGLRTLCAPAHSARAHPDQDISEADLSAADKRHALGLMRVNHCGEVCAQALYQGQALTARDPSAREALRQAAQEEVEHLAWTERRIRELGGRPSLLNPLWYTGSLALGVAAGVLGDKWNLGFLQETERQVGAHLDSHLSALPDDDARSRAIVSQMRDDELQHAEMAHELGAAELPAPLKAAMKLSAKVMTGSSYRI

SEQ ID NO: 7954 - protein, 217 aa, Chromobacterium substugae
MNLASIGPGKDMPGDFNVVIEISANAAPIKYEFDKDWNTLVVDRFMGTSMMYPANYGFVPQTLAGDGDPVDVLVVTPFPLPPGVVVRCRALGLIKMEDDGGVDAKLVAVPVEKLCPMYKSIQKLEDLPELLRQQMVHFFEHYKDLEKGKWVKIQGWGTLEDAKTELVEGIARFGKAAAPSPSRPYGRFFCARRMLHCTIRLLRGIMVCRISPHLPRF

SEQ ID NO: 7955 - protein, 221 aa, Chromobacterium substugae
MRRLAARGLPAASASGPAAWPADWIGIALEDGWLDLGRDGDAALARRQRQCEDAGFAFIELGGDWQAPAAEHGFMLLAGSRQPPAGETLTLLDALAPQAGCWLHCGPAHSARFCQRVFAALLHAGRAALPLPDAQPRALQWEEMLSSQWQLADKLRQLADAYLIEHLGQRPPYPSPLPDEARHFAANLARAIALALPDSQDWPALLEKLAAALAACRPAGK

SEQ ID NO: 7956 - protein, 188 aa, Chromobacterium substugae
MFTTTQEFSALGQSQFDKAVRLSSIVLAGAERFASLQLDLSRKLLSDNAEAFKALSEVKDAKSLSDLQSGLAQPALDQAFSAARNVYDAALLTQNELSSFVEEQIAENSKALQTSLDRLSKSAPAGSDIAVAALKTLLNTSTAAFESVSKTAKKVSAEIAEAGVEAATNSAKAASAAVSRKKTTTSAA

SEQ ID NO: 7957 - protein, 235 aa, Chromobacterium substugae
MANAFDIKSASLDLLAILLRTDNLDELGQALDARFGNTSGAPAEAFVLDVEALPNPAELDLGRLLPLLSRRGIRAVALRHPDNALAAVASQFGLAFASSAALPRSAQAPQEPAAKPAVEPAAAPAGAMIVDRPVRAGQQIYAKGCDLIVLAMVSAGAEVIADGNIHVYAPLRGRALAGARGNAAARIFTRSMEAELVSIAGVYRTIEQALPDSILGKPSQIYLENERLVMAALGE

SEQ ID NO: 7958 - protein, 270 aa, Chromobacterium substugae
MAKIIVVTSGKGGVGKTTTSASFASGLALRGHKTAVIDFDVGLRNLDLIMGCERRVVYDLINVVNGEASLNQALIKDKNCDNLFIIPASQTRDKDALTLDGVEKVLKELADNGFEYIVCDSPAGIEKGALMALYFADEALIVTNPEVSSVRDSDRILGILSSKSKRAEEGREAVKEHLLITRYAPGRVDKGEMLSVDDVKEILRVPLLGVIPESPSVLQASNSGTPAIHLKGSDVADAYSDVVARFLGEQRPMRFLDAPKVGILKRLFGG

SEQ ID NO: 7959 - protein, 85 aa, Chromobacterium substugae
MSLIDMIFGKRQKSAAIARERLQIILAHERNGRDAPDYLPALQRELMEVISKYVAVNLEDIKVQVERQDDYEVLEVNIVLPEHQR

SEQ ID NO: 7960 - protein, 312 aa, Chromobacterium substugae
MTLTELRYIVAVARERHFGRAAQSCFVSQPTLSIAIKKLEDELGITLFERGGQEVAVTEIGERIIEQSQRVLEEAEAVKRLAGEHQNELAGPLKLGVIFTISPYLLPKLIPALRILAPDMPLILEENYTSRLAEMLKRGEVDAIIVADPFEETGIEAWPLYDEPFVVATPKGHPWEKQPQVDACQLAEESVLLLTQGNCFRDQVLQACSELSSRQHFGHNLASTLQGSSLNTIRHMVASGMGVTVMPATSVGPGDETLLSVVPFSQPAPQRRVLLVTRKQFFRKKAIDTLQQAVFRSGLPGVVMLEGEPKLQ

SEQ ID NO: 7961 - protein, 43 aa, Chromobacterium substugae
MKPDSHGAACFVPGHCGLLLQDYHHPEFAANCMMHLLVENAAA

SEQ ID NO: 7962 - protein, 646 aa, Chromobacterium substugae
MQKPDNPSNETERIAALHALNILDTPPEERFDRIARLAQHIMQVPIALVSFVDAGRQWFKSHQGLDAKQTGRDISFCGHAILGDDVLCVADTQLDPRFSDNPLVTGNPHIRFYAGAPLDIGGGVRLGTLCAIDRMPHTPSPEQLAALRDLAASTVDMMLMQPAADLIKQLHDSDTRLRAVLDTVIDGIITLDAHGVMESTNPAACRIFGYAASELAGRSLDMLIADPCQSMAGGMPGMAGALPLLEHGKEVTGLHRNGATFPLELSISEMHLQGSCMFVAVARDISERKKVERIKNEFISTISHELRTPLTSIHGGLVLALNGGDETLSPRTRQLLEIASSNCARLTALANDILDLKKIEAGHLEFTFEKVDLSALVKQSIKANEAYAHQSGVSLQALNALSQSYVIGDPNRLMQAISNLLSNAVKFSPVDGIVEISIHKIQDRYRVAIHDEGRGIPESFRSEIFNRFAQADKSDTREKSGAGLGLNITKAIIERHHGLLDYESTMGTGTTFHFDLPAATALVAAKPSRLLICKREESETEALRASLDEQGVESDGAYRGHIALDLLRHTAYQAVLIDLPHHESLAMIEAILSMRGLNAPALVLPDERKTDYLESIQTEGLAIHWFPRHATLAALEKTILSAINHA

SEQ ID NO: 7963 - protein, 128 aa, Chromobacterium substugae
MSSRKIQLMFIDDDQDIRSIFAFAFEQEQDMEIKLCASSIDAISWAEASPPDIIVLDVMMPEMDGPNTFSRLKAIPALALTPIIFLTAKVQKQEIERLKALGATAVIEKPFNPLELPGLIRSLAPEIG

SEQ ID NO: 7964 - protein, 208 aa, Chromobacterium substugae
MNDDFVAVIDDDDALREMLCLMLGSIKIPVIGYPDGRSFMEDAKRHQCACVVLDMRMPGMSGLDLQRQIRSETLDMPVIFMTAHADIRVVVDAMRDGALEFLQKPIQGQELLDCVQQCLQTLPQRKQKVREKEVFQARLANLTPREKQVLDEIASGMSSKQIADKLGVTLNTAEQYRSSVLKKMRASSTAKLLSSMELWQRKTAGKRE

SEQ ID NO: 7965 - protein, 115 aa, Chromobacterium substugae
MRGERKDMDAAETQKRMQALRAQYQDRLLRQLDEMQALAAQLNGEAADQAVYSVLRERLHKLAGSGGTFGQPELGRRCRSLECLLDGWLAADAPPIDAGMRRQFLADLAALAALT

SEQ ID NO: 7966 - protein, 715 aa, Chromobacterium substugae
MENDTLSAAFAVFIDEARDLIGQMEDILLRLEAGSADGDDLPALFRCAHTIKGSAGMFGLEEVVRFTHVVESVLDELRNGAFAFDSDLASVLLDCQDHISGLIAAATDGGEADRARSDALIPQLSRWLGQEAPPAASASEALPQQEATGDEQGVASPFWHLSLRFSPSILCDGMDPLKFINYLNRYGRVQHVETVCDHLPPLEAADPQQCYLGFEVVLDSAASAEEIASVFAFCAESASIVILPPHSPLPAFQRLIQALPEASGRVGEILVACGTLTSDELYRLLVLPHGGGEALPVEPRGVGEEAQPKPKPKREEERRPAEGGSVKVPACRLDALIDRVGELVIAGAGNQAQAAKAAHPAMLEAASQLLTLVEAVRDMALQLRMVAVGEVFYRFPRVVRDVAKELGKEIELRISGAEAELDKSMVEKIADPLMHLLRNAMDHGIEPAETRIARGKPMQGTVTLKAYHESGAIMIEVADDGGGLDHEKILRKAIEKGIVADGANLSRHDIHQLILAPGFSTAERVTNLSGRGVGMDVVKSHIEALRGSLVIESEPGRGTTMRLCLPLTLAIIDGFHVGVGGAQFIVPLDMVVECLELPQCQGDVDYMDKDGAALPFVRLRELFGERGPAHPRPRVVTVSFAGKRIGLVVDRIYGKCQTVIKPLGALFQHVPCVTGSTILGDGEVALIIDVVQLIQGVVARDVQQRQRNASVALTA

SEQ ID NO: 7967 - protein, 114 aa, Chromobacterium substugae
MDFSLDFDEETGRHLFRGELGVYTAHAVQAVWLNLLQAADGICMDLAGVTEIDTAGLQLLLQMKLHAAKSVSFCNASEPVREMARLVNQEALLKQPDAVGEGWLDRAAGRHYTR

SEQ ID NO: 7968 - protein, 121 aa, Chromobacterium substugae
MAKLILVVDDSASLRSLVAMTLTDAGYEVMEACDGADALSKLKGQRISLVISDVNMPNMDGLTFVQELKKNPAYKCAPVIMLTTEVAEDKKQAGQSAGAKAWMVKPFQPKQMLAAVELLAS

SEQ ID NO: 7969 - protein, 184 aa, Chromobacterium substugae
MADNQASNPNPAIGAAQHESSVGKLYLAFSLGGNAYSIEIERIREIIEYDVPTAVPMMPLAVCGVINLRGAVVPVLDLAVRFGHHPIVVSRRSCYVIVEVEHGGALHVIGLLVDRVTAVVEIDDADIEPPPAFGAQIDVDFIAGLARHDNRFLIILNMARALSIAEISAVTRMGEEKLPQADPA

SEQ ID NO: 7970 - protein, 666 aa, Chromobacterium substugae
MPALVAMLEQMANGNLNTRLEISSHGEAGRVARLATQIQSGLQTLLADMKRMSAEHEAGDIDVRMDETKFEGAYREMVSGINEMVAGHIAVKKKAMACVKEFGEGNFDAQLEVFPGKKRFINDTVEQVRANIKAFIGEMNHMSAEHDAGDIDVRMDEAKFQGAYRSMAAGVNSMAAGHIAVKKKAMACVKEFGEGNFDAQLEVFPGKKRFINDIVEQVRANIKAFIGEMNHMSAEHDAGDIDVRMDEAKFQGAYRSMAAGVNSMVAGHIAVKKKAMACIKEFGEGNMEAPLELFPGKKRFINDTIEQMRANIKALIVDTDMLVQASVEGRLDERANANAHRGDFRKIVEGINKTLDGMAGPVKEVMRVMESLAVGNLTCLVEGQYAGDFDQLKRSVNTSVDQLAQTIRQVSEAIEEISSALNQVNSASQALSQNATEQAASLEQTTSSMEEMSVSIAQNTDNAVVTDGIATQSAKDAMRGGDAVDETVKAMRAIADKIGIIDDIAYRTDLLALNAAIEAARAGEHGKGFAVVAAEVRKLAERSQIAAQEISGLAANSVQTAEQAGQLLSEMLPSINRTADLVREITAASNEQSIGTNQINEAMNQLNLTTQQTASASEELAATAQTVAEQAELLRNLMSQFELRESHGNAMRDTMALMRSGGRSYA

SEQ ID NO: 7971 - protein, 41 aa, Chromobacterium substugae
MATSAGMPFSWLRESHAAINNRGKDKVLTHMAAFTQIFSPS

SEQ ID NO: 7972 - protein, 392 aa, Chromobacterium substugae
MKSSIRLPFSLTVFPLVLALACASFLLGVLGAHPIALSAGGALLALGWAGRTWMGRDVGRFIDASVQRSRTISDAETAVHRDQAAYLDSLRVTCRAMLPRWRTNVELVRAQSESAVDGLVAEFRDIRSRLKRALGAFASQGQEDLASTIGGARDELETILSELKAATAAKQQMMGNIASLVQLTEDLQKMAIEVGDIAARTNLLALNAAIEAARAGESGRGFAVVADEVRKLSNLSATTGASIRDKVSTANQLVGGALAAAERLSSEDKRLLVSSESAIAATLARINQAADGLASASASLRAENLQVSQRIEEVLVNLQFQDRTAQIMGWVLSDMGRLDERLTQDEEQVRQGEVPQPISVDSWVEKAESQYTTLEQAPHRHQVDAQSSMILF

SEQ ID NO: 7973 - protein, 674 aa, Chromobacterium substugae
MNANPLLQDWNTPHQLPPFGLIRPEHFEPALAALFAEHLAEIDALAALEEAPSFANTAAAFDRSGRRLERAQLLLDNLTASETSAELQEVERRTAPQLAEHNSRIYMHAGFFARLDAVHARRAELGLSEEQDRLLDLIHRNFVRAGAKLQGEDRRRYAEIVSRLAELTTAFGQNVLADEAEYALPLGENDLAGLPPFLLDAARAAAEARGLEGWAITLSRSSIVPFLTFSARRELREAAWRAWTERGEHAERDNRPLAREILALRVEQSRLLGFDTFADYAIANRMAGKPAAVHALLEQVWEPAKARFESEKAMLREEAARLGEPADIQPWDWFYLAEKVRIARYALDDAEIKPYFGLENMVTAMFDVARRLFGLSFAERHDLTLYHPDVRAWEVSRGGKVIGLFLGDNYARQSKRGGAWMHVYRSQARNGGEALPIVVNNNNFAKAGHGQTLLSFDDVRTLFHEFGHGLHGLLSNVEYRLLAGPNSPWDYVELPSQLMENWALVPEVLAKHALHAETGAAIPAELVAKIKAARHFNQGFETVRYTASTLIDLALHQRADADGVDIAAFEAAERERLGVPPAAGMNHRPPHFRHIFTGPEYAAGYYVYMWAEVLEAEAFAAFEEAGDAFDPALADKLYRHIYSAGDAVEQRAAFRAFRGRDPQAAAMLKKRGLQ

SEQ ID NO: 7974 - protein, 193 aa, Chromobacterium substugae
MTKKIGKSIKWLLPTIVLLAIGALFWKSQQPTHKASPPAEAARIHYLNYANVRFPFSIPYPKGLLIPGEEPDNGDGLAFTSPDGQTVMTASGINNANDDTLQSEYRDDLKRPSESGQPRKVAFKTIKKDWFVISGTEGDKIFYQKTYLVDDQFMTFDIRYPASQRAKWDPIVAHISKQFKVTPGNTPYEVQSQ

SEQ ID NO: 7975 - protein, 43 aa, Chromobacterium substugae
MVRDDGCAGEVSVSGLSLRPGTDDGDIAFTGTGLRTGCCRASP

SEQ ID NO: 7976 - protein, 671 aa, Chromobacterium substugae
MSNPLLQHWDTPHQLPPFDAIRAEHFALALQQLMAEHRAAVAAIANQPEPASFANTVEALDAAALPLKRVSLVFHNLRSSHSDAELRAAERELAPQLAAHHGAICLDEALFARLDAVLRQAPQLELNEEQRRLLQRLHRDFTMAGACLRGEDRREFADANEELARLSAQFGQNVLADESEFVLRLSGEDDLAGLPASLRAAAAQTARERGLDGHAVTLARSSVTAFLAHSSRADLRETAWRAWVGRGEQPQRDNRPLIRRIMALRQRQARLLGYANYADYALTDRMAGAPAAVHRLLEQVWAPAKVLLAREKLQLQALARKQGLNPDIQPWDWRYLAEKARLEHYALDDAEVKPYFSLENMQAAMFDVAGRLFGLSFAERDDLPRYHPDVKGWEVYRHGELIGVFLSDNFARPGKSGGAWASIYRAQGRNGGRSLPITVNNTNFIKGSPTLLSFDDVRTLFHEFGHGLHHLLSDVRYQRLSGTQVLRDFVELPSQLLENWALVPEVLERHARHVETGAAIPAALIARILAARNFQQGYATVRYVISALLDLELHQAGDGVDDIAAFEDEVCRRHGLPPEAGLAHRLSHFSHLFNGGYAAGYYVYLWAEVLEAEAFAAFEARGDAFDAELADSLRRHIFSVGNSRDPQQAFQAFCGHAPSAGAMLEKRGLAG

SEQ ID NO: 7977 - protein, 211 aa, Chromobacterium substugae
MRHLAAACLALAALSGSARAFDLGSVLNSVNQAVDTAKNVGNSVSGGNPATGDGSLTPRLKLNRPSPVGSPLLAKLDEYNHHYKELDEYTVFLSRPNQNSDGSIRVAKAELLRGQVYKDLYNHPDSQSTMQVWEAYKSQLSQDGYKLDFICDKPCANHVNLWQTALSSSFIVYDKSDRYLVAHKDNTWVSVAIGEIGSHPLSSVNVVVRGN

SEQ ID NO: 7978 - protein, 133 aa, Chromobacterium substugae
MEIFFYAYKALTTKPDEMLAKRGLARVHHRILFFVARYPKLSVKDLLGFLGVTKQAINIPLRQLLEMELICSQAAPHDKRVKQLSLSEEGLRLEESLHREQQRLLQTAFGDCGDKATRDWFLINGKLSEHILP

SEQ ID NO: 7979 - protein, 200 aa, Chromobacterium substugae
MGRRRAPTSISKTETIMSKAFTKEEDQAEDDLPSEQRLPAASKNYITPGGWQRLKDELYHLVNRERPEMVQVVNWAASNGDRSENGDYLYGKRRLREIDRRIRFLTKRLEIAEVVDPETREATDQIFFSATVLIQRGDGAEQRLTIVGVDEIDLPRGRISWISPIARALLKAREGDSVLFRGPDGDEDIEVLEVCYCKVE

SEQ ID NO: 7980 - protein, 179 aa, Chromobacterium substugae
MLDGLTAGSSMGDRRLAVARFVLGGSVEDFGQNQDAGLALPAEPRKQRAAIVIIEGGKLLLMRRIKPGKDYYSLPGGNIKKNETPAIACVRETREETGLNVWLGDKLCVLEGRSRTEHVFVAREHRGMLRLGGPELAKLSADNHYELAWLDAAALCAVKLRPKALLPYCLALLEGGDQA

SEQ ID NO: 7981 - protein, 466 aa, Chromobacterium substugae
MSTKGQRTNARQPVARVKGRETAQPRQNAGRNQGQQARQGKSGPSAQPRFPQQQQAGAGQQNGRRNGPARQPRDAYGNPAVPSQNGVPLFKLSRREQEQQALAAARGKPVYGRDSNGDVNGNVALDHERRFGNKNAAAPVDGNAAKPPRGPKPEGEGRGRPQQVQKAKKLRLRSPSQDIKSKSQKLKEVRVDLNEIEPIRLQKALSSSGVGSRREMEEWIEAGLVTVNGKKANLGDKVGPHDRVMVKGDAIKLKWPDRLPRVIMYHKEEGEIVTRDDPEGRVTVFDRLPQAKSSRWVAIGRLDVNTAGLLLITTSGELANRMMHPSFEVEREYSVRVMGELTPEIMKEMVKGVELEDGPARFDRIFQTGGQEEAANQWFNVVIKEGRNREVRRMFEHFGLTVSRLMRVRFGNIGLPPRLKRGQFYELNPAEVAAVMKWSNLTVTGGKKAPAQRKASARKPRTPRPE

SEQ ID NO: 7982 - protein, 210 aa, Chromobacterium substugae
MSTITDLKYLKIVLETALLTAQEPLSVSQLKKLFTEDVKAALINDILDDIQGDWRGRGIELVKLASGWRFRARAEFTPYLNRLNPEKPPRYSRAVMETLAIIAYKQPVTRGDIEAIRGVSVSTNVMQTLLERGWIEVIGHKDVPGRPGLYATTRKFLDDLSFVSLNDLPPLAELGTLVVPDTQLQDDSPDAGADDLPLDDEADNLEPVAE

SEQ ID NO: 7983 - protein, 172 aa, Chromobacterium substugae
MKIEAASEHHLSAYRRYFQACREADFEYYRGLEDDAGHWLGQVVLHAQGKSLPAGWVPCQTWFLLTGEGEIIGAARLRQGETDVIQDVIGHIGFEVLPQWRGHGYGRVLLQYVQALGSSPACGNWVLVCDADDPAAIRTIEACGGQRLEDMPQPDGRVLRRFSLTSLAGLMD

SEQ ID NO: 7984 - protein, 325 aa, Chromobacterium substugae
MSDTPQAILLMGPTASGKTGLALELARRFPLEIISVDSALVYRGMDIGSAKPSLAEMAACPHHLIDVITPLQSYSAAQFHADANRLIGEISARGNIPLLVGGTMLYYKALLEGLSDLPQADAALRAELDADAARLGWPALHARLAGLDPATAARLNPNDAQRIHRALEVCLLSGRPMSELIAQGKAAAADFRHLPLALVPRERGWLHQRIAQRFDIMLEQGFLDEVSRLRAQYPDLSLDLPSMRCVGYRQAWEHQDGLYDRREFIERGIAATRQLAKRQLTWTRGLDVMPVDAQQQDLAGLLTDAVADFLAGKPPADALRFSGPF

SEQ ID NO: 7985 - protein, 196 aa, Chromobacterium substugae
MTGNRLSNTALAAALLAASIAAQADSKLLGVPLTVQEHSQWCWAGSSKAVLAWYKQTPSQCAIVNWAFGINYACGNSNFNWNSDANSPNNMFGGNGSLQDILTNWGVSNYTVYDYLSWTHVQQDIQANRPFVIRYGWTSGGGHFIVGRGYQTGSGGNYLYMMNPWPGEGMTYASYSSVVSASDHDWTHTLRMNASP

SEQ ID NO: 7986 - protein, 235 aa, Chromobacterium substugae
MQSKSLIAAVLFSLAALAGGPAGAQPAPFSVSSQTAAEAAAAASRGLAQFARQNLLDFGARLPAGFPLDVADGRELPALRIGPGFPVYSVDPQQLLAGNGDISQLMAPTGSWRFVVYLRQQAVGLVTVEQVGGHWEAVSYGAAGLAKSLESLQAAYGNAERSNTRFVRVYQAQSDFLEVSPAGGGKPRFAALASAYASLALKPQAAGAVGNGLMDSADFIEPLRAAVRNNLSRFR

SEQ ID NO: 7987 - protein, 115 aa, Chromobacterium substugae
MSIYRHKQGARLAEAVVSNGLIFLAGQVPENTDADARAQTENVLGQIDALLKELDSDKSKIVDVTIFLASLADYDAMNAAWDAWVPAGHVPARATVEAKLANPAWKVEIKLVAAR

SEQ ID NO: 7988 - protein, 380 aa, Chromobacterium substugae
MTDFHTLAVTAGAHEDPFGAVMPPIYATSTYRQRAPGEHTGYEYSRSQNPTREALERAVAELEGGARGYAFGSGLAAISTVLELLPAGSHLIAVNDLYGGTYRLFEKVRKASANLEVTYVASEDSAALEAAIRPNTRMIWVETPSNPLNQLVDLQQVSAIARRHGLIGVVDNTFASPVNQRPLDFGFDIVVHSATKYLNGHSDVVAGVAVVSRDKPELAEQLAFLHNAVGAILDAFPSFLVLRGLRTLALRIEQHNRNGLAVARWLEAQPWVEKVLYPGLESHPQHELARRQMQGYGGIVSFYLKGDVKAFLAKLKLFALAESLGGVESLVCLPAAMTHASIPAERRAALGIHDNLIRLSVGVEGEAALIADLEQARRDS

SEQ ID NO: 7989 - protein, 456 aa, Chromobacterium substugae
MKDDSVLSLIGNTPLVRVSHLDTGPCELYLKLESHNPGGSIKDRIALTMIEAAERDGLLKPGGTIIEATAGNTGLGLALVAAQKGYPLILVVPDKMSREKILHLQALGAQVRLTRSDVGKGHPEYYQDLAARIAAETPGACYIDQFNNPANPLAHETTTGPEIWRQMNGEVDAVVVGVGSSGTLTGLTRFFRAKAPGTAFVLADPVGSVMADYVETGSFGQAGSWLIEGIGEDFIPPLTDLSMVKRAFRISDQESFDTAQELLRAEGILAGSSSGALLAAALRYCREQTEPKRVVTLVCDSGNKYLSKMYNRDWLVDQGMLSLPVVGGLTDLIVRRHQDGSTVSCHPDEALSVAYQRMRLHDVSQLPVLKDDKVVGILDEWDLLLSVHGEPENFRQNVDSAMSSHVQTLSPQASLQDLLQVFNAGHIALIVDKGRYLGLITQADLLAFWRRQPRAA

SEQ ID NO: 7990 - protein, 275 aa, Chromobacterium substugae
MQLAETQADLPYIHGFSAAEQARLVRQARFSEAMVYRDVDFSGVERLLEVGCGVGAQTEILLRRYPELAITGIDFSQRQLAVARQRLQGSPYHERVRLQHMDAEDLDFAPASFDAAFLCWILEHVHAPERVLAEVRRVLKPGARLYATEAMNASFFLAPYSPNLQQYWLAFNDHQLSVGGDPFVGAKLGNILQRLGFRQVETQVKTWHLDSREPHRRQLVLDYWTELLLSAADQLIEAGRVDSQLVETMTRELRQLRSDPELVFFYSFMQASAVV

SEQ ID NO: 7991 - protein, 405 aa, Chromobacterium substugae
MYLNTGRIEYMNLNWLNGLLDLPWWGNIVAALILTHITIASVTIFLHRHQAHRALDLHPAPSHFFRFWLWLTTGMVTKQWAAIHRKHHARCETLEDPHSPQVLGIKKVLWEGAELYRAACKDQSIMDKFGHGTPDDWLERNVYSRHNAKGIVLMLIIDLALFGPIGLSIWAVQMVWIPFWAAGVINGLGHFWGYRNFENEDASTNLVPWGILVGGEELHNNHHTFGTSAKLSYKWYEFDIGWMYIRILEMLGLATVRKVAPQLAQDPSRPQLDLEHLQAIVANRYAIAARYARELRDEYHAELGKLSLPELPQVNLPRKMKIWLKQDAKDTPEDERLQLARLLEQSQVLATIYNMRQELTRLWERSNLSREQLLKELQDWCARAEASGIAALQRFSLSLRQAALA

SEQ ID NO: 7992 - protein, 40 aa, Chromobacterium substugae
MLFLQGVFGFDACQVARGCIQDKQATEGGAGNDQSTFWQH

SEQ ID NO: 7993 - protein, 529 aa, Chromobacterium substugae
MLPKRRLIIAGATLGGLFVLYAASSYLAGVKAEDTLQEQHRMLASLPLFKVKSHSYERGWFSSTETTELVFNRHLSGPYENMLPDNMKPLLNATIKFTNHVQHGPLPGLSGFHFRPGWALVKTEFAMSDSTRKTLKTFFGDKEPITITNHIGFSGGGLLDVNVPAFDYEEALSGVKMKWKGFDLKVDYANGYKEYKTEALSPGFLLEAASKGTVSFEGVRYLSDMRPGNTDIKLGTSELTIGNVQLSSRESVPYSIKLNELIYLMTRVRVGEFVNPSGEFKPSSVALKNFSYQIVTSEQDDFINSRGKVNFAELSFNANRYGPLRLDVAVNHLHGRTLAQLDKAIGQIPFEGVDPAVLRRQYVDTLKRNIGPLLENSPKVLINEFYLKMPTGEATLQASAGIHGFTSADLNDFTQLAKRFTVEAKASLPRQTLENLVQTQFRNLFTVDHTAEDQPNMQEVDDLAKSLLDSQLAQWKAQDYIVEENGQISTELNYSAQGLTIHKKKVALPWEESEEPTDASAPAASPAKK

SEQ ID NO: 7994 - protein, 158 aa, Chromobacterium substugae
MQGDKKVIKYLNQILRNELTAINQYFLHARMFKNWGLKKLNEHEYEESIDEMKHADKLIERVLFLEGLPNLQDLGKLHIGETPHEMLQCDLKLEMEALPLLREAIAYCETAKDYVTRDLLEDILESEEEHVDWLETQLDLIERVGIQNYLQSQMDDAS

SEQ ID NO: 7995 - protein, 58 aa, Chromobacterium substugae
MTDSQIRQAVHAGASRMCDLRRELGVASDCGKCACMANQVRKDAQAELAVCSVARTAA

SEQ ID NO: 7996 - protein, 155 aa, Chromobacterium substugae
MIVNNLQREWKPNATVAAIVERGGRFLMVEEDTADGLRLNQPAGHLEPGETLLQAVEREAREETGWRFTPQGLTGIYLADRPGSDITYLRFAFHGSAAPPQQPAALDAGIVAVHWLSHQEIQAQQARLRSPVVLSCLADYIAGVRYPLDLIRDLR

SEQ ID NO: 7997 - protein, 195 aa, Chromobacterium substugae
MPPCLTPLLLILLCLLPAAARADGLNICYHYRCSRQAYFEISEEARDWLAARLARAGSAAAEREVVSDAVVALYRIAARDTPIWQDKGGNFHDGPAEGRMDCVDHSSNVTAFLGYLDRQGWLKFHHAAPPAWRAPWILDLHYTGVLHDIAAGQDWAVDTWFRDFGEPPVVVPLSIWMKGYEPPAVSAPDASGQQK

SEQ ID NO: 7998 - protein, 358 aa, Chromobacterium substugae
MTGKKRIVVGMSGGVDSSVTAWLLKQQGHEVIGVFMQNWEDDNDDEYCSIKQDALDAMSVADIVGIDMEIVNFAKEYKDRVFSYFLKEYSAGRTPNPDVLCNAEIKFKAFLDYAMELGADCIATGHYARKLEKDGTHYLMKAVDHTKDQSYFLYRLQQHQLAKAMFPLGDIRKTEVRKLAEEAGLPTAAKKDSTGICFIGERPFREFLKRYLPTSPGAMVTPDGKTVGEHIGLMYYTLGQRKGLTIGGSRDGNGEPWFVAGKDIPGNRLIVVQGHDHPLLLKPTLSMADLSWTLPDAPKPGDYSAKNRYRMADAGCSLSPIVDGQASLTFREKQWAVTPGQSAVLYDGDICLGGGIIQ

SEQ ID NO: 7999 - protein, 416 aa, Chromobacterium substugae
MSAPASSALPSAVLAAASAAGKLQAGTPAFRSTSRAMFVGGFCTFAMLYSTQPLMPVFAHDFGLTPAAASGAVSMATGALAISLIPASLLSDRFGRRALMNGALGLAALLMLLSVFVDGFGPFLFLRALFGVALAGLPAVAMAYLSEEVDGKSLGHSMGLYIAGNALGGMCGRFLAAVLADHFGWRGALLALALLGCAGAWLFWRWLPPSRHFQPRRQDFGRLRRELAAVARDGGLPWLFLAAFLLMGCFVSLYNYLGFRLLAAPFGLSQSALALVFSLYVVGIWASAWVGRLADRLGRRNVLWLMVALMLAGLALTLADTLWLLVPGIALFTFGFFAGHSVASSWVGLRAREAKALASALYLCCYYLGSSVYGSVSGLMWGGGGWLGVAAALAAGLSALLAAALWLRRLQPLSQG

SEQ ID NO: 8000 - protein, 294 aa, Chromobacterium substugae
MELRHLRYFLAVAEELHFTRAAERLHIGQPPLSQQIQALEAELGVALFLRHQRKVELTAAGRQFLPRARQILADSAAAIAAARRAANGETGELRIGFTSSLPLTPILHRSLHRYREAYPDVRLTLREMFTAGQFEALEKKQLDLGFVRFNGPTPSPLIQVEELHRDRLLAVLPLAHPLSGAASLALADLAREPLIGYPRESGAGLRDVVLQLARQNGLELNVVQEAGEAITQIGLAAAGVGIAILPSPLECVQIPAVRYVPLSDSDAYLAMGIATRRDETSPLVAHFLAGVAKD

SEQ ID NO: 8001 - protein, 246 aa, Chromobacterium substugae
MDGKVALVTGGSRGIGAATTRLLVAAGWRVAANYRADEASAAALKTELGDAVELFRADASDERAIVRLFDDALCHYGRLDGLVNNAGVTAPMCRLEDYSAERVERVLRVNVLGPLLCCREAVRRMSTRHGGDGGAIVNVSSAASRLGSAGEYIDYAASKGAIDTLTLGLAREVAEEGIRVNAVRPGLIETGIHAASGEAGRVARLAPSVPLRRGGRAEEVAEAIVWLLSDAASFCTGSLLDVSGGR

SEQ ID NO: 8002 - protein, 294 aa, Chromobacterium substugae
MQQQIDTLVVAGVGLIGGSFALALKRAGRVRRVIGVGRTLANLERALALGVVDEISQDIAAAAPRADLVLLASPVGQMGALMAALAPGLRPGAIVTDGGSTKSDVAALYRRHLPDHLPWCVPAHPIAGSDMSGAVAAQYGLYENRRVVLTPLAETAPEAAETVAALWRACGAEIHSMSAAEHDAVFASVSHLPHLLAFAYVDRVAAKDNAERCFDFAATGFRDFTRIAGSHPEMWTDISLANRDALLAELADYRAGLERLSAMLAGGDAAGLQQLFSEARGVRTRWHQQFLRRG

SEQ ID NO: 8003 - protein, 87 aa, Chromobacterium substugae
MKPTLYCYFKVGADRGALLEQLRALHAELAAAGWPGQLLRRCDDADTWMEVYPDIDDRDAFLAAWLAARRRHGLESLAAHQEWFQPL

SEQ ID NO: 8004 - protein, 407 aa, Chromobacterium substugae
MEGRQAGQADKRLPVKLILKLLAGMALGIALGLCAPAPLLSLLLTFKGLFGQFIGFMIPLIIVFYIMSGIAALESGSGRMLGWTVGLAYASTVLSGALAFAAASTILPQWVGEAAAAPAAAAQAAPLFKLEIKPLFDVMTALMLAFVFGLGIAATGAARLREIAEQGKDIVEKVLARVLVPLLPAYIACVFAEMAAAGSALDTLKTFGAVLLLAIGLHALWLALLYGASGLLLGRNPFALLRAMLPAYFTALGTMSSAATIPVALRSAGAMKVSAPVGNFVMPLCATIHLCGSTITLVSCATAVMLMTGGLAVPGWEVMLPFILLLGVTMVAAPGAPGGGVMAALGILSSVLGFPEASLALMIALYLAQDSFGTACNVAGDGVIALWVDRLAGRAGQGCAAAAPQRG

SEQ ID NO: 8005 - protein, 270 aa, Chromobacterium substugae
MAMLVNGLPAEAVSALDRGLAYGDGVFRTLQLRDGRPRLWRWQYARLADDAARLALPLPDEQLLLDELAALGREHPLAVGKITLTRGVGARGYAMAAAGEPTRIVSAAPWAGYPEEYGERGVSARWCELRLSLQPRLAGVKHLNRLESVLARSEWSDPAIQEGLLLDQDGWLAEGTMSNVYLLRDGVIHTPLLDCCGVNGAVRDWLTENVSSFGLEFTESRLSPADLIDADAVFLSNSLIGLWPVARLGDRAWTPSPLLQTLRQALLQQA

SEQ ID NO: 8006 - protein, 430 aa, Chromobacterium substugae
MFTQKLDFIPDLLALHAADREHFPYLMQSSGDSGWDLLLMQSERRVFMAGEGQAFLDALRAFRPQPVSNPHELPFVGGWFVYLAYDLLSEFEPHVPAALPDSFPLAVWARTPAAVLVDRAKNEAWLVGESADDWHALERLVARQPDFQPRLVALAALEEDPPEWYTEAVARLKRYIYEGDVFQVNISRGWRAELADGIAAPDLFAALRRANPAPFSALADFGDAQIVSSSPERLVRVRDGWAETRPIAGTHPRSKDPAEDAELKKRLISSVKERAEHVMLIDLERNDLGRISRPGTVEVNELMAVASYAYVHHIESNVRGKLRDEVAPADVLRALFPGGTITGCPKVRTMQIIRELENSARRAYTGSLGYLNRDGTMDFNILIRTFMQEGNKLRFRAGGGIVADSDPERELQETRHKARGLLRALGVEQA

SEQ ID NO: 8007 - protein, 413 aa, Chromobacterium substugae
MSKRRVVVTGLGHVSPVGNDVATGWANLVAGKSGIAKITRFDASDMACQIAGEVKDFDIAQYISPKEARRNDLFIHYGIAAALQAVTDAGLDDIPGLDKTRVGVNIGSGIGGLPLIEETGVALMEGGPRKIGPFFIPGSLINLIAGQVSILKGYQGPSYGIVSACTTGAHCIGDAARLIQYGDADIMVAGGAEGAVSRLGIGGFAAMKAMSTRNDDPAAASRPWDKGRDGFVMGEGAGVLVLEEYEHAVKRGARIYAELIGFGMSSDAHHITAPSAEGPARGVANALRDAGINADAVQYVNAHGTSTPLGDANETQAIKMAFGDHAKKLVVNSTKSMTGHLLGGAGGVEAIYTILAIHKQVSPPTINLVEQDVESGCDLDYVANTARDMKIEVGISNSFGFGGTNGTLVFKRV

SEQ ID NO: 8008 - protein, 80 aa, Chromobacterium substugae
MENNIEQRVKKIVAEQLGVNEAEVKNESSFVDDLGADSLDTVELVMALEEEFECEIPDEEAEKITTVQHAVDYVNANLNK

SEQ ID NO: 8009 - protein, 245 aa, Chromobacterium substugae
MSLQGKVALVTGASRGIGAAIADALLAEGAVVIGTATSESGAAAIHERLSAKGGAGRVLNVTEDGAVEALIESVEKEFGAVAVLVNNAGITRDGLLMRMKDEDWDAIMDTNLKSVFKASKAVMRGMMKARSGRIVNIASVVGAMGNAGQANYAAAKAGIIGFTKSMAREVGSRNITVNCVAPGFIDTDMTRALPEAQREALVGQISLGRLGDAKDIADAVVFLASDRAAYITGQTLHVNGGMLMP

SEQ ID NO: 8010 - protein, 309 aa, Chromobacterium substugae
MAFAFLFPGQGSQSLKMMDGFADLPVVQHTFEEASDTLSLDLWAMLQADSADAINATVNTQPIMLAAGYATYLAWQELNGKQPSVVAGHSLGEYTALVAAGALPFAEAVKLVRLRAEAMQAAVPVGVGAMAAILSLSDDDIRAACAEAAQGEVVEAVNFNSPGQVVIAGHKAAVERAMELCKARGAKRALPLPVSVPSHCALMRPAADRLADALRDVHLNAPAIPVLHNADVAGYNDAEQIRDALTRQLYMPVRWTETIQKLAADGISLMAECGPGKVLAGLAKRIDGDVKCLALTDRAALEAARDQLA

SEQ ID NO: 8011 - protein, 319 aa, Chromobacterium substugae
MGYSRILGTGSYLPSQVLTNAQLAERVDTSDEWIVSRTGIRARHIADDQHKTSDLALMAANAAIENAGIDKHEIDLIIVATTTPDMIFPSTACILQEKLGLPGIPAFDVQAVCAGFIYALSTANAYIKSGMAKKALVIGAEIMSRVLDWDDRRTCVLFGDGAGAVVLGESDEPGILHAKLAADGRYQGLLNTPAQISGGKIQGIPYLHMDGPAVFKFAVKSLSDIAVSTLKEAGVDKAAVDWLVPHQANLRIIESTAKHLGLDMARVVVTLPSQGNTSAASIPLALDVAVRDGRIQRGHTVLLEGIGGGFAWGAVLLTF

SEQ ID NO: 8012 - protein, 291 aa, Chromobacterium substugae
MRERILIQHATQVVGMDEAPQLALKNKKDSSMRVAINLVKEGKAQAAVSAGNTGALMATARFVLKTIPGIDRPAIAKLLPNVKGTSCVLDLGANVDCTPEQLLQFGIMGSELMSCLQGRSHPSVGLLNIGSEDIKGNDNIKKTAELLRQSELNFYGNVEGDDICKGTVDVVVCDGFTGNVALKTAEGLAHMFAVFLKEEFGRSWWTRLCALAALPVLALFKKRIDPRRYNGASLLGLRGIVVKSHGGADVTGFRYALAQACEEAGSDVIGHIAERVANQLNNLKQSEAEAN

SEQ ID NO: 8013 - protein, 59 aa, Chromobacterium substugae
MAVQQNKKSPSKRGMHRAHDFLTAPALAVEASTGEAHLRHHISPNGFYRGRKVVKTKGE

SEQ ID NO: 8014 - protein, 301 aa, Chromobacterium substugae
MEHHGAAAHPLEHLHAVFKAAGLADLLAVQQGDLVGADDQGVAVLARQRLRLGASQPHGGFERGFAGQRRFVADGRLGAEWQAEAGDDLLAIARSGGQYDLHGFGVGLRQGRAPGRALPSLPCFFQIRGLHARFMSKPILIDPLKFAREGRSQSGLVPVCELDERVHSDLSDTSGEVSYQLTGFRDELQRFALRIQLDAKLQVTCQRCLDGMPFSLATDSVITLFASQEKLDEACEQDEELDAILAEPELNAIALIEDEIIMGLPHSPKHDECSRDTLSLAKADKPNPFAVLAALKRPKSE

SEQ ID NO: 8015 - protein, 234 aa, Chromobacterium substugae
MSGTLFLIPAPLGDENVAWLPEGERAKVIHITHFVVEAEKTARKHLKALGVTAPIRELAMSTLNEHTKEADVAALLAPLQAGHDVGLISEAGCPAVADPGAQLVALAHRHGIRVEPLIGPSSILLALMASGANGQCFAFHGYLPVDAAEKAKLVKELEQRSRQRNETQLFIETPYRNNALLQQLRETLAPSTRLAVACDLTLPTQTIVSHRVQDWPQNPPDLHKRPAIFVIHAA

SEQ ID NO: 8016 - protein, 402 aa, Chromobacterium substugae
MPKNTPIIQSLLDTDLYKFTMLQVVLHQFPAAHGEYEFKCRNHPDTPLTQLKQQLETQLDHLCQLRFSQDELDYLRGLRFIKSDFVDYLELFHLQRRFIEVAEEGEQLAIRIKGPMVQAMFFEIFVLAIVNELYFRPLDNQKVREEGRRRLEAKLAELERFQREEAAEQRFPLLIADFGTRRRFSRDWQEHVVERLNAALPEIFRGTSNVHLARKLGITPIGTMAHEFFQAFQALGVRLRDFQKAALESWVQEYRGDLGIALTDVVGMDAFLADFDLYFAKLFDGLRHDSGDPYIWGEKAIAHYRKLRIDPASKMLTFSDGLSVDSALQLHRHFSPHIQVSFGIGTHFTNDMGLEPLQIVLKLVSCNGQPVAKLSDSPGKTMCSDETFLAYLRQVFRIAAPQ

SEQ ID NO: 8017 - protein, 284 aa, Chromobacterium substugae
MRTLTVIGPGRLGSSLARLARLSGQFEVVDVMARRMPPLLRACEFIGAGRAVSDMHQLAAADLYLLAVPDAAIAFCARALAAAGVVPAGSVVFHASGAGESALLRPLAEQGAHVASLHPAFSFADPERAVAGFAGTLCALEGDEEACSRLEGFAAALGGRPFRLGPGGKAAYHAGLSVASNFLVALLEMAEGLTRQAGVPDGLAADLLGGLMRQTLENALLLGPHAALTGPIVRGDVGTVERHLSVLEDAELASAYRALGRQAVALAGDRLPAQARQQLMALLY

SEQ ID NO: 8018 - protein, 380 aa, Chromobacterium substugae
MKKSLIALLVATLPAAAFADVTIYGKIKGGVEYNDNGVTKQTNIDDLGSRIGFKGAEDLGSGLKAIWQVETGFGIDGTGTGSSSGTFANRNSFLGLQSNLGTLRFGNVSNFLDSDMGTVDTWEYNSNALGLGIFTRDATRLKNSVRYDLPAVVPGLTAALQYGAKETKGQASADRETYNLGLGYENSGFFGKYNYSHESKAVSSVAVVVDKATGKIESVGVVDANHTAVASFAQNDTANEKHRLEVGYNANNLFVGFGYQQAKGGLDVVGSAWGNQVIAGFAVPNGQTISANGKVKTREYALTAGYTFGAITPKFTYAHGDKVEVGGVKLDNTQYDQYVLGADYAVSKRTTIGAQYGQIAVKGTGNNDLKSFGLNMVHAF

SEQ ID NO: 8019 - protein, 216 aa, Chromobacterium substugae
MQTRRTQQSRRESTIGKLVEAAIECLMECGYHGTSVQLICNRAGVSQGALFRHFATKNELMQPVGRKVVDDIFEAGLALAGKLPPGMPEEERIVALMKALVMAPRHIVLLELLMAARTTPDLREIFLGNASIYFRDRFVAMMASLFPRYAISTGFFATLLTMMTTMHGMALYRTLSEHPDGDKMREQWLQNALRSELERIRLEGADSRNPVYQLPF

SEQ ID NO: 8020 - protein, 527 aa, Chromobacterium substugae
MKTINALLLAAWLPALAVAAKPLTVCTDANPEGFDVVQYNSLVTTNASADVLMNRLVEYDAASGKLKPGLARSWEAGADGLSYTFHLRPGVSFHSTEYFKPSRAFNADDVAFTFERMLNPDNPWYKTAPTGYPHAQAMQFPKLIKAVRKLDAQTVRFELNYPEATFLSSLTMGFASIYSAEYAGQLLAAGKTADLNSKPVGTGPFVFKSFAKDAQVRYLPNPAYFGGKPKVSALIYAITPDSAVRLQKLRAGECQIALSPKPQDVQAAQGDGKLRVWQAPAFMTAFVAFNSQKKPLNSPLVRQAINLAFDKASYLKAVFGNTAVAANLVYPPNTWSYDKAIKPYPYDPAQARKLLAQAGYPNGFDVGIWVRPGGSTLNPNPKAGAEMLQADLAKVGIRLQIKVLEWGELIKRGKAGEHEMLFMGWAGDNGDPDNFLTPQFSCSAVQSGTNFARYCDPRLDKLIADGKKTSDFKARAKLYQAAQKLIHEQALWLPLAHPTAFSLARKDVSGYAANPYGRVDFSAVSLK

SEQ ID NO: 8021 - protein, 649 aa, Chromobacterium substugae
MLEALGLPLWIFDIDHKRVFWANQAALRVWGARSLAELQQRDMSLDMSVSVAQRLGQYQQDFERENASFVESWTLYPNGRPCVLKVAFRGIRADGRVMMFCEAQNPLSADPASLRSAEALMHTSVPITLYDSAGMALYRNPSARAQVADAGERWRQHFLHDGDWQALQQGVAAVGEARQLARVHTRRGERWHEIAVRACRDAVSGQDALLVSEVDITDLKHAEARASFLANHDVLTGLPNRNGIRSDFLPYLQQALRNGRQAALMFIDLDRFKNVNDSLGHARGDELLVGMTARLSRLLRHDEKAARLGGDEFLVMLAAPDAAGRAEALGRDILQALGMPIRLGGMDISVSASIGISVCRDGTLDLEQMMRHADLAMYAAKDAGRNNLMFFTPALEARTQAQLALESDIRRGLEQGEFVAGFQPRVDVASGKVVGAEALARWNHPQRGLLKPDSFIQVCEDSGLILQLGRQILAQATRQQRLWREMGLDLMVSVNLSPCQFVDPALPAMVAAVLADSGCQADRLELEITESVLLGHDDQTMRTLQALRAQGVSIAVDDFGTGYSNLAYLQRYPLSSLKIDRSFIADLDSTPAIAELIITMCRMLGLKVVAEGVETPKQLAWLRQRGCQEYQGYLCSPALAAGEFHKLLL

SEQ ID NO: 8022 - protein, 224 aa, Chromobacterium substugae
MLGNIVGMSGVSEMGIANFDAFYRSNGSFYGDRPALSLMYFLDKFDVRGGGQGLDLACGQGRNAFYLASLGFSMYGVDESSEAVSRMGELADQRRLSVCGKVVNLADLEIEPQSYRIIVAYTALDHLDAAAGERLAQSMMAGLEPGGYLFAAVFMVDDPGCSGRGGDVSETAAYVRHYYRPGELREQFSALAPLAYQEEYALDLSHGRPHHHSMARLFACKQAA

SEQ ID NO: 8023 - protein, 950 aa, Chromobacterium substugae
MSLSALFNRNEFIARHIGPSDDERAEMLAAIGAASIDALVGETLPADIRLNRALDLPAPQPEAEALAALKAVAAKNVVNKSFIGLGYYPVKTPSVILRNVLENPGWYTAYTPYQAEIAQGRLEALLNFQQMVIDLTGLEMANASLLDEATAAAEAMAMAGRVSKSKSTRFFVDSRVLPQTLDVMKTRAKYFGFELVQGHPEEAGNGDYFGALFQYPGEAGDLIDLTPHIAAIKAKGGVVAVAADVMALVALKSPGEMGADIALGNTQRFGVPMGFGGPHAAYFAFKDEMKRSAPGRIIGVSIDAKGKTALRMALQTREQHIRREKANSNICTSQVLLANIAGLYAVYHGAEGVKRIAARIHRLAAIFAHAVQAAGGKLVFDRFFDTVQVDAPKADAIYAAALAAGYNLRRVGKTVLGVAFHEAATEADLAKLIELFTGKQADIAALDAAAQDAIPAALKRESAILSHPVFNVHHSEHEMLRYMKKLENRDLAMNHSMISLGSCTMKLNATSEMIPITWPEFANMHPFAPREQTVGYLEMIAGLEKQLRAITGFDIISMQPNSGAQGEYAGLLAISRYHESRGEAHRNICLIPQSAHGTNPATAQMMNMQVVVVKCDEAGNVDVADLKAKAEQHAANLAALMITYPSTHGVFEQAIKQICEIVHAHGGQVYMDGANLNAQVGLTRPADIGADVSHMNLHKTFCIPHGGGGPGMGPIGLKAHLAPFIANHVVAPVPGAEAGQTAVSAAPFGSASILPISYMYIAMMGAEGMKQATENALLSANYLATRLGEHYPVLYTGANGRVAHECIIDLRPLKAASGVTEVDVAKRLMDYGFHAPTMSFPVPGTLMIEPTESEPKAELDRFIAAMAAIRAEIDQVQNGAWPADNNPLVNAPHSKADIAGDWNRPYSREQGLFPLPYVLENKFWPSVNRIDDVYGDRNLVCSCPGIENYM

SEQ ID NO: 8024 - protein, 128 aa, Chromobacterium substugae
MSNIPAELKYVESHEWLRLEADGSVTVGITAHAQELLGDIVFVELPKVGAALARDEQAGVVESVKAASDVYCPIAGEILAVNEELEGEPELANSEPYGDGWFFKIKPANAADLDGLMDAAAYAKEIGA

SEQ ID NO: 8025 - protein, 362 aa, Chromobacterium substugae
MTAPKRTPLFDAHVAAGAKMVDFAGWEMPIHYGSQLKEHEIVRSDAGMFDVSHMTVIDITGADAKSWLQKLIANDVAKLGFEGKALYSGMLTAEGTVVDDLIVYLTSYGYRMVVNAGTTEKDLAWMESQKAGFDVALQVRRDLAMLAVQGPQAIEKVCSIKPELADAIRALKVFQGLPQDEWFYARTGYTGEDGLEIMVPADQAIAFFHQLQAAGVAPIGLGARDTLRLEAGMNLYGHDMDETVSPLEAGMGWTIAWEPAERKFNGREALEAQKAAGVKMKQVGLVLEGRGVLREGLKVVVEGVGEGVITSGTFSPTLKHSIAIARVPAATGATALVDLRGALTDVRVVKMPFVRNGKKVFE

SEQ ID NO: 8026 - protein, 443 aa, Chromobacterium substugae
MSENSSIQKKGSLGVWMCTALVVGNMIGSGVFLLPASLAPFGGISMLGWLLTSGGAICLALVFARLSAILPREGGPYAYIHAGFGDFAGFWIAWGYWIALWAGNAALAVAATSYMQVFFPILGHNEPLAGAFAISLIWIVTWINSRGARSSGMVAVVTTLLKLLPLAAVTFIGFFHMHPENLAFNPHGKPLLSSLSATMALTLWAFLGLESASVPAGDVVEPEKTIPRATVIGTLLATVLYILSTISLMGLMPADTLAASQAPFADAARLMWGDWGYWAVGFGAVVSCFGALNGWSLMQAHVPAAAAKDKLFPSRFAQRNAAGVPIFGLVLSSALVTILMAMKYAGGDSGVKIFEFIILLATATTLLPYAFCSMALIAIMLMRGKAFAPKDYVAPGFFAGIGFVYSLWALYGSGADTVMWGMLLLMLGLPVYVWQLKERHAAA

SEQ ID NO: 8027 - protein, 298 aa, Chromobacterium substugae
MSKSSYRGRFAPSPTGLLHAGSLSTAVGSYLEARSRGGEWLLRMEDLDPPREMPGAADDILRTLEAFGFEWDGEVVYQSRRHERYRAALLQLAASGHAYACCCTRKEIAAAARRGLDGYVYPGTCRNGCPGGREGRAWRLRAPDRDVSVMDRLQGECRQNLAGDIGDFVLLRADGFWAYQLAVVVDDAEQGVNDIVRGADLLVSTPRQLQVYDSLGLPPPGYCHLPVLTNAAGEKLSKQTLAPAISGGDAARQLRAALGWLGHPPPAECGRLDELWRWAIANWSLSRAPRGPLILPHA

SEQ ID NO: 8028 - protein, 107 aa, Chromobacterium substugae
MTYVVTDACIKCKYTDCVDVCPVDCFHEGPNFLAIDPEECIDCSLCVAECPISAIYAEDDLPKGQENFLALNAELAKNWPVITEKIDPLPDHADWAEVKDKLQYLER

SEQ ID NO: 8029 - protein, 201 aa, Chromobacterium substugae
MNFPGAMDGNRYYDKHFQTMAVKVFPGEFHATNQRLMLVTLLGSCVAVCLSDRTAGVCGMNHFLLPEGSLDLGAGASAARFGVNAMELLITDMQKLGAMRHRLEAKIFGAANVLEGMTVVNVGERNSQFIRSYLANEQIPVLAEDLLGECARKVYFFTETGRVLIKKLKRSGVAVKAEQPYRGRILEQGEGAKTGDIDLFL

SEQ ID NO: 8030 - protein, 354 aa, Chromobacterium substugae
MAVIRSKIRVVVVDDSALIRSLLTAIINGAPDMEVVATASDPILARERIRETSPDVVTLDVEMPRMDGLEFLRRLMRLRPTPVLMISSLTAAGSETALAALELGAVDFVHKPAEDVARRMPDYAEEIRAKLRMAAAARLRQPMRFPPVPVGMLAGPDAGRALIFVGASTGGTEAIKEFLLGMPANCPPILIVQHMPEHFTFTFAARLDRLCAMRVTEARDGEPAQIGAAYIAPGHSHMRVRPGGPTGYQIALDQGEPVNRHRPAVDALFDSAARHLRGNAIGVLLTGMGRDGAAGLLRMRQAGAVTFGQDEASCVVYGMPKEAVKAGAVMHVCPLASLAFRVVECLQLHGERMT

SEQ ID NO: 8031 - protein, 280 aa, Chromobacterium substugae
MMDETELKFTGSDFRRARDMLYQKAGIALHDSKKHMVYARLARRVRSRGLRSFGEYLDLLQQDQEEGEWQGFINALTTNLTSFFREPHHFEMLREHVRRRRPAGETFRVWSAASSTGEEPYSIAITLLESWRESGGGAFELLASDIDTQALAQAARGVYPLERVVQLAPHLLKRYFDKGAGANEGMARLKRQAREAALFFQFNLAASTWPDIGRFDVIFCRNVLIYFDKATQADILSRMAPCLKPDGLLFLGHSENISHLTEAFAGCGRTAYRLARPDGG

SEQ ID NO: 8032 - protein, 1057 aa, Chromobacterium substugae
MSDMKLKHQLALGFGLLLAALAAALFLAQAQLRGQQARDDDAAAGRLIQAGQLALAGRAQDAGAQLVLRVAGLLAGGDGAQWRAEQPRVDAALEAAMTGLSALTAHAAGDGKPLLEAAREAGLAVRGQIADYRRLAAAAHGDEARIYLRASLWPAAQKYQEAVGRYARFEGEQSLRLAAAEAGASSGRAADGVAVAGAALAALAVALYWLLARALERQLGGDPRVLAMVLRELAGGEVRTAFNVRDGDDSSPFAFLRAAVSRSLENMRLRSALDVCTTNVMIADGEHQVVYANRAALDMFQQAEADIRQELPQFSARAILGCSIDSFHRNPSFQRGLLQDLRGTHRGTIKVGGRTFHLVLTPILDGQNRKLGAVVEWVDATRELERKAEEDARLAADRLAAAENARIRSALDVCTTNVMIADAEHKIIYANGSALAMFRNAEPDIRKDIPSFSASRLLGSSIDEFHKNPGYQRGLLAQARDTHRSSIAVGGRTFGLILSPVVGAKGERLGSVVEWQDNTEMLRLQQEAQQRMDQERAQAAENARIRNALDNCTTNVMIADNERRIIYMNHSVTDMLRSVEADLRKALPHFDVRRLLGTSIDEFHKNPAHQRELLANMRATYRAEIVVAGRTFSLVSNPVFGADGARLGSVVEWKDRTAEVEIEREVAGIVSAASAGEFGKRIDVEGKQGFFRLLSEGVNQLMGVTSQGLADIAGVLGALAGGDLTRSISADYQGLFGQLKADSNATVDKLKEIVANIKDSTDTINTAAREIAAGNANLSSRTEQQAASLEETASSMEEITSTVRQNAENARKANSLAIGASDIAARGGKVVGDVVSTMNEINDSAKKIVDIISVIDGIAFQTNILALNAAVEAARAGEQGRGFAVVASEVRSLAQRSAAAAKEIKSLIGDSVDKVESGSRLVDEAGRTMDEIVVSIRRVADIMSDISAASAEQSSGIEQVNLAVTQMDENTQKNAALVEQAAAAAESLEEQARYLSGAVAVFRLDESGRSGQPPQTRPLASRQPAAWTFAAKGRGPARALEPIRPPRDADDGTWEEF

SEQ ID NO: 8033 - protein, 160 aa, Chromobacterium substugae
MPMDKPNDAQARELLVFTLGDEEYAIDILKVQEIRGYDAVTRIANAPDFIKGVINLRGSIVPIVDLRLKFGLGDPQYNAFTVVIILNLGKRTVGMVVDGVSDVVQLGQEALRAPPEFGASVDTAYIEGLGMVDEQMIIIVDIERLMNSEEMALTDAAARS

SEQ ID NO: 8034 - protein, 702 aa, Chromobacterium substugae
MAIDMSQFHQVFFDEADEHLAGMESLLLAIDVGEPQAEDLHAVFRAAHSIKGGAATFGFSDMADLTHVLESLLDRVRKGGVKLTAQMVDVFLQAKDVLHGMLAAHKGGARADPERAEAVRRRLRDIEDSAGGEPAAAPALVGAAMAPGQERIWTLFLELSPAEGLDMRRLLDSLAAHGDLTVVQQGAAQAGLPWVAVFTSALDAGEVAESLAFMLAPEQFRISVDHGCEEGGGFGLFLSGDAAAAAAEGAGSGFGLFEPPPPARGADIEGEGFGLFAEAPGVVKPAPAAVAQADKGPAAGESSIRVNIEKVDLLLNLVGELVITQSMLVQSGSALDPAEHERLLSGIGALQRNSRELQEAVMSIRMTPIAFVFKRFPRVVRDLAGKLGKQVELKMAGENTELDKSFVEKLSDPLTHLVRNSLDHGIESPAVRSEKGKQPAGKLTLRAFHQGGSIVIDVCDDGAGLDRERILAKARERGMEVHDAASDQEVWNLIFEAGFSTAAEVTDISGRGVGMDVVKRNIQSMGGRIEIDSMLDVGTTISIRLPLTLAIMDGMSVRVGREIYVLPLGCVLESLQPAPGEIKTIAGRGEVVRIRGEYLPIVMLGRHFGVADAGCAATGGILVVVEASGGRAALLVDDLIGQQQFVVKNLETHYRKVDGLAGATILGDGRVALILDIATIVRSHGGQRGPASAVAPAETGAG

SEQ ID NO: 8035 - protein, 121 aa, Chromobacterium substugae
MSKKILTVDDSASIRQMVSFTLKSAGYEVAEAADGKAGLGKALGAQFDLVLTDQNMPGMDGLTLIRSLRKQPAYAATPILMLTTESSDEMKTLGRAAGASGWLVKPFDPQRLLDVVKRLVG

SEQ ID NO: 8036 - protein, 50 aa, Chromobacterium substugae
MGFPLANDSDRCDRRRQACWPGPADGVIGKHGSRAVAVFRRSANPAHHFM

SEQ ID NO: 8037 - protein, 103 aa, Chromobacterium substugae
MRPIVKVEGGIGRIILIGQFDFNLHREFRQAGQELLDNNAVKIIRIDMEQVPQIDSSALGMLLLLRERAAMNRMTMEIVNCQPAVKQVFEIANMSTHFNFQFA

SEQ ID NO: 8038 - protein, 91 aa, Chromobacterium substugae
MRLIGQFDFNLHKDFRQASQELLDNPAVQEIHVDFDQVPFLDSSALGMLLLLKERAAGQKKSMILINCREAVMQVFEIACFNKMFTIRPAS

SEQ ID NO: 8039 - protein, 385 aa, Chromobacterium substugae
MVSSLKDQQQLEAAFEQFNAVSSQLIDAYRQLEVQVNVLNAQLDEANNQLRKQRDENAALAERLALLLKVLPAGVVELSPEGRVIAENLAAEMLLNGCYIGEMWSDFMTGLQRSELDDTYALEQGGESRRLTLQYQDLPASGGRIVLIHDVTRLHQLTSELAQQQKLASMGSMAAALAHQLRTPLASAMLYTANLKQDIPRPEDRARFVDKSLARMRALEGLIQNMLSYVRGQISSLEMVEVAALLEDVCSVMAPQCHDKGVIFDCHLPAESAITVLIDRKALQGALLNLLENALQFTPPGAMVALAVEKLRDGVVFRVDDGGPGVDAAVADKIFEPFFTMRPGGTGLGLAIVKKVAEELGGNVRCYNRTSGGACFELKLPVCRE

SEQ ID NO: 8040 - protein, 317 aa, Chromobacterium substugae
MSELLKKIDARTKLAGTNKLEILLFSLGHDQRTGRKEVFGINVFKVREVMRTPEITSAPEMPSSVEGMVSLRGALVPVIDLAKYAGIVTSNRPEIMIVTEYNGHTQGFLVEAVDTILRLDWSAMRVPPDMITNRMAGLVTAVTELDNGTLVMMMDVEKVLAETSIVDDGHSFINIEPVKEERRIFFADDSAVARKQIERTLEAMNIKYTSAINGMRGWEDLQKMASQAEAAGRQLCDELHLVLTDVEMPEMDGYMLTKMIKSDPRFSGIPVLMHSSLSGSSNQKLGESVGVDSYVAKFEPQKLASKLRQMLKLEPSN

SEQ ID NO: 8041 - protein, 313 aa, Chromobacterium substugae
MPSTDASLLATVDARTKLAGSNKMEILLFSLGTRETFGINVFKVREVSQTPAITKTPNMPFGVEGVLSLRGNIIPVISLAKFIGHDNNGSKFDTMIVTEFNKSTQAFLVDSVDRIIRVDWDKVRAPENIMAAAGTNQNLITAVTELENGKLVSILDVEQILASVVGEPRLPDVPTAQLEIDQYIFFVDDSVVARKEITGVLEKMGIKFQQATNGREAWDRLQVLAGRNWGEGECLHDYLKIILVDAEMPEMDGYVLTKLIKSDQRFKGIPVIMHSSLSSNANRAMGSSVGVDSYVAKFDPGVLAETLIPFLQR

SEQ ID NO: 8042 - protein, 131 aa, Chromobacterium substugae
MSDKNMKFLVVDDFSTMRRIVRNLLKELGFTNVDEAEDGQVALHKLKTQSFDFVVSDWNMPNMTGIELLKAVRADPQLKHLPFMMITAEAKRENIIEAAMAGASGYIVKPFTAATMEEKMNKIFQNMNKPA

SEQ ID NO: 8043 - protein, 246 aa, Chromobacterium substugae
MLENGDSPELEALFESVARQQQDQEPPAAAPAGEETASKMFSSETNPSTMYEHIGQMTRKMHDALRDLGYDKSLERVAETIPDAKDRLAYIATLTENSAERVLNATDIAKPFQDNLERQAQALSERWEKLFANLLSVEEFKNLAAETRQYLKDVPSQTQATNTQLLEIVMAQDFQDLTGQVIKKMMGMVKILETELVSFLIEFSPDEKKGELNSSLLNGPVINPEGRTDVVNSQQQVDDLLESLGF

SEQ ID NO: 8044 - protein, 627 aa, Chromobacterium substugae
MSEFGGMEELLGDFLMESTDLLSDVDNKLVELEKRPEDKALLNDIFRGFHTIKGGAGFLNVIPMVNLCHRTENLFDKLRNGELHITSEVMDVILDATGIVRDMFGTLGQGLMPGDADPRILAALDAALAGEPLTEAAPAAPEPAVQQAAPAAVPAAGSPDWNQLYQAVAPAAAAAAPAAAPAAPVAAAAPAPARVDAPPPAAKPPAPKPAQQAKPSGNAPAASGPQENTIRIDTVRLDMVLNLSGEIGLTKNRLTTLRTEILQGNRDTNTLRSLDEAISQLDLLVGDLQNAVMKTRMQPIGRLFQKYPRLARDLARQLGKEVELVLSGEETELDKTMIEDLNDPLVHLVRNAVDHGIESPEDRVASGKKPQALVQLTAEQVGDHILIEITDDGKGMNPDALRRKAIEKGLIDQETANSLDEKQCLQLIFLPGFSTKDQISSVSGRGVGMDVVRTNIQKLNGRIDINSVGGEGTRISISLPLTLAILPVLVVRACNQPFAVPLAMVREIITIDSGAIQEVSGKPTIVVRDEILPLKTLAGLLGWAPTQKPYFGVLMQSAEKSFILAIDSFVGRDDVVIKPLQNIRPKGVAGATLSGDGSVVLVLDMEDLLASSESNNTTVRTTDVIAT

SEQ ID NO: 8045 - protein, 407 aa, Chromobacterium substugae
MTSNTAFIGRQPVLNRNQQLIGYELLFRPSGDAVGVGKHTELQADTDVLVNTLNNMGTSWLIGNKLAFINIGETMLNSEFLELLPPRRIILDISPRIVPSNELLSRARHLRAMGFGIALDDFSFESPAAAFLELANYVKLDIQNQDTTRFQMLAARLRSYPLIRIAERVETHAQFHLCKELGMDGFQGYYFAKPETLAAKVIHPTFSNTLELLNLLRLDADIRDIEQVLKRDVALSYKLLRYVNSAAAGLNTSISSFSHAVTVLGYQKLYRWLTLLLVTASDDNHAPPALQKTAVTRGRFMELLGITLGERHDVNDNLFIVGLFSLLDVLFDMPMDKIIEHLQLPTPITDALLHERGAMSHYLRLAKACEDGGLDGVPQLCDQLGLSSEQLNQAHISALAWVEELGL

SEQ ID NO: 8046 - protein, 147 aa, Chromobacterium substugae
MSVVRPFSPDDPQRLADIERQAAGHAWSAGQYRDAIAAGYPCYGVFDDSDALQGFMLVMRALDEAEILNIVIAKSNQGQGLGRQLLRHAMLDLAASGCRRLFLEVRESNAPALRLYQHCQFRQCGMRKHYYPTQDGREHAILMEAAL

SEQ ID NO: 8047 - protein, 283 aa, Chromobacterium substugae
MSRNSLLQQTMGLGPAWQPRDGWFEQHPALLLRAQAAALPDAEPETSAPAIDVAPQVAIASIPAETPKAETLREPAQPQPAPEMAPAPAARSEMPLLDWPQLERQVADCQRCRLCETRIQTVFGRGNPKARWLLIGEAPGEQEDRQGLPFVGKAGQLLDNMLAATGLDREQDVYIANVLKCRPPGNRNPAPDEIAACHGYLQQQIRHIQPTLILALGRFAAQTLLQTEESIGRLRGRVHRYQDVPMVVSYHPAYLLRNQPDKAKAWQDLLLARRIFQQTAGRG

SEQ ID NO: 8048 - protein, 51 aa, Chromobacterium substugae
MRDKIKLESTAGTGHFYTTTKNKRTMPEKMEIKKFDPVARKHVLYKETKLK

SEQ ID NO: 8049 - protein, 96 aa, Chromobacterium substugae
MSGFIYVINPAFTGFGSLTMARVCKVTGKRPMTGNNVSHANNKTKRRFLPNLQYRKFWVESENRWVRLRVSNAALRTIDKVGIDVVLADLRARGEI

SEQ ID NO: 8050 - protein, 546 aa, Chromobacterium substugae
MTKYIFVTGGVVSSLGKGIAAASIAAILESRGLKVTMLKLDPYINVDPGTMSPFQHGEVFVTEDGAETDLDLGHYERFIQAKMKKSNNFTTGQVYESVITKERRGDYLGGTVQVIPHITDEIKLKMKEGAADADIAIVEIGGTVGDIESLPFLEAIRQMRSNHGRKNTLYVHLSYVPYIATAGEIKTKPTQHSVKELREIGIQPDILLCRMDRELPEDEKRKIALFCNVEENAVIGCYDSDSIYKVPGMLHAQGIDDIIAEQLQLDLPKADLAVWDGIIDAIQHPDHAINIAMVGKYVDLTESYKSLTEALKHAGIHTRTSVNIIYVDSEEIDRDGADSLKDMDAILVPGGFGKRGVEGKIKAVKFARENNIPYLGICLGMQIALIEYARDVAGLAGANSTEFDLDTNYPVVALIDEWVNHDGKVEKRDENSNLGGTMRLGGQQCDLVDGSLAARVYGNTEIVERHRHRYEVNNYYIQRLEQAGLTISGRSSGHEKLVETVELANHRWFFACQFHPEFTSTPRDGHPLFIAYVKAALAYQADKQGN

SEQ ID NO: 8051 - protein, 280 aa, Chromobacterium substugae
MKLCGFEVGLQQPLFLIAGPSVIESEQMALDTAGQLKEIAHALGIHFIYKSSYDKASYTYGGSFRGFGIDEGLRILSEVKRQIEVPVLTDVHTENEVVQVASVVDVLQTPAFLSSQADFIRAVAQCGKPANIKKGQFMAPGDMSQVILKAREAAREAGLEEDSFMVCERGASFGYNNMVSDMRSLSMLRETGCPVVYDATHSVQLPGNAAASQRHFVPVLARAAVAAGIAGIFLETHPAPARAMSDGLNAWPLARIKELLTTLKAMDELVKQTPWPEHSL

SEQ ID NO: 8052 - protein, 427 aa, Chromobacterium substugae
MSSIVDVVAREILDSRGNPTVEADVLLESGVMGRAAVPSGASTGTREALELRDGDKSRYLGKGVLKAVDNINTEICEAIIGLDASDQTFIDKTLIELDGTETKSRLGANAMLAVSMAVARAAAEDAGLPLYRYLGGAGPMALPVPMMNVINGGEHANNTLDIQEFMIIPVGAQTFREALRMGAEIFHNLKKICDKKGYATTVGDEGGFAPNLESHEDAIKLILEAVDTAGYVAGQDVMIALDCAASEFFRDGKYHLTAEKLSLSSEEFADYLENLADKYPIISIEDGMSEQDWDGWKLLTERLGQKVQIVGDDVFVTNPKILAEGIAKGVANSLLVKVNQIGTLSETLKAVDLAKRSRYTCVMSHRSGETEDSTIADLAVATNCMQIKTGSLSRSDRMAKYNQLLRIEEELGDAAHYPGRAAFYHLK

SEQ ID NO: 8053 - protein, 107 aa, Chromobacterium substugae
MRWLTVTLVTVILALQWPLWFGKGSWLRVWQLDKQLQEQRATTQKLVARNAALDAEVRDLKQGSDAIEERARNELGMIRNGEVFFQLLDPSKNTPLPSHPITDTHSH

SEQ ID NO: 8054 - protein, 604 aa, Chromobacterium substugae
MMAGRLKSTKVWAMTTQNPIEVARETLKQLSTRKLLPTPENFERVYHELTQTPMVRDNKLAVLLLRALETLPQDNVQAKVTLSRLRQALDESRWEQAPQLVIDFLRGSFATQQLSQSWGLLIQNLMRSWETRQPDLPQHHKQSALERVLINYGNQPEELNQKLTALLQNWNAAPSLRETTPQPDGAADAADTGTPAAVSDNWLSWQRTLAFALKHGLEPRLASYPDLVDCLEGLLKELDGVADDASLNAFMPKLRAFMIKLELQSQQEGRLASGLTNLLRLMLDNVAELNRSDEYLLGQVSSLQELLTHEPLSMQQVYQLETSLKEVIRKQGMQKSSLDEAASSLRALLDRFVSRLALMTDSTDEFHAKIQTHSEKLKQTSNVDDLGGIISALMEDTSMMQLDLTRSRDELISAKEQVEAAEHRIHELENALEAASAKVKEDQLTGAYNRRGLAEYFQREIGRAERTAAPLSVALIDVDNFKQLNDRYGHLAGDDALKYLVDTIKHSLRPADIVARFGGEEFVILMPDTPENEAILTVQRLQRELTKTFFLANNDKLLITFSAGVARWHLGEQETDVLERADHAMYQAKINGKNRVCSAEEALE

SEQ ID NO: 8055 - protein, 100 aa, Chromobacterium substugae
MIETLEVEVAYARPDRQWLVPLRLPAGATAAQAAAESGILAQCPELDMATLKLGVFGKAVKPDAPLRQHDRVEIYRALLADPKEVRRQRAAAGKGMKKGG

SEQ ID NO: 8056 - protein, 145 aa, Chromobacterium substugae
MQHVEKSVLVAHTPAQMYALVDDIEHYSRFLPWCGKTEVLSRGEGQVVASLHIDYLKVRQHFTTRNRNVENESIHMELVDGPFESLEGLWRFKPLGDFGCKIEFSLRYQFSSRILEKLIGPVFGHISGSLVDAFIQEADRKYGND

SEQ ID NO: 8057 - protein, 151 aa, Chromobacterium substugae
MSIIQNRKAFHDYFIEEELEAGLVLEGWEVKAIRAGRVQLKESYVDWKNGAFWLIGCHITPLQSASTHVNPDPVRPRKLLLSQAEINRFIGKVERAGYTMMALDLHYSKGNVKANVGLAKGKKLHDKRDTEKDREWQREKQRVMKSHRGAA

SEQ ID NO: 8058 - protein, 116 aa, Chromobacterium substugae
MKRGAALPIALICLGCVWLLKSTALLPNTTTLLALLLFAAGVLLLALDGFNKSTLVTSPMLAYTGAAVYAVDQLGLRVSHFAAVGMVLMGVLMLVARSDGIPERREPPRRLPPGDD

SEQ ID NO: 8059 - protein, 525 aa, Chromobacterium substugae
MDKILILDFGSQVTQLIARRVREAHVYCELHSFDMPIEEIKAFAPKAIILSGGPNSVYESDYQADPKLFELGVPVLGICYGMQFMAQTLGGKVEGGDKREFGYAQIKARHHSKLLEGLQDQIDDAGNGFLDVWMSHGDKVTSLPAGFQVIAETPSCPYAAMADETRGFYGVQFHPEVTHTKRGTEMIHRFVLHVAGCKPSWTMPNYIDEAVKKIRDQVGDEEVILGLSGGVDSSVAAALIHRAIGDQLTCVFVDHGLLRLNEGKMVMEMFAQNLGVKVVHVQAEADFMAKLAGESDPEKKRKIIGAEFIEVFDRESGKLTNAKWLAQGTIYPDVIESAGAKTKKAHTIKSHHNVGGLPEDMNLKLLEPLRELFKDEVRQLGVALGLPHDMVYRHPFPGPGLGVRILGEVKKEYADLLRQADAIFIEELRNTVDEKTGKNWYELTSQAFAVFLPVKSVGVMGDGRTYDYVVALRAVVTSDFMTAHWAELPYSLLGRASNRIINEVRGINRVVYDVSGKPPATIEWE

SEQ ID NO: 8060 - protein, 485 aa, Chromobacterium substugae
MWKSTAAALALLILAGAASAGEQSACDRLLRKLGPQLADASCVESPDLTTRNPNTTPANDSLPGLPPSAFMPQADRDILVADPAHRPSIKKAVPGLQIQARFAKDPLGQARFLLRLPKDWNGRLVVAGASGARSEFNGDFVWSDYVLQQGYAYASQNKGVLSAHASTAADPLACRTGTPDNPHYVHYYDDDPGQEFTRWRDFMVMASDLARRGVEAQYGRKPRYTYAVGASNGGYQVRRAIETAPESFDGGVEWAGTFVDPRGPNLLTGLPPALLNYPDYLASGRSPTSTAALNILAAGYPPDLVADTANGRVSLWGNHHDSFWEPTQCQWQKRLDPGYNTYGAGPDRYNYLARLSASKVGANVAAIATDGKIKRPLITVAGTMDALLPIDLHARAYARQVAAEGGEHAQTYRLYEIQNGNHVERYASLFPQLELVEPHAQRAFDLLVRFVEQKTPLPPGQCVARGGTIGDAPAQPGHCPNLLAP

SEQ ID NO: 8061 - protein, 284 aa, Chromobacterium substugae
MALCHLTMSANARADDNTIRWQMPGNPPVTITDGPDKGQGYADVFLRYFIERAPEYNSVIERASLARVSGLMKQGEHVCQPSLLKTVEREAYMEFSDPVEFVLPYYIVMRSDRTARLKAYRDADGAIDIARLMHDLSLTTVRQEMRGYPPVVLSAFTAAAGQKNILQTSADDVGPFSQLASGWVDYIIAYPDEVYWFARHLKLPTSIKFVYFPIAGHPKYTIGYAACTKGAWGRKIVKRVNEIVAKAGRRPPWIDAEARLLDPEAAKRYEEVYARYSPFRRQAD

SEQ ID NO: 8062 - protein, 435 aa, Chromobacterium substugae
MDANRQAKDNAQSRNSPLIFMPQRGLARRMLVWIICISTTAALIATSVQLFFDYRSDVSELEQGMRYIEQSQLPGLADAAWNFNVAGMQVQLDGIGHSPWVAGATIHYGPSQSAALTTGQLDADAGRLFKYVLRRNGVVVGKIYIEPNLHTLYSRTLDRIGIVLATQGGKSLVTSISILLLISWMITRHLTQMAEFARSFEPGKSFTPFVLRRRPQGLRDELSVLVDGLNDAYARLQKAHEFQVRHNEILSQQVELRTAELLEAHQQLALLAVTDKLTGTVNRRGLDEVFKNAMALADPDSRPLAIILTDIDSFKSVNDSRGHLAGDALLQEFTGILNRVVRATDTVGRWGGEEFLILCPQTTLEQALRLAEHMRASVQAHAFAGIGSKTSSFGVAVLRQGETADDLVRRADEALYQAKKSGRNRVCSEAPDIVS

SEQ ID NO: 8063 - protein, 57 aa, Chromobacterium substugae
MPALFTTALPQGPQLGWRSLPVQALLAGALALLSALMVLILLRRGGEQASQAWRSRQ

SEQ ID NO: 8064 - protein, 434 aa, Chromobacterium substugae
MTDSRSTTLTRADYQTLGLAALGGALEIYDFIIFAFFATTLSKLFFPPHMPEWLRLLQTFGIFATGYLARPLGGILMAHFADRLGRKRIFSLTILLMAGPCLIIGLMPTYTDIGIAAPLLLLALRILQGAAVGGEVPSAWSFVAEHAPLQHRGYALGVLQAGLTFGYLLGALTATILARVFTPQEMLEYGWRIPFLLGGPFGLLGVWLRRWLAETPIFLAMRSRQAEQVSYPLLTILKEHRATLLPAALLTCVLTSAVVVLVVVTPTLLQQRFGMSADHAFGLSSIGIVFLNLGCIVAGHACDRIGHRRSLLLYSLLLPLGVGLLYACLIDGWGWPGLAYAAAGLCCGIVGVVPSIMVAMFPAKVRVSGISFTYNIAYSIWASVTPLLLIAAMPWSPWICVAYCAAVALAGMSCARAARPAREPSLDEALYQRG

SEQ ID NO: 8065 - protein, 39 aa, Chromobacterium substugae
MMKEDNSKRRRGVDRPRQTKLTGWCGRVKPPGQAVHPRW

SEQ ID NO: 8066 - protein, 104 aa, Chromobacterium substugae
MSNAAIAKEKEQLLDDVRQVLASTEELIDAAADDGSAHSKELRKRLSEKLGTAKAKLRDAEVAVVGRAKEAAKATDEYVHENPWKSIGIAAGVGFLLGMLVSRR

SEQ ID NO: 8067 - protein, 130 aa, Chromobacterium substugae
MSEPTRPPRPGTLRSFANGAAALLLTRAELMALEAQEWKDDIVGNLLQGMLGVVLLGCGLIAAVLALWALTPVEWRLAVMACLALLLGGAGAALLLGLRRKLREQPAPFAVTLEEARKDWAALGPGGERP

SEQ ID NO: 8068 - protein, 90 aa, Chromobacterium substugae
MTPQDRALKKQLLVMKGEALRVKLKLEKQKLLEPLRWAGEGFALWRAPGQLGAALDILGKLLPNEKLGRWLKGGGRLLAAWRLFGRWLKR

SEQ ID NO: 8069 - protein, 341 aa, Chromobacterium substugae
MSVITPQSSVSRLDLWQRTSIAAKPSTDAAPSSSSADAQAQSQAARLSTAPNDLQQALNRGWQDYMQKLRVDLNRPAQRQSPQADDIQKKMLKQQADALRQMMMVTRDKASLRALATQLARLARELKDLVSSMTQNAADQQMAVNVGGDQASGGAAASSAAEASAGSDAGSGGDSDAEAASAEAAAAASSAQAAPAAADGADAQQAASGQNTAQEASAADANANAQAPGQTDAQGDSGNVDPQAALRNMLANGNPVAGDPDIEQIRQVLKMVQAFIKQMAQQLQTQKDPNSRDLKDDMKRADKDLEDVDKILKGGPEAMAALNGQMDVNINVSADAGTANA

SEQ ID NO: 8070 - protein, 43 aa, Chromobacterium substugae
MRLRDLAIIAGLAAATKPARPAAEQAVAANMPIGIKKTKLLPI

SEQ ID NO: 8071 - protein, 244 aa, Chromobacterium substugae
MTLTSPPLPPSALAWLAEQDIHSQPQLQARGAVTAFLLLKAAGHTVTRRLLFALEAAARGIHWQQLEESDKAALLRRLAEHPPVSLPPPLAASLDYLRQARELAAQAAAEGEVPVGALVVKNGEIIGRGYNQPIGRHDPSAHAEMQALRDAAARLGNYRLDGCDLYVTLEPCPMCSGAILHARIARVVYGARDAKTGAAGSTVDLFADPRLNHHAAVFGGVDADACAEQLSAFFRQRRQDAAGG

SEQ ID NO: 8072 - protein, 208 aa, Chromobacterium substugae
MRCLLVLLLAGLAHSCLAADDAAALILQAQTAAPLQATHPNARHYGEPWIWVGVRSQTLRLLDGWGRVEKEYAVSTAKNGVGEMSGSYQTPRGWHTVCDKIGAGAAENTIIFRRQVTPWKYTPELHAQYPNKDWILTRILWLCGQEPGINQGGDVDSYDRAIYIHGAGDHVPWGRPSSLGCVRMKNHDVIELFDAAPTGIDVWIDENA

SEQ ID NO: 8073 - protein, 137 aa, Chromobacterium substugae
MHSALTLSTPALLFPAISLLLLAYTNRFLGLAGIIRNLYEEYRDSQDPKILRQIGNLRTRITLIKWMQFLGIGSLFLCTVAMFQVYTGWQAWGEITFGVSLLCMIGSLAVSLLELVRSSDALNILLSDLQAEYERRR

SEQ ID NO: 8074 - protein, 260 aa, Chromobacterium substugae
MNMSPASVATFSLYADLYARYRPSYPEALYGWLLPLCPGYARAWDCATGSGQTAVRLGQSFARVDATDISSNQLSAAEPHTQVYYRECPAEVTPFDDDCFDLVCVSQALHWFHHPSFWPEVRRVLKPGGIFAAWGYHHCVVTPEIDRACSVLWSIIEPFWSSRCQLLWDDFRSSGCPLPLLKAPSFSIVNDWTLEHFLGFLNTTSASKLCKQALGENILDDASLRIARAWGSPSQTRRVELPLHLMVARKDAPQDFPGYG

SEQ ID NO: 8075 - protein, 582 aa, Chromobacterium substugae
MKVHSMPTFTRKLLPLLTLSVLAACGGGGSGSSGSAPSQNNNASARYHVAGQVQKGPFIFGSQIWISELDDKLSPTGKVYMTQTKDDLGNFGIPGSVNTKLVELTGSGYYMNELTGTLSTAPVTLNAVADLSVSKSLTINLLTTLQAPRLKALMAGGSDYQTAYNQSRNEVLAVFGIDPAKVDSLGSLFDMRINGNADQDSILLATSVILSQAAKNQALQANTDTAELSHLISTIASDLANNGKLSSQSLQDQLSVAATQIDLDAVRRNVETYYTKRGIQLVAPKFEEWIDKDNSQTIPRRLVPTSGLSFQDSADANPEQIYSSNAVKISGLKDGQAAILRLNGTGTLLKNDKAVTTDSFVKNNDVIQLKDAAPSFNEEKSNTVQIGSSTATWKIKSASTHLRIDDQNGGLFPAPGVEQAYIFLHQSQFIAFRFTPSADFIAKYSGVDVNAVGGAVVSNLSIYSDNNNNPDQALITSNEKTSLYKKLITGGSVREFIPNSVQYRLGSSGVQLKANKNYWIVLAMTVPDFPMAGLQGGKGKTSQYDGTLKLSKNGTTWCSQPSERDTPCFNNYISPASFWLAD

SEQ ID NO: 8076 - protein, 509 aa, Chromobacterium substugae
MTIIRQDDFIQSIADAFQYISCYHPKDYIDALYQAYLNEESAAAKDAMAQILVNSRMCAEGQRPICQDTGIAVVFLKVGMKVQWDAQLSVQEMVNEGVRRAYNHPDNKLRASVLLDPAGKRQNSKDNTPAVVHFEIVEGDQVEVICAAKGGGSENKSKMVMLNPSDSIVDWVLKTVPTMGAGWCPPGILGLGIGGTPEKAMLLAKESLMDHVDIHELKAKAAAGEELSRVEALRLELFEKVNALGIGAQGLGGLTTVLDVKILDYPTHAASLPVAMIPNCAATRHIHFHLDGNGPAHLEPPSLEDWPDITYDPSNGKRVDLDKITREEVASWQPGDVLLLNGKILTGRDAAHKRMVDMLNKGEKLPVDFTNRFIYYVGPVDPVREEVVGPAGPTTATRMDKFTRQMLEQTGLLGMIGKAERGPAAIEAIKDNKAVYLMAVGGSAYLVSKAIKASKVVGFADLGMEAIYEFEVKDMPVTVAVDSCGTSVHNTGPAEWRVKIGKIPVSAAL

SEQ ID NO: 8077 - protein, 46 aa, Chromobacterium substugae
MNYPAAGASLCLRPAATKNLVLIVTLSVMNFDPGQGATPAILRGAP

SEQ ID NO: 8078 - protein, 242 aa, Chromobacterium substugae
MHYNLHNLFDLDLFGMLHTLICLATAFVSGTVIGLERQYRQRTAGLRTNALVAVSAAAFVNMALQLDGAGSASRVVAYVVSGVGFLGAGTIMKEGLNVRGLNTAATLWGSAATGACAGAGMLGQALLTTLFVLAVNTLLRPVVNSINRRPIDDETSEVTYQLCVIASRDEQKRALAQVGELLEQANYPVGDLDVESFSDDEVEMTATLLATSVDSDELDRIAAALAAHPYISQAYWNTSTSE

SEQ ID NO: 8079 - protein, 548 aa, Chromobacterium substugae
MTNPIKNEAVLDSAHIGDIRGAFGTIRHGDVAARKGIWQRLRTLLAILGPGLIVMVGDNDAGAFSTYSQAGQNYGTSLLWTLILLIPVLYVNQEMVLRLGAVTGVGHARLILERFGKFWGAFSAIDLFLLNALTIVTEFIGITLALQYLGLPKEWGVVAAALLVMAAASTGDFRRFERFSMILVVFSLLLVPVFMMVHPPMAQIGHDLFVPGMPAGGKLSDVMLLIIGIVGTTVAPWQLFFQQSYVIDKRITPRFIKYERADLWLGIVMVLIGAIAIIAMAAALFAGKPEFGNFQDAGAVAAGLGKYHSHLAGVLFSVALIDASLIGASAVSLSTAYALADVLNMKHSLHRKPSDARAFYLVYFLLIAGAAALVLIPGVPLGLLTNAVQTLAGVLLPSASVFLLLLCNDKEVLGPWVNGRWTNLFTGAVAAVLVLLSVILTASVLWPDISSQTIINILVGGGIVGGIVVIAAHTVKLRRDAETGADLAEEAKPSKLYMHNWRMPPLAQLKPMVLSRSNRLWMGVLRGYLVVAVIMVVYKVAEVALLAH

SEQ ID NO: 8080 - protein, 37 aa, Chromobacterium substugae
MARPRHRNGAPAAVRGKRGMRKPDSALRAWRSAVIKQ

SEQ ID NO: 8081 - protein, 298 aa, Chromobacterium substugae
MAMLFPLLAVLIWAANVIVSKAAANVLDPAAISIYRWLVAALVLTPFCLPTVRRRARELKPWLGKFLALSALGMVMFQCLAYYAAHSTSATNMGVITAMVPLLGLLLNAAVFRQKVSAPAWLGVAVSLSGVVYLLGKGDPLGLLSNGINIGDGLILAGAASYALYGILLRRWAPPFGSWVNLYLQASLAVLLLLPLTLTARSMAIPAEGAGLVLFAGIGSSLFAAYLWMHGIQKLGSDRTAIFMNLLPLFTALMASAMLGETIHHYHWVGGGLILLGVAMGQGVLRLRPARREAFVNK

SEQ ID NO: 8082 - protein, 272 aa, Chromobacterium substugae
MLPDQDDYFASDAALPEPAPLTFRYHRFTPKSEFARHRHRWGQLSRINLGLVELLLDDGKVVAPAQYLLWTPPEVPHAAYVRQAMHYISIYVSGDIAARLPAHTCLIEQTPLVRALLDDFAQRRIVSPVDPWDIRQAELLCQRLLESGREASYLPDSGQKLLRPILDAIRHDPSDATPLKAWAERVFSTERTLARLFQRELGMSFGQWRGRARLLEALSRLKQGDSVQDISARLGYATPSAFIAMFQKQLGASPERYRRQLLEGGQWDELSA

SEQ ID NO: 8083 - protein, 471 aa, Chromobacterium substugae
MSKRYRMALVWLRRDLRLDDHAAFYHALKLSEAAAPVFVFDAAILDALPRDDRRVDFIHQSVAALKAELNALGGDLLVRHGLPADEIPKLAAQLGADAVFCNRDYEPAARERDAEVARRLSERGIAFHAAKDQAIFDTDEVLTGAGKPFSVFTPYKNAWLKTLTPFHLQAYPVRRYLDALLPRQAEAMPSLADIGFLPSDLSALPVRAGADGAEALFADFTSRIGRYKTQRDFPGVKGVSYLSVHLRFGTISIRRLAAYAWHDGGEGAMTWLSELIWRDFYQQVLWHRPDVVGHAFKPEYDALPFPNDADWFAAWREGRTGYPLVDAAMRQLNRSGYMHNRLRMVAASFLVKDLLIDWRWGERYFAEKLLDFDLAANNGGWQWAASTGCDAQPYFRIFNPVSQSEKFDPDGRFIRRYAPELARLPDKLIHAPWQAKPEQLRDAGIQLGRDYPHPIVDHAAQRELALALFKR

SEQ ID NO: 8084 - protein, 313 aa, Chromobacterium substugae
MEHFTAMPIFVAVVEAGSFSAAAERLGLTKSAVSKRVQQLEAGLNVRLLQRTTRSLSLTEAGERYYDRARAALALANEAEEAAAGLQGRPQGLLRVAAPMAFGRLHLSPLVAEFLRRYPDIQLDLAMDDRMVDLVEGGYDLAVRIGNLPDNRMVARRLAPCRVVVCASPAYLAAHGAPAHPAELVGHNCIHYSYYRGGASWVFSGPDGEIRVPPRGNYQVNNSEARRDALLAGLGICEMPTFIVGADLAAGRLVEVLSAYPLPAHAVHAVYPQRGLPAKARAFIDFLDEKLGGDAPPWDAGLTASPSAERDPI

SEQ ID NO: 8085 - protein, 156 aa, Chromobacterium substugae
MPSHPLPARPLSDYALAALALSAGALLALMIHCNSRLAAASDPLTASWIAHAAGAFAAWLLWAAWRRPGPAAGPAPRWAYLGGVPGALTVALAAIAVNSPLGLAGTLALAMVGQVLFGLLADHFGWLGMPRRRLGRSDALAALLVLAGCAILIFGA

SEQ ID NO: 8086 - protein, 153 aa, Chromobacterium substugae
MLIVIAAAIANGLCIGGSRAVNGKLGQHRGALAASFWNHLGGLLFLSLLLAASGAMPRLPAHAPWHAWCGGVIGALFVALNSFALPRLGTMKTALLVIAGQMLAGVLIDHLAAGGGKSAPIQLAGAALIALGLFASRRAAAQASQPPTAARQA

SEQ ID NO: 8087 - protein, 127 aa, Chromobacterium substugae
MAGRREGGAKKKERVELISNLLRMGGLFALTALAEIVGCYLPWLVLRQGKPVWLLAPAAASLALFAWLLTLHPAAAGRVYAAYGGVYITVALGWLWLVDGIRPDRWDALGCGLALAGMAVIMLAPRG

SEQ ID NO: 8088 - protein, 165 aa, Chromobacterium substugae
MQLTRFTDLGLRVLMYLTGLEPGQLATIPEIAERFVISRNHLVKVVHFMAQQGWLATSRGKGGGLALAKPPEHYRLGEVVRTLEGLSQLIDCAEPPCALFGGCRLKGALDAALQAFFQTLDGYTLRDIIASPTGEAIIRMHRGLSGAQAEGGPLSSITLPSGSGR

SEQ ID NO: 8089 - protein, 405 aa, Chromobacterium substugae
MLSASTRALVKATVPVLQQHGVALTSHFYRRMFEHNPELKHLFNQGHQHSGQQQQALAMAVLAYAQHIDDPSPLLPVLTRVAHKHVSLGIRAEHYPIVGKHLLASIREVLGDAAGDDLIQAWAEAYGQLAALMAGLENDLYRDTVNADGGWSGWRPFRVVRKEAESEEIASFYLEPSDGGALPGFRPGQYVSVKRFVPEWGLSQPRQYSLSDAPNGEHLRISVKREDAGPGKPAGRMSNLLHREVAVGDVLELSAPQGDFCLNEDGAGPVVLISAGVGQTPMLAMLGQLLRQGGQREIRFLHAARHGGAHAMKHKLRQLAERHARLKLHICYEQPRAQDLAGVDYHAAGRLQLDALRELALLPDADYYLCGPLGFMDVQRGSLLRQGVAPARIHYEVFGSNPSAD

SEQ ID NO: 8090 - protein, 266 aa, Chromobacterium substugae
MAQRGRQNGQQQPLGPGAPVKKASQQSWRNGYAAGSRFAAAWRRRLYFLTLTKGIFMSQTKMESKAGMQPRHGQVFKPESRGQLCVDGVNAQCPLQSWHVNGLESGKFFPAAVAGLMDPLAPTDTPNAAPPADGKIASAGQAHSAVLDEQSAERWAKHPAKSGQEMEFQWSYHARHLTRRWNYFITKADWNPNQPLSRAQFESEPFYKVEMSAQPYWEHSAELMPPEPTIHMMRMPQRQGYHVVLAVWEVADTGNAFYQVIDFDFS

SEQ ID NO: 8091 - protein, 874 aa, Chromobacterium substugae
MRHPLPARPALLGLLIASLFSPLAHAAEAFGSPGDTPVRGPAAKSFVGTAVGSPSKVYFTGYRGVVSEVYYPVLDTPESVDLQFLVGDAGKTFVDEEKRQAYSAGQTDARTMSWIASTGNGGHNWQISKRIFADPNHDTLIQRVTFTALNGHTVGDFNLYVLFKPYLDNAGSGNSAQTVAAAGGYALAASHNSRASALMASQPWKVVNGQPMLSNGFVGQSDGWTDLIGSGDNKMDWTYSSATNGNVAQTGWLDLGDPTATSVSFDAALGFGASQSDAVNSAAASLGSDLTAAQQQYDKAWHAYTAGLSTQGGLADDRYYQAAMTLKTMQDKSNGAMIAGIGTPWGETQGDANQGGYHLVWPRDLFKFANALTTAGDTATATTVVNYLFNTLQQASNCGAAEYNAAGCAAGYSRVGRFPQNAWISGWPYWQGTQMDEQAMPILLAWRLGSAVSNPLWPKIKLTADYIVATGPWSYQERWEENSGYSPSTLAAEIAGLVAAADIARNNGDDASAGRYLSAADYWQQSVAAWTYTTSGSFGNGSYYLRINPAARAGSGADRASFNPSAGPDTPQTLMVKNGGGSHDARRVVDGGFLELVRMGVKRANDPTIVNTINVFDSVLGQNLALPGAPALPYNAWFRYNFDGYGEHNDGSDFNGTGAGRLWPIFTAERGMYEIARQGSAAAGQPYFATLKLLATPEGMLPEQVWSNSAMLPDGWAVSTPAGYLPGAPTKSMAPLNWAMGEYISLLASIHAGRVVDIPQVVCARYNNCRAAPKAGEVPVDINVTASTQWGQQIYVTGNARALGNWNTDLGIPLDAAAYPAWQNGVNLPAGQQIAYKYYRKNADGSVTWESLSGNRSLQTPASGSLSLNDQVSW

SEQ ID NO: 8092 - protein, 110 aa, Chromobacterium substugae
MTPRRAWTAALLLTAAVAGGAVWRLWPAQAPSPPPAVAKPPAAILPTRPIVHQATPAQPWRPPARPALPPVKKGGNSWRPEAAPVAAKVEVQRGAPDMPDAQPLPRPPDP

SEQ ID NO: 8093 - protein, 175 aa, Chromobacterium substugae
MPHREVFALDAAQTEAWLPEMAELLHACVHGGASIHFVQPFTLEQATAFWRDSTLPGVAGGGRVLLAALVDGELAGSAQLDCGTPPNQPHRAEVCKLLVHPDYRRQGVARALMAELEAQARLRKRSLLTLDTASGDHAEPLYLSLGYQEAGRIPGYAWDGRGEKLQATTLMYKTL

SEQ ID NO: 8094 - protein, 742 aa, Chromobacterium substugae
MCLLSFSALLYMGREIYQAAPPIPAMVRDAGGKALFTGEQIRRGQQAWLASGGQQLGTVWGHGSYVAPDWSADWLHREALALREDWARQRFGMAYAQLDIGRQGMLDAELRREMRANGYDAASGTLTLSAARAAAARETARHYQGLYSADPAFDTLREQYAMTADALPSADDRVAVSAFFFWSAWSAAADRPGEAGVSYTNNWPHEPLVGNAPTAANGMWSIASVILMLAGIAAMVWYHMAAGEGEEPAQVPDADPLGRLKATPSMRATRKYFYVVIGLLLTQVGMGAITAHYAVEGHSFFGIPLAEVLPWVVSRTIHTQFGVLWIATAWLATGLYIAPLLSGHEPKHQKLGVDALFWALVFIVVGSTVTGWVGTLQRLGTDFSFWIGNQGLAYTSMGRVWQILLFVGLLFWLFLVARALLPALRDKETEGRSLIAMLLLSAACIGLFYATSLAWGQRTHYSMIEYWRWWLVHLWVEGFFEVFATAVVALIFARLGLIRMSSANRAIVLETMVFLFGGILGTLHHLYFTGASTAVISVGAVFSAFEVVPLALVGFEGWQTYRRAGAAPWVERYKWAILCFVAVGGWNTVGAGLLGFAINPPISLYYVQGLNMTPAHGHAALFGVYGMLGIGLMLFCLRGVSDAQRWDNRLLKPAFWLLNIGLFLMVFLSILPSGIYQAWASVEHGLWYARSPEVVHSALMQNLVWLRVPGDIAFALGVLYLGCFALRLLGWGGKKALAEQRV

SEQ ID NO: 8095 - protein, 813 aa, Chromobacterium substugae
MAMSTRYPALLLVLLSLAGCKESQPKPGTVLDEAKQAKRTVESFPAADEDYFHAMDSGVKLDADEVKGRNTWLVWTGGNDRLWDTLATVSVGNLDLLKTLSSHPGLKFGRDSRWDYLGLVNEPCFEKATGPDPQRFGLWLDHRSANCPKDPFENEQKYPGVALGARGKNLPAGSYYGYATGVVGLRLFPNPAFDEAAAKKWDPKRYYEDPSYYNDKDLIRPYRVGMSCAFCHVGPNPVNPPANPEHPKWENLSSNVGAQYFWVDRIFSWQADPGNFAFQLFHTARPGTLDTSLISTDSINNPRTMNAVYDLVPRLELAKRWGKETLAGGGLDNKQFNDFVKDGPLTQFYKAPNTVWTPRVLKDGSDSVGALGALNRVYLNIGLFSEEWLLHFRPLIGGKTITPIEIKVANKNSVYWQATENQTPDMALFFLKSTDPHKLKDAPGGEQYLSKDAAQLTRGKVVFAENCARCHSSKLPPEVPALDPTQGCAGPDYLSCFNKYWESTKTERFKSEMRKIVLADDFLKDNYLSTELRVPVTLLETNACSPLARNALKDNIWDNFSSQTYKDLPSVGSITVHNPFTGQPWQYKMPAGGRGYTRPASLISVWSTAPFLLNNTVGKFNPSPSVAGRMDSFNDSIRQMLWPETRQKDSVLGDKVPGVIDRTTARSYLRVPIGYLPDSLQELQGPLQRYLPWLFGDDSLEIGPIPAGTPVNLIANLELVLENPSLGERLKHDKKLVSVLLKLIHDLKALPKDASDEEARKVFANLAQPLLELSTCPDFVVNRGHYFGTRYMKGEAGLSDSDKLALIEFLKTF

SEQ ID NO: 8096 - protein, 632 aa, Chromobacterium substugae
MAGMSADSNRSTDYEYIVVGSGAGGGTLAARLAEEGHSVLLLEAGGDPYRLQGGDAWQPDADRLPDDYNVPVFHALASENKAMKLDYFVRHYRNDEQQRRDPKYRAEWDGQRVDGVLYPRSGTLGGCTAHNAMITVYPHNADWDNIAQLTGDASWASGLMRRYFQKLENCHHRPLYRWLGKFCINPTRHGWKGWLQTEKAIPESALGDAGLVDTLLVSLDKAFNEVDVPHSSWRWLLQGQADPNDWRLVRDNAVGVCYPPLATRNHQRNGSRERVIDVAQRFPNRLHIELDALATQVLFDERNRATGVEYLKGEKLYRAFHQPGSGGEKRAARASREVILCGGAFNTPQLLMLSGIGPAAHLQQHGIPVRVDLPGVGQNLQDRYEVGVVNRMNFKHWEVLKGAEFAKGDPQYQQWEQGRKGVYTTNGAVLAVIKRSAKERPLPDLFCFALLGLFKGYFPGYSRLFPEHLNYLTWAILKAHTNNRAGTVTLRSADPHDPPQIDFHYFEEGSAGGEQDLDSVVDGIKFVRTLTADLKKQKLIAEEELPGDAVQTDDELRQFVRDNAWGHHASCSCAIGPREQNGVLDSDFRVYGVHGLRVVDASVFPRIPGFFIVSAVYMIAEKAADAILADAG

SEQ ID NO: 8097 - protein, 886 aa, Chromobacterium substugae
MDSQAETSLSKWQDVLRAERASIAAARQAEDIPRPAGPDGADIPQDAMIGLAFSGGGIRSATFNLGVLQALAKTGWLQQMDYLSTVSGGGYIGSWLSALKRRLRPKETINQTLTDLQGRAPAIQFLREYSNYLTPKTGLFSLDTLSAVVTYGRNLVLNQFVLLCFLTALLLCPHMLVAFAGYAATYPGGDMMSLAVAVLAAIFSARQARDTVNDGLQAAKPAAASTSVALLLIFVYAVSILALSRLKQGNLAWHELSLTPFLLICSPAYALYWAILAHGFTQLNNRGYRRSVCWALLAGLIGGGGLWLMLQALDYLLPVRQEPFLAWHVIGFGFVLLPAAFIMTATAHIGLVKRSFSELQREWWSRLGALLLVSDLALLLVFAMVALALPLVEVADDWIRNAVLPAWLLSTLAAVWQGQSAATSGKEKGDWREWVAKIGPYVFIAGLLLLVSALLSWLLTYFKTTGAQWALSDNPCPDYRCDLTEWASLHFQASHDAGHGGLLYLLLLAASLAVGIFASSRIDINVFSLHNFYRNRLTRCYLGASNRLRSERVNRFTGFCAEDDLAMSELARANPVQRPYHLINTALNLVSGSDLAWQQRKAASFTFSPLYCGYKFPDTAPHPVDVFVRTADYLQDDPSALEAGPMLGSLVATSGAAVSPNQGYHSSPAVSFLLTVFNVRLGRWCPNPNRASAAQLREMSPPVSWRYLLDELFGRTNAESGFVYLSDGGHFENLGIYELARRECALIIACDAGQDENMTFEDLGNAIRKCRIDLGAEIRIDVDSIRIDATTGYSPSCCQMGDIFYASGKRGRLLYLKPCLRGHGAEPVDVLQYKAANPSFPHQSTLNQWFDESQFESYRKLGLCIGETALAELSRPARAPDAADPA

SEQ ID NO: 8098 - protein, 313 aa, Chromobacterium substugae
MLGALRSFEAAGRLLSFTRAAQELHLTQSAVSQQVRKLEERLGYRLFARGSALGLTDKGGALLRTVSAALGEIEQTLARLGADAAPLQLSCVPSFALRWLMPRLTEFQRLAPEVPLRLLAEFQPPDGGMAGADIAIRYDAASHVPPQAVPLLDEYLLPVATPAYLARHPAFAAGESMDGIAMLHDASPWDGAEAFAEWRLWLQAARPDWLPLLGGAQFNLSSLALGMALNHEGVAMARTALVWDELQSGRLVDVFGRWVASPARYALLGRDPSRRETQAFAGWISSACARFDAERERERVRAQGPGPRRRQAG

SEQ ID NO: 8099 - protein, 423 aa, Chromobacterium substugae
MLWLNDQAGVAPMPPRPQAADIESARTRLQRCQGLLARLFPDLSACGGVIASPLLPLAKLQQAQGGDAAREGAWLLKADHALPVAGSIKARGGFHEVLALAEELALRHGLLDAAGDRAALAEPAARACFSQYTVMVGSTGNLGMSIGLIAAALGFRAVVHMSVEAKAWKKDRLRRHGVQVIEHAGDYAQAVAAGRAAAAADPATHFVDDEQSLALFLGYAAAARELAEQLRAAGRAVDAERPLFVYLPCGVGGAPGGIAFGLKALYGEHVHCFFAEPAASPCMLVQLAAGAAAPVSVYDIGLDNRTEADGLAVGLASPLASPLMARLLSGVFTVEDAQLFTGLLQLFETEGIALEPSAAAGLPGPDWICRSAAGRAYLDLHGLAGRLGSATHVIWSTGGSLVPEAEHERFRAEGRRLRDRQAQ

SEQ ID NO: 8100 - protein, 205 aa, Chromobacterium substugae
MSRANHTADTREHLLATGEKIILGKGFAAVGLAEILSSAGVPKGSFYHYFQSKEGYGVELLRRYFLNYDEQLVLRLRPEAGPARDSLLKYFNGWVSQHRCDAQSHTCLAVKLAAEVSDLSEPMREALAEGMGRVISRLADAIRRGQQEGSLCVHLPADELAASLYSLWVGSALLYKVQRSAQPMLNALKLTETMLKVPSAANCGA

SEQ ID NO: 8101 - protein, 246 aa, Chromobacterium substugae
MNETLQLMQQHRSVRSYQDKPISQQTLDAVLDAAWKGPTSINGQQVSLVVVQDAEQRQRIAEIAGGQPWIAQAPVFIAVVIDFHKTRLGVEMAGAQQTIHNSVEAFAVGAVDAGIALGNLMTAARSAGLGVVPIGGIRRDPQAMIELLQLPELTFPLVGLALGHPDQEGSVKPRLPRDSFVHNGQYQAEALPGHIAAYDETLRQYWQDIGRGDGEPWSRNTAGYYRNVYFPKVAPVARSQGFGFDQ

SEQ ID NO: 8102 - protein, 364 aa, Chromobacterium substugae
MQADKLFTPLIMGAVTLANRVAMAPLTRLRNIEPGDVPGPLAKEYYRQRASAGLIVAEGTHISPTAKGYAGAPGIYSEEQVKAWSEVTGAVHEAGGKIALQLWHTGRISHRSLQPNGDAPVGPSAIQADSRTNIRAADGSLVREQCDTPRALEIEEIDDILEDYRRATDNARRAGFDLVEIHGAHGYLLDQFLSPQANVRADQYGGSVENRARFLLQVVDAVVGEWDAAHVGIRISPLGIFNGVSNTDQLEMALYLAEQLAKRKLAFLHISEPDWAGGPKLDETFRAELRKRYPGVIVGAGGYTAEKAETLIKQGYIDAAAFGRSYIANPDLVERLKRNAPLNPPQAETFYGGGAEGYTDYPAL

SEQ ID NO: 8103 - protein, 213 aa, Chromobacterium substugae
MMIPIGIIVKTDGKMNKRKAADSSVPPRERLLEAAGELFYNDGIRATGVEAIAARANTTKMALYRHFQSKDALLAEWLRQVIAGYWRAFDAIAAEHAGDPRAQILGWAAFFADDAGAWSHRGCPFINSIAELPDREHVGRKLIAEYKQGQWRRLAGLCRAAGLASPEDTASELMLVFEGAQVAAQNQSIADAGALALRIASAIVERQAQASIG

SEQ ID NO: 8104 - protein, 498 aa, Chromobacterium substugae
MKLSEYAQYDAIGLGQLVARGEVSPQELAETALRACAAVNPHINAVIETWQPELADAAAALERGSPLAGVPFLIKDVGVAMAGRKIEFGSRLAQGFTAAADSILMRRFRQAGLATLGRTTTPEFAWSGTTESALSGPTRNPWNAARGAGGSSGGAAAAVAAGIVPIAHATDAAGSIRIPAAASGVFGLKPTRGRVSNGPILDEAIHGLAAQLGVSRSVRDSAALLDAARGADGGQPFSIAEPAGSYFAQVGAEPGRLRIGVMAQAWGGQRTAAAVLERLAEATRLCESLGHIVEEAALPLGCSWDAFVHASSVLWAANIAVWIDDMAAATGRQIDLSTLEQQTLAVYRTGHGMRGVEIVRALDLRNAVTRSVAAFFTRYDLLLTPTLPELAPPIGSYAADTASMDGHQWTAHVMGGSPFTPAFNAAGVPAMSAPLFQDAASALPVGMQFVAPAGREDRLFRLAGQLERSLPWADRKPAIWAGRDPRAEPACRHDDNRI

SEQ ID NO: 8105 - protein, 42 aa, Chromobacterium substugae
MMTTGFETRYSLGLAAAASGAPPQQKALHAAGGKGSAPRRTS

SEQ ID NO: 8106 - protein, 689 aa, Chromobacterium substugae
MKTRLLASAALLLATQAHAAADPYLWLENIQGKDALQWVKQQNEHTSREVENWQDFSALKQGILSVLDSGARIPAIEKIGGRYYNFWRDAQHPRGLWRSATLDEYRKADPAWETVLDLDQLAKDEKENWVWQGADCVKPRQDRCLIRLSRGGGDAAVVREFDLPAKRFLADGFVVPEAKSEVNWADRDTLYVATDFGKGTLTDSGYPRIVKEWKRGQPLADAATLFEGRQTDISVNADGIDTAGQHYDVISQGTSFFTNDTYLKRDGKWLKLDKPGHVEASFHGAWLLLRPRQNWQVGGHDWKAGSLLAVKVDDYLQGKRDFAALFQPTATTSLGGSAGTRDALILTVLDNVKSRLVEWKVADGKWRSRPVAAPGYGSIDVSPVDGDSSNDYFFTFTDFLTPTSLSLAHIGSDAREPLKQQPAFFDAKPYRIQQFFARSNDGTRVPYFVVARKDLKLNGKNPTLLYGYGGFEVSLTPYYSGTLGKAWLERGGVYVLGNIRGGGEYGPAWHEAALKHKRQKAYDDFSSIAKDLSRRGIADARHLGIKGGSNGGLLMGVMLTKYPQLFHAIVCQVPLLDMKRFNKLLAGASWMDEYGNPDQPSDWAYIKRYSPYQNIRPGTRYPATLFVTSTLDDRVHPGHARKMFAAMKQIGADVRYYERTEGGHGSAANHDEEARIAAMEYAFLWKQLR

SEQ ID NO: 8107 - protein, 1512 aa, Chromobacterium substugae
MSTFRSRIWSRPELRVAVVFVCTMIAVTAAVVFQTGLHQRQQLLSAYQIRLGYVTHTRDAILRNQFDQLARDVRFLSATPPVSGIVRASAHGGVDPQENSTMAAWHSRLASIFSAFLAANPEFSSVRFIGIANDGKELARVERNAQDQVEVTPAAKLQAHGDRDYMQETIRLETGQVYFSDINLGSRHRDAGGNTAVPTIRVATPIRDAGGKTFGIVIINFDARNLLASLFQSIPVELKLYVTNQGGDYLAQPDPSRVFGFEKNLQWRWSDDFQPTTPLLGQPEGLQAYSSPHGTAYVRSINIPFNPAFPNHYCTVYAVLPDEAVAGMVATTRRATLATSLGIFLLIGAVASLYLRKYRQASARQAELAAIVESSHDAIIGCTPDGTVSSWNAGAEKMFLYPAAETLSRKLTELIVPPEIEPLLRELRQDGVQNSFNSSLHTREGLLLDVAITMSPIQSRDNRLSGFALTIRDITDQKATEKRIRELNASLEQQVEARTAQIRIYSALQNAILANAGYAIIATDLSGMITLFNPAAERMLGYRADEMIGRQPLTRLHRQSELAAQAASLSQELSEDIQAGFDAIVARSRHGLSNESQWTYARRDGRLFPVQLTVSTLENEAGEASGYLGIAADITEREQDRRALESARDQLEKAAEVAELGIWRWEINSDTLEWNDRMFEIYDIPKSFRVFGLYYNHWRSRVHPDDIAMAEHKLQGALEGSDVYNPTFRIVRQDGEIRYLQAAALIEYEADGKPGRVLGINRDITSQREQEDWLLEAKAAADSANRAKSEFLANMSHEIRTPMNAILGMLQLLQQTGLDNRQADYTDKAATAARTLLAILNDILDFSRVEAGKLTLDPHPFSIDKLLRDIGVILSANVGDKDVEILFDIDPALPDEIVADALRLQQILINLSGNAIKFTERGEVVLSARLQQQDENRLTIAFAIRDTGIGISAEQCQRIFEGFSQAETSTARRYGGSGLGLAISQRLVSLMGGQLSVASEQGQGSTFSFTIECETAQPPPLAPPAGIVSLHNLSCLVIEDNDTARQTQSAILRSFGWQVDVAGSGEEALAMVAEGRDYNIVLIDWKMPGMDGWETCSRLRAMQSGRHTPVIMMVTAYGRELFAQRQQRDPDLFDSMLVKPVTASMLFDAVADAQASHGEPAPTPIRPANLAPRLSGLRLLLVEDNPTNQQVARELLGHEGAEVAVADCGQAALQAVHDAAPLYDLVLMDIQMPDMDGYTVTRRIRADHPADQLPIIAMTANVMPADREAALEAGMNDHVGKPFDLAQLVEVIQRHTGRPAAPPPAPPPQPRPADGKQTLNSQSAIPRFGGNLQIYRHTLLSFCDEIHSLLRDLEDARASQRRDKAVQALHTLKGLAATVGAEELAALAAAEEKTMRAPEQRWPDNPEPLRQAAQRAEAAAQEEAERLPHGAAPAARADTDAEDLHIGLASLRHMLNTANLEAMHVFEQLRQQHYHAMPGEFDQLSDAIMKMNFAAAARLCADILQRAKVDQP

SEQ ID NO: 8108 - protein, 311 aa, Chromobacterium substugae
MSANLSAEAPAPAFHRGRILVVDDQPSNIMVAHQILQSEHEVFMATSGEQALAFCQNAPPDLLLLDVEMPGMNGMEVCRRLKQEPATQGIPVIFVTGHQSQEQEAACWEAGAVDFVTKPVTPATLRNRVNVHLTLKHQADQLRALAFTDGLTGIANRRYFDAQFDKVWRHCLRHGSSLALIMSDVDHFKKYNDRYGHTMGDECLRQIARTLQLQLNRPYDLAARFGGEEFVCLMPETSLAGAVSVAIKMEAAIRALQIEHADSQPDHTVTLSLGVAAMAPDADSDGRHLMKMADDQLYLAKNTGRGRICAV

SEQ ID NO: 8109 - protein, 384 aa, Chromobacterium substugae
MSSTTILLVEDSATNRYFIEQFIMELGYRCVSAKNGLEAVAYCRDHLPDLILMDVIMPEMDGLQATAELRRMFGEHWVPIIFLTSLNELESVVGGLKSGGDDYLAKPVSFDLLSAKIHVFLRIAEMQNQINQDAVRLEKYFRENEVEQQLALELIERLIGQRTSQPEYVWQYLSPAASFNGDLIIICQPPSGGEHIMLADCTGHGLTAAISALPAIDCFYEMTQAGCGMAEIARGVNQKLHRLLPGGRFVAAALIAIEPEGRRLNIWNGGVPCVLLFNDQAQVIGSCKSSHPPLGILPSEAFDDSMQSLEWRPSQVLVVSSDGITEAKNGAGEMFGLPGVVAAAGKGWPARIGESVLEAVTAHMQGGAASDDISLLVIRHPPPH

SEQ ID NO: 8110 - protein, 233 aa, Chromobacterium substugae
MNQASEKALVVLSGGQDSTTCLYWALRRFGDGNVEAVTFDYGQRHRVELAAAKKIAALAGVRQTVLPIDTFAAIGGNALTDDGIAPETGARDDDALPNTFVPGRNLVFLTFAAAFGYTRGARHLVTGVAQTDYSGYPDCRENTLKALEVALRLGMDSRVELHTPLMYLSKAETVTLAQQVGAMEALAWSHTCYNGEVPPCGRCASCELRAKGFAEAGVADPLVSRCQAEAQGN

SEQ ID NO: 8111 - protein, 339 aa, Chromobacterium substugae
MHACYMMAGAGFEAARQLHAAPGREARPHGHSFRLGVRAEAQYTDQTTLQAAVEAAAAALDYADLNTALAACDDLALARHLADALPHPAAIRLQSAPDRGVMLDGVQALVWLNTSFEAAHHLPHVPPGHKCGRLHGHGFGVRIVADAARCSQDDLARAWEPLRGRLNHRYLNDIAGLDNPTSEVLAQWLHQQLRDALPGLAWVEVRETHSAGSQFDGKRFRIWKEQRFESAMPFDAAGNYTGHSYLVRLMLSGGIDRTMGWLLDFGDVKDRFKPIYRQLDHNPLDKLAGLRSRDNAAVAEWVHAQLSPLVPELARVDLMENENAGVSLHFHQDMRWPLL

SEQ ID NO: 8112 - protein, 211 aa, Chromobacterium substugae
MTTYTVKEIFYTLQGEGRQAGRAAVFCRFAGCNLWSGREEDRAKAVCRFCDTDFVGAGPDGGKFDGAEALAKRIAAEWPQDAGGSPYVVCTGGEPLLQLDAELVDALHTEGFEIAVETNGTVAAPAGLDWICVSPKAGSELKQLAGDELKLVYPQAAQMPESVAHLDFGTFYLQPMDGPDLAANTRAAIAYCMAHPQWRLSVQTHKVVNIR

SEQ ID NO: 8113 - protein, 83 aa, Chromobacterium substugae
MNRNKTLIATAFGAVIAMGALASAPAAAADKDQCFGIAKAGQNDCKNASHACAGQAKTDNDPADFKLVPAGTCQQMGGQTKPM

SEQ ID NO: 8114 - protein, 86 aa, Chromobacterium substugae
MKQSKALIASALGAVIAMGALASAPAAAADKEKCYGIAQAGKNDCASATGAHSCAGQAKMDKDPGDWKYVAKGSCEKMGGSTTVKK

SEQ ID NO: 8115 - protein, 274 aa, Chromobacterium substugae
MPPLPNVCGIGLRAPHYREALETLPPLGWVEVHSENFFDGGTPLAMLRRVAKNWPLSLHGVGLGLGSCPRPDAGHLASLKRLVDELSPASVSEHLSFNHSPSRYVNDLLPVPYTRAALDAVAGHVMETQDALRRPILLENLSSYVEFPGNEMNEGEFLAELVRLTGCGILLDVNNLYVNRINLGTDTRAVLSALPAEAIGEIHLAGYSEREGMLVDTHSQPVHEGVWQLFREVIRQIGPRPTLIEWDLDIPPLAVLQAEAAKAQALLEARHELA

SEQ ID NO: 8116 - protein, 254 aa, Chromobacterium substugae
MNWHDWQSALLEAIADPAQPAPAAELGLRADGLAVYRNNYRVGLIDTLAHSHPVCRQLVGEEFFTALAREYVKTHASHSGNLHLYGASFSDFIAGFEHCRELPYLADVARLEWAAHRSYYAADAEALDSGALAAFAPEQWEQLIFTPLPGVALCAADSPALSIWLAHRDGGSLEGILQRPAENALVFRLRGEVQAQALDPARYAFYAALFAGAALERAIPPALQTDENFDLQAALFGLFQPALLSSIHLQGAPA

SEQ ID NO: 8117 - protein, 156 aa, Chromobacterium substugae
MNKLIQAPVCGYQLLIRCANLLQPLVLLLLRLWIANVFFSSGLTKIADWDVTLALFSDEYHVPLLPPAVAAVMATCGELGLSSLLAAGLGGRFAAAGLFILNAVAVISYPDLTEATRQFHYFWGAQILVLLAFGPGLLSLDRLVQWRLQKRGGAEG

SEQ ID NO: 8118 - protein, 280 aa, Chromobacterium substugae
MSAQKTLVVLAPQPDPQHLADIARLAGGQPTVGEGAARIRAVLPEHRRQAIEQCRRHGYDAAYVDSDKRLGDFGLLVSDMDSTLINIECIDEIADIKGLKPQVAEITERAMRGELDFGAALKERVALLAGLPESALEQVYRERLRLNPGAEALLAACRGLGIKTLLVSGGFTYFTDRLKADYGLDYAYANQLEIVDGRLTGRLTGDIIDAAAKQRLLMATRDALQLRADQVLAVGDGANDLPMLREAGVGIAYHAKPMVSAEADIAIERGGLDAILQLFL

SEQ ID NO: 8119 - protein, 174 aa, Chromobacterium substugae
MQDAKAPDLPQLDTVSFDADLPFQVQEREGDYSPRLQRETRLALRVLAAPGETPDDSNPVLLRLEAKLDLALEVSLLERHPDRPACTPCRLGLSAVAWCDSRAWAPGQALLISLYPNPDSALSLCLNGRVIQCDSQSPQRHLLVADISGSFDLDTHLMWEKWVFRRHRRAILER

SEQ ID NO: 8120 - protein, 324 aa, Chromobacterium substugae
MLIDRFGRAIEYLRLSVTDRCDLRCNYCLPKGFKGFEEPANWLTFDEIERVVAVFARLGTRRVRLTGGEPLLRRNLPQLAARLSALPGLEDLSLTTNGTQLRRHALELKQAGVRRLNLSLDSLRRDCVERITGSDSLPRVLDGLMAAKEAGFAPIKINMVAMRGVNEQDIESMVAFCIEHGLVLRLIEAMPMGDTGRAAQYLDLQPVLQRLSRQFGLSAQAVSLGGGPARYWSSADGAFSLGVITPISQHFCATCNRVRLSVDGTLYMCLGQEEKMELRPLLRAGIDDAGLEAAIRQAIELKPERHEFREQPQKLVRFMSMTGG

SEQ ID NO: 8121 - protein, 42 aa, Chromobacterium substugae
MRVRTACRRRGGWRPYPAAFAVCAACFDECRISSLNKLAGPV

SEQ ID NO: 8122 - protein, 98 aa, Chromobacterium substugae
MYEMKPSILILAAGLALSASAAFADTATNTIVGGALGGAAGAAIGHSVGGRDGAIIGGAIGGGAGAAIGNGYGKSGSREARGDGRYRCRHKHRHHRCR

SEQ ID NO: 8123 - protein, 246 aa, Chromobacterium substugae
MKPHEVRSRAFAMPLTSPAYPPGPYRFYNREYMVITYRTDPDAIQAVLPEPLQADGDIVKYEFIRMPDSTGFGDYSESGQVIPVTFRGVRGSYSHAMFLDDQPPLAGGRELWGFPKKAGRPKLEVCGDTLIGSLDFGPLRIATGTMGYKYQQLDQVALEASLAEPNFLLKIIPHVDGTPRICELVRYHTSNVVIKGAWSAPASLELHPHALAPVADLPVLEVLSARHFICDLTLDLGSVVYDYLQQ

SEQ ID NO: 8124 - protein, 99 aa, Chromobacterium substugae
MNAAKKIRRFLEEGHDPQQMQVLKELAAALEMGRSFDLSQLYDIDMRYFEVAIDLLKDWRFDHHISARSKLLEQLLTEIAPSQQAAPATEERGREKRKG

SEQ ID NO: 8125 - protein, 347 aa, Chromobacterium substugae
MPDQLRVGLMGFGYAGATFHAPLLSATPGIKLAAVASSRAELVRSALPAAQVFPSPEALLTGSEVDLVVIATPNDSHFALASAALAAGKHVVVDKPFTVRAVEARGLALQAEQAGLLLSVFHNRRWDADFLAVRQLLADGVLGRVTHFESHFDRYRPHVRQRWRESAQAGAGLWYDLGPHLLDQAVQLWGLPEAISLELAALRDGAQADDWFHAQLRYADKRVILHASALAADAGPRFIIHGTAGSYAKYGLDTQEDALKAGDRPGQAGWGGDPRPGRLLLAGSEAVERPAGAGDYMRYYAGVRDAILLGAANPVDAWEAWRVMVLLELGCDSAAQQCWKAVAPSLA

SEQ ID NO: 8126 - protein, 902 aa, Chromobacterium substugae
MAESQKKQKKLSLRDQDPFLEREKLKYSNPLPSREFLMQILAEQGVPLFPDELAQMLSIAPAEILYFERRLRAMERDGEVIINRKGAVCVAQKLDLVRCKVSGHRDGFGFAMPDEGEGSGADIFLPEREMKKVMHGDRVMVRPSGVDRRGRQEGRIVEVLEHAVTRLVGRIQRERGVWVVLPEDKRINHSILIEPGGEAGAKEGQVVMVEILQQPDAHHQPVGQVTEVLGNYADPGMEIEIALRKHDLPHRFPDDALLQAKETPKKVRKKDWSKDRVDLRELPLVTIDGETARDFDDAVYAEKKGKGFRLVVAIADVSFYVQPADALDKEALNRGTSVYFPRRVIPMLPEALSNGICSLNPDVERMCMVCDMQINAKGEVKKYQFYPAVMRSKARLTYNQVWDWLQNGSDHPMLPHVKDLYALFKILLAARAKRGAIEFDSVETQMIFNDSGKIDRIVPVVRNDAHRLIEECMLAANVCSADFLLKSGHKALYRVHEGPTPEKLENLRAYLRLVGLTLGGADKPSAKDYAVLAEQIHGRPDAPVLQTMLLRSMQQAVYTQENNGHFGLAYEAYTHFTSPIRRYPDLLVHRAIKAVLKNEKYKPGKWAALGVHCSMTERRADDASRDVESWLKTYYMRDKVGEVFQGKISAVTSFGVFVLLDDVYVEGLVHISELGKDYFHFKKDIQAIVGEKSGMQYRLGDALTVKVMGANLESAQVDFALVRETPVVSETSAASGKTEGDAPRSSRRSRGNRAAPAAEAPEARESKPAGLPAAPKGRSRQTAGRNRAAEAVAAPAAQAVEQGKPAAQAKPVAQAKPVAQAKPAAQAKPAAQAKPAAQAKPAAQAKPAAQAKPAAQAKPAAQAKPAAQAKPAAQAKPAAQAKPAAQAKPAAQAKPAAEANRY

SEQ ID NO: 8127 - protein, 470 aa, Chromobacterium substugae
MQLKIAPGMLTPLIVATALFMENMDATVISTSLPVIALELGVDPISLKLALTSYLVSLAVFIPISGWMADRFGARRIFRSAILVFMLGSLLCAVTSSLHGFVMARFLQGIGGAMMVPVGRLVILRTIDKADLVRALSYLTVPALLGPVIGPPLGGFISTYFHWRWIFLINIPIGLLGLALAGRFIANLKEDEVPRLDWWGFLLTGAGLSMLMLGLATEGKHMLSVTASIWLSLLGGALLLIYLWHYRRQQHPLLDLSLLRLPTFNAGVVGGFMFRVGIGTIPFLLPLMLQLGFGFSPFESGLLTCSTAMGAIGMKTIVAKVLQRFGFRRVLVLNSILAGCSVAVYALFQADTPHWVLLMVFVLGGCLRSLQFTSLNAITFADVDKDRLSQATSLSSVAQQLAAGFGVTVGAFALQAASWLQGHQQLTAGDFGHAFLFMGSLTALSSLLFLSLERDAGQQVSAGHEGGEEK

SEQ ID NO: 8128 - protein, 702 aa, Chromobacterium substugae
MNRLTCGLALTLISAAVLSACGSSSSPSANATSGVVTGSYFRHAKVCLDSNGNGRCDAGEPSAYTDDNGAFSLNGGGALVVEVGTDATRYDPDTGTAAAVTQPLVFRAPANSGGVVSSLTTEVADLMDSNGGDLNAARNAVADRLGVPADKVMADHNKESDPDIKATLKAAINQNIDAIADAVKEAGNGGDIKASLHKRMALSDIKNVVVIYAENRGFDNLYGLFPGADGIPGVNPASRGQYSPQKDFDNSALPVLPPTWGGLTAAGQTVTLTQAQTMNFANKPFQIDDPKGLNGTGVVVPQSVVTRDLVHRFYNNQMQINGGANDKFAAYSDAGGLSMGYYDGSQMAMWKLAQQYTLADNFFMGAFGGSFLNHQYLVCACAPEYPNADTSPAKGSISAIDTDAKGNFLRLTPAANAPASVLSGTAKYLNDGNLTPKDSAGKYYAVNTMQPPFQPSGNAPADKAQYADPSKSTTLPAQSQATIADRLDAKKISWAWYSGGWAASLADRGNIYNGSQPNFQPHHQPFNYFAAFDPAAQADYRNAHLKDFDQSFLADAAAGKLPQVAFYKPQGNLNQHSGYASVADGDAHIASVIAKLQQSPQWSNMLVVVTYDENGGFYDHAQVPKGDRWGPGTRIPAILISPFAKKGYVDHTQYDTGSILRFLTRRFGLKALPGVAGRDAALVRNGGRPMGDFTSALAFDRK

SEQ ID NO: 8129 - protein, 421 aa, Chromobacterium substugae
MHASTPWLLTLSLIVGGALAVSAAASHATPAAKPAYADASYTPGAHPPSAKQLEALGKQLFFDRGLSASGRMSCASCHSPDHAYGPPNGLAAQLGGLDGKQPGTRAVPSLRYLQNVPAFSEHFHDNDGNDSEDAGPTGGFTWDGRADSTHSQAALPLLAANEMANGTAENVARKLQASPVAATFRQLFGKDVFQRPKQAFDKAVLALEVFQQNPAEFYPYSSKYDAYLRGQAQLSAAEMRGLRVFNDPAKGNCASCHLSQRSESGAFPSFSDFGHIAVGAPRNPDIAANRDGHYYDLGLCGPARTDFRNRADYCGLFRTPGLRNVATRKVFFHNGVFHDLRQVLRFYAERDVKPEKWYPAGQNGKLAKFDDLPARYQGNVNMEAPFGGKKGGKPAYGERDIDDMLAFLKTLNDGYQPGKRG

SEQ ID NO: 8130 - protein, 116 aa, Chromobacterium substugae
MTVQRIVANLAAADPARADAFYRGLLGLDLIMDHGWIRTYGADSRMQTQLSFASEGGSGAPLPALSIEVDNLDQVLARAREAGVAIEYGPASEPWGVRRFFVRDPFGTLVNILQHE

SEQ ID NO: 8131 - protein, 431 aa, Chromobacterium substugae
MSKNVVVIGTQWGDEGKGKIVDWLTDHARAVVRFQGGHNAGHTLVVGGKKTVLRLIPSGILRPDVECYIGNGVVLSPEALLKEIGELEEAGVNVTARLKIAEGCPLILPYHVALDQAREAAKGEAKIGTTGRGIGPCYEDKVARRALKVIDLFDSAGFAVKLRENVDYYNFLLTQLFQAEPVSFDDILAQTMLLAERIKPMVADVSRTLYDMNQAGVPLLFEGAQGTLLDIDHGTYPFVTSSNCVAGAAAPGAGVAPQMLNYVLGIVKGYTTRVGSGPFPTEQDNEIGMFLAKRGNEFGSVTGRPRRCGWFDAAALKRSIQINGVTGLCVTKLDVMDGLEEIKLCVGYMLDGQRVDILPFGSDAVTKCEPIYESMPGWTESTFGAKRWEDLPVNAQAYLTRIAEVCGAPVAIVSTGPDREETIVLDHPYGL

SEQ ID NO: 8132 - protein, 383 aa, Chromobacterium substugae
MRNWLLPEYIADILPATARQVESAKAAMLEGFRVAGYELVLPPLIEYIDSLVSEGDVTLDLKTFKLDDQLSGRQLGLRADITPQVARIDAHLLGGRTGVTRLCYAGSVVHSRPSGLTSSREPLQVGAELYGYAGIEADLEIIDLMLSTLEKAGVKKLRLDVGHIAIFRGLAAAAGLAPGVTRELFSLLQNKDVASIAELVAGVAEPYKSAFLALPELYGPASVLDKARTRLPSLPEVELGLMQLAAIARAVQGRVELSFDLAELRGDFYHTGLMFAAYAPGWSDAIARGGRYDNVGRRFGRARPATGFSLDLRDLVRILPERDSSRGVRVAARHLPAAAEEVARLRAAGEMVVVDYLGESAVALNCDRELVPAADGWQLAPFN

SEQ ID NO: 8133 - protein, 293 aa, Chromobacterium substugae
MERMIPAVVAVVGALFVASLSLFTVDQRQFALVFQFGEVVKVISQPGIQFKIPLLQNVRYFDRRVQTIDAEAPELFNTREKKNVLVDSFVKWRVVDVSQFYKSVGSEAAAVARLKQTINDGLRAEFGQKTVADVISGQRDQVMETVRKRADADARKIGVEILDVRLKRVDFPDKISSSVYDRMQSERRTVASQLRSEGAADAERVRAEADKQREVILAEAYSKAQALKGQGDAKAAAIYAEAYGKNPEFYAFWRSMDAYKESFKNKSDVLVLDPSSDFFKYLKNPQAGQSKGK

SEQ ID NO: 8134 - protein, 375 aa, Chromobacterium substugae
MFRNLNQKLARLLGAKPTAGRPGGAGAPPSYKGGALAVVGVLAALWLASGFYVVDAREEGVVLRLGSFNRLTEPGLQWHAPYPFEKVEIVNLTELRSVEVGYRGSAQNRVPEESLMLTADQNIIDVQLSVQYDIKDARAFLFNNAARERDAKDIVKQAAETAIREVVGRNKVDFVLNEGRAQIAAEARKVIQDVLDRYAVGIRIAKVNINDVQPPQAVLAAFDDAVKAGQDKDKLLNEGMAYANEVVPKAKGMAARLQQEAEGYQQQVVARAQGDAERFKQVLSEYNKAPKVMRERMYLDMMQQIMNSSSKVLVDQKGGNNLLYLPLDKLMQMSAPASPAAPQAPAASAPATATPPAAKNGREISRGRDFFGAER

SEQ ID NO: 8135 - protein, 376 aa, Chromobacterium substugae
MFDRPDLGDQAVLVSLDFGDADYQESVAEFAELVRSSNVEILGKVEGKRQRPDAALFAGKGKVEEIAAVVRATGANVVIFNHALSPGQERNLERALQCRVIDRNSLILDIFAQRARSHEGKLQVELAQLSHLSTRLVRGWTHLERQKGGIGLRGPGETQLETDRRLLGIRVKSLKDRLAQVQRQRSTQRKSRTRAGIASVSIVGYTNAGKSTLFNALTKANIYAADQLFATLDTTSRKLFLHHDCSVVLSDTVGFIRDLPHTLVAAFRATLEETVQADLLLHVVDCANETRDAQIDEVNKVLAEIDADGIPQLIVWNKCDLKDLPPEIERGENGEIAAVRVSALKGIGLELLREAIAERVQPSANNHKEPYEHVAE

SEQ ID NO: 8136 - protein, 86 aa, Chromobacterium substugae
MSSKGQMLQDPFLNILRKEHVPVSIYLVNGIKLQGQVESFDQYVVLLKNTVTQMVYKHAISTVVPARPVSIPHEHPAQKQEQAQDA

SEQ ID NO: 8137 - protein, 470 aa, Chromobacterium substugae
MKPTVALVGRPNVGKSTLFNRLTRSRDALVADQPGLTRDRHYGQGRVGEKPYLVVDTGGFEPVVDEGILFEMAKQTLQAVDEADAVVFLVDGRSGLTPQDKIIANRLRQLDRPVYLAVNKAEGMRHAIAGAEFHELALGEPLVISAAHGDGVRELMELVLETFPDEVEEEESRHPKFAVIGRPNVGKSTLVNAILGEERVIAFDQAGTTRDSIYIDFEREGHTYTIIDTAGVRRRAKVNEMLEKFSVIKTMKAIEDANVAVLVLDAQLDISEQDATIAGFALEAGRALVVAVNKWDNLDSEQKDNVRREIARKLNFLDFAKFHYISAIEGRGVADLFKSIDEAYRAAMVKLATPKLTRVLQVALERQQPPRSGLIRPKMRYAHQGGQNPPIIVVHGNALDNIPASYTRYLEHTFRKVFKLQGTPLRVQYKSSENPFDTEEGKEKSRAKPKPMSKMRGREKEVRYGKSSKK

SEQ ID NO: 8138 - protein, 379 aa, Chromobacterium substugae
MRRQLLLTTVLSSMLLAGCASWFEGSSQFQPTPLANIKPLQALDVKWSLQQAGPASSFLPVYDSGNVVSADAEGRIRSVDALSGRVQADVALKRALASGVAVSGDVVLVGSADAKLLAVDRKSGKIVWQQPLTSLMLEAPQIAGDIVVVRTNDARLTGFSLADGKQQWSVGNVLPQLTVRNNGSMRAVGKEAVMVGQAGGRLDIVNPQTGNTLWQGAVATPRGATELERVTDVTSRPAYDGGQVCAVAYQGRVACFEARNGSLLWGREVSSSRGLAMDARNVYVTAEDGSIWAYDRQSGRNLWKNDELKYRNVSGPAMIGRFVLVVDGEGYAHLLSNESGSIVGRSKIGTSGPVNQPVSLGSSALIQGQDGRLAMLNLG

SEQ ID NO: 8139 - protein, 209 aa, Chromobacterium substugae
MAFDLQEQEQIDSLKAFWQQWGKLIGGAVLAVCLGTFGFKGYQWHQKEQSEKAAAAYEAVDSAVAAKDIAKLKSAAQLLQGEYAGTIYASRSALVLAKAAFDKNDPALATSQLEWAAKNGKDEAIQAIARMRLASLHLDQKQYDAAISELNQEHPAAFDAQYLELKGDVFVAKGDNAAARDAYKAALAKLVEESPVRQLVQTKLDALGA

SEQ ID NO: 8140 - protein, 423 aa, Chromobacterium substugae
MSQKYQAVKGMNDVLPAESYQWEYFEGVLRKLLADYGYQNIRTPIVEGTPLFVRSIGEVTDIVEKEMYTFVDSLNGDSLTLRPEGTAGTLRAVVEHNLLYNAAPKLWYMGPMYRHERPQKGRYRQFHQVGVEALGLAGPDIDAEIIAMTADLWRRLGISQYVRLEINSLGNAEERAAHREALIAYLEGHVDILDEDGKRRLYTNPLRVLDTKNPALQEMADNAPKLSDYLGEESRAHYAGWKAMIAALGIEFVENPRLVRGLDYYNRSVFEWVTSELGAQGTVCAGGRYDGLVEQLGGKAAPGIGFGMGMERVLLLLQDKNLLPAQRSVDVYLVNQGEGAGLYSMKLAQTLRAAGYSVVQHLGEASFKSQMKKADGSGAEFALIVGENEIQAGQVVIKALRADIAQQTVAADAVLATLATLKA

SEQ ID NO: 8141 - protein, 429 aa, Chromobacterium substugae
MDSVNIARRLTRQVRVGHVLVGSDAPVVVQSMTNTDTADAAATVEQVYQLAQAGSEVVRITVNSLEAAAQVAEIRRRLDDMGCDAPLVGDFHFNGDRLLKEFPDCAKALAKYRINPGNVGKGAKGDDKFAFMIRTAMEHDKAVRIGVNWGSLDQALLARMMDANSRAAQPLPLPKLMQEALIVSALESAEKAVELGLSPNNIILSCKVSNVQDLISVYRELGGRCDYPLHLGLTEAGMGSKGIVASSAALAVLLQEGIGDTIRISLTPQPGEARTKEVVVAQELLQTMGLRSFTPLVTACPGCGRTTSTFFQELADHIQGYLREQMPVWRLQYPGVEDMKVAVMGCVVNGPGESKLADIGISLPGTGEVPVAPVYVDGQKDVTLKGDNIPAEFTAIVDDYVRTRYGEGGAKRREAPAPRTIPIRPVDAR

SEQ ID NO: 8142 - protein, 318 aa, Chromobacterium substugae
MEKKIEHHDSPMPSGIGARLKAAREAAGLGLGEVADRLKLSLRQLDAIERDDFDALPGATFVRGFVRNYARFLEVDPEPLMQALEQHFPSAVNEVANLVKGTAARETAHEAEEPEPAPAGGGAGKWLALLVVAAALAGGGAWYANRDADSAAKQAGSADNQLAPMLTQQHEASAAQAVAPAADKAASAPVAAAPAPAAQGKPQASAPQAAAKPVAKPVASAAAAVKVAKPAAASAPQAEGSDRVSVNVKDAAWVSVQDANGRRLIYQVMQPGNATEVTGLAPFKVVVGNASQVELNYNGKPVDLSGKIRGTTAKIQLK

SEQ ID NO: 8143 - protein, 236 aa, Chromobacterium substugae
MAFGVSTFAMAAGNVRELAQIRSQLAVEYARIGNLKSALDNANQAVKADPSFITAYVTRAYVLGLLQQNGLAEDDFRQALRLDPANSEANNNYGLFLCEHGRAQDSLALFQKALANPLYDAPQAAYLNLGRCSAKLGQTEQANDYLLGALRLAPDYAPALRELAEMHLGLGNAKLAAFYFGRLRNGGQNGLTAADLWLGARIARKTGDGALEGECANALKNRYPDSRETQLLLSGS

SEQ ID NO: 8144 - protein, 364 aa, Chromobacterium substugae
MKTNLLDFNLDQLTQHFAEMGEKPFRAKQVMRWMHQMAEADFDAMTDLAKSLRAKLHERAVVGVPSLMTGQESSDGTRKWLLDVGTGNGVETVFIPEDDRGTLCVSSQVGCALECTFCSTGRQGFNRNLSTAEIIGQLWWANKAMGVTPKNERVVSNVVMMGMGEPLANFDNVVSAMQIMLDDHGYGLSRRRVTLSTSGLVPQMDRLREECPVALAVSLHAPNDVIRDEIVPINKKYPLAELMAACRRYLEKAPRDFITFEYVMLDGVNDRPEHARQLLELVREVPCKFNLIPFNPFPNSGYDRSSNNAIRIFREILQERGYVVTVRKTRGDDIDAACGQLAGQVQDKTRRQAKWMQIVEDKKL

SEQ ID NO: 8145 - protein, 141 aa, Chromobacterium substugae
MAIERTLSIVKPDAVAKNVIGKIYDRFESAGLKVVAAKMKQLSRAEAEGFYAVHKERPFFKDLVDFMVSGPVMIQALEGENAVLKNRELMGATDPKKADAGTIRADFAESIDANAVHGSDSVENAAIEVAYFFAASEISSR

SEQ ID NO: 8146 - protein, 319 aa, Chromobacterium substugae
MSIITPLGLPNSDEPAILAVFSNTCCTFHPGTMREQNQQQPPADGDNESDLNSKLKKRLWIAGGLVAVALAAIPLMDALTKPKMDMSSDAQSPSSGKIVKPAASSPSAGAIALPKAASAAAEQSSAPAAEPANRAPATPAETSPASPDLSKTPAVANQQASRHAGAPHPAAQNKPAAPEKTPPAATARQPAPPTRNAAAAPQPAAPQPAAQQEAPPAKIAAEAPAKACALAGASAKIAAEAPAKAQPAGSSVGYQVQLGLFASMGNAQKLVKDLQKHGIAAHTVTRVQLGPFKTRAEADDAMSKLRSLGYSPLLAAEGQ

SEQ ID NO: 8147 - protein, 325 aa, Chromobacterium substugae
MWFRQLSFYRLNAESLVDADKLLQALEKRPFQPCMGLDWFSEGWVAPAGHLDAPVYAARGSLMVSMRREDKVLPASVIRDFVDMKVQEIEDKELRKVGRKEKLALKEQVTDDLLPRAFVRSGRTSAYLDIQRGWLMVDSGTASKAEALVSKLREALPPFPAALPRTKLAPHAAMTDWLAAGEAPGGFELDADCELKDSSENGAVVRCSRIDLTSDEIRQHIATGKQATKLGLIWNEKIRFQLTDTLQLKRIQFLDVLQEEASQAGDDRESLFAATFLLMSEELGELVSALVEALGGLEDSQALPALDQPQAEAAPASGSVDVPWD

SEQ ID NO: 8148 - protein, 481 aa, Chromobacterium substugae
MSKHNLTTAAGAPVVDNQNVQTAGPRGPMLLQDVWYLEKLAHFDREVIPERRMHAKGSGAFGTFTVTHDISRYTRAALFSDIGKQTDLFLRFSTVAGERGAADAERDIRGFAVKFYTEEGNWDLVGNNTPVFFLRDPLKFPDLNRAVKRNPYTNMRDANANWDFWTLLPEALHQVTIVMSDRGIPASYRHMHGFGSHTFSLISAKGERHWVKFHFHTQQGIQNLSDAEAEALVGRDRESAQRDLLESIERGDFPRWTLYIQVMTEAQADACPFNPFDLTKVWSHKAYPLIEVGVLELNRNPQNYFAEVEQAAFNPANVVPGISFSPDRMLQGRLFAYGDAERYRLGVNHHLIPVNAPRCPFHNSYHRDGAMRVDSNAGATIGYEPNSQGKWQQQPAFDEPPLALQGNAYHYDFRADDDDYYSQPGALFRLMTPAQQQVLFDNTARAMGGVDEAIQRRHIANCAKADPAYGAGVAKALGLKI

SEQ ID NO: 8149 - protein, 58 aa, Chromobacterium substugae
MQTVSPFPSRHKAGKTAPSPRRRWRRWLGLAIFCAGCLLWLQHGVAPAPRPVAASAAR

SEQ ID NO: 8150 - protein, 259 aa, Chromobacterium substugae
MTTRQPSLFISHGAPTLPIEDSPTRHFLEQLGRDWPRPRAIVIVSAHWEDRALTVNLQPRPDTMYDFGGFPPVLRTLRYPAATDAALAERVVGLLDQAGLPVAATAERPLDHGMWTPLLLMFPQADIPLVMISLHHQAGTAEHYALGQALRPLRDDNVLVIGSGSYTHNLWELSPEGSERAPWAAGFADWMDQALQDNRRDDIIHWQQRAPYPNENHPSDEHFQPLLVALGASNDEAAPVKLHDDWRMGSLSMACWRFD

SEQ ID NO: 8151 - protein, 316 aa, Chromobacterium substugae
MSDDHAVDLSVTWLGRAMPGCLYNASGVWCREEDELAALRASAAAALITKSATLAPRDGNPEPRYHPTPLGSINSMGLPNRGFDYYLDFARRYGDGGGKPLFLSLSGLTLDDNCAMLRRLAEAGLPALPEINLSCPNVPGKPQLGYDFGATAEALDAFDAAYPGLYGVKLPPYFDPAHFAAMAEILNRHRRLAFVTCINSIGNGLVVDVDSEAVVIKPKDGLGGLGGDYVLPTALANVREFYRLLPGKDVVGCGGVKSGREAFMHILAGARAVQVGTCLHQEGPGAFARIAAELAALMRAKGYRRLDDFRGRLRTL

SEQ ID NO: 8152 - protein, 45 aa, Chromobacterium substugae
MPWIVRKNAGRGAERGQDLRARQRKCPAWPGMWSMAANAYICACW

SEQ ID NO: 8153 - protein, 155 aa, Chromobacterium substugae
MQGDPKTIALLNDLLAEELSAADQYFIHAEMYKDMGLNKLFERIDHEREDELEHARALIARTLFLQGKPNVARRVPIQVGEDVPTMLKADLEVEYRVGALLKEVVAHCESVRDYVTRDALMVLLEETENDHAHWLEQQLKLIEMTGLANYQQAQM

SEQ ID NO: 8154 - protein, 589 aa, Chromobacterium substugae
MKRFALIGLPNTGKSTLFNRLTGMSQRVGNWPGLTVDLISARLLLGGKMVELVDLPGINDLTGYSDDEAVVRDVLLAAPFDGAVLVLNASQLDRQLPLALQMIASGLPCLLALNMADEARLLGVSIDADALSERLRTPVVLISAKRMEGWPRLMEGLNRLASRAEPAVHAQLESVPESQQAIDLARRQLDGCWRLPPVLPTLLTEKVDRWLLHPWLGLPLFFAFMALLFNLTYQIGTPLQDAVGGGLDWVKDHALAPALSSVPAILQSLLLDGVWQGVATVLTFAPILFVFFVLMAMVEDSGYLARAAFLTDAMMARLGLDGRGFVMQLMGFGCNVPAILGTRVMRERKQRLLTMLVIPFSLCSARLQVVVFFAGILFSKSQAPWVVSSLYLMTFVAAIVTAWVFKHRYRGDEAFLLEVPPYRLPGARHMLARATGEVSAFLRLASTFILAGVVMVWLLTHIPAGGGKTLAYALGEAMSPLLDPIGIRAELAVALLFGFIAKEILLGSLAVIYGVSEAGLGGALVQHLDWASAMSFLIFTLVYVPCLSTVAAMQRESKSWGFAAMSAGWSVLLAWLLSFAFYQGVHLAR

SEQ ID NO: 8155 - protein, 76 aa, Chromobacterium substugae
MPSLDVFPAGQAGVVASLDLADEVFRRVAAFGLVPGGRFHLLKAAPWGGPLLLEVGATRFLLRRSLARRIQVRAAA

SEQ ID NO: 8156 - protein, 190 aa, Chromobacterium substugae
MSIKSDKWIRRMADEHGMIEPFEANQVKMAADGQKLISYGTSSYGYDIRCADEFKVFTNINSTIVDPKSFDPNSFVEVSGKGYCIIPPNSFALARTVEYFRIPRSVLTVCLGKSTYARCGIIVNVTPFEPEWEGYVTLEFSNTTPLPAKIYANEGVAQVLFFESDEVCDVSYKDRAGKYQGQVGVTLPRP

SEQ ID NO: 8157 - protein, 158 aa, Chromobacterium substugae
MNLYDFSFRRLDGVEQPLAGYRGKVMLLVNTASQCGFTPQYAGLEQLHQRFADQGLVVIGFPCNQFGRQEPGDAAQIGAFCQKNYGVDFTMADKVEVNGDGAHPLWAYLKQQKRGLLGRPVRWNFSKFLVDRQGRVVARFAPFTRPDKLAANIEALLK

SEQ ID NO: 8158 - protein, 93 aa, Chromobacterium substugae
MGLALKTLLAELETQRAGDPDAMAELELVAVRTLEVPLDITACRELRVLAHVFNGDQAELAAAVLRAALADIQEHLDDDLDLLAAHARRCIDS

SEQ ID NO: 8159 - protein, 352 aa, Chromobacterium substugae
MKFSKPGKIMLTIYSESHRLQHGRAELIDGTLKPCFETPSRADMVLAAVRERELGDVIHPRRHGLAPILAVHDDGYVRFLESAWQRWSALGRYHDALPKMWQIRRLRERVPEQVEGQLCYYSMDCGTPLTAGTWPAITAAADCALTGVERLIGGERAAFALTRPPGHHAARDYCGGYCFFNNAAIAAQALREHGLRKVAVLDVDYHHGNGTQDIFYARSDVLFLSIHGDPATEYPFFLGFADEKGAGEGLGYNFNFPLPAGACVSTWFVALDCALEQIARFGAEALVVSLGVDTYQGDPISRFRLDSPDFVTLGARLAGLKLPTLFCLEGGYAVEPIGTNVVNVLAGFEARC

SEQ ID NO: 8160 - protein, 135 aa, Chromobacterium substugae
MKSKKQAKAACPCGGGELSACCGRYLAADAPPAPSAQALMRSRFSAYALGREDYLLATWHASTRPAALDLAEDAGVVKWIALEVLRCEAGLAGDAAGIVEFVARYKVGGKAEKLREVSRFVCEDGRWYYVAGEVS

SEQ ID NO: 8161 - protein, 157 aa, Chromobacterium substugae
MAGMKRQLIAFSLLGSLTACSALQQLGAPVHSGTGASSRPAPSRAADKVDQLLAEANRLADQVKSGALTRTAAADQLGAARLRIAGANPVDNDNFAVYRQLTVDREAGRIDSDAFRSRLEQHLREWMRRWPKYSSKPADPAFTNFLLKLYGLPPLGY

SEQ ID NO: 8162 - protein, 313 aa, Chromobacterium substugae
MRNKTMRIAHTITDLIGNTPLVRLNRVTDGVGATVVAKLEFFNPAHSVKDRIAVAMLDAAEKAGKIGPNTVIVEPTSGNTGIGLAMVCAARGYKLAITMPETMARRQLLKAYGAELILTPGPDGMGGAIAKAKALVDEFPDTYFMPQQFENPANPEIHRHTTAEEVWNDTDGQVDIFVAGVGTGGTITGVGEVLKARKPGVQIVAVEPDASPVLSGGAKGPHPIQGIGAGFVPAILNTGIYDEIIRVKNDDAMQTAREVATKEGILVGISSGAAVWSALQLAKRPENAGKLIVVVIPSFGERYLSTALFEHLA

SEQ ID NO: 8163 - protein, 289 aa, Chromobacterium substugae
MPTQETLIPLAGWRRKLYIVIYEADTRAGRLFDLTLTLAILISVACVMLESVAGVRQRYGTLLSVLDWAFTILFTVEYALRLICVHKPLRYVKSFFGVIDLLSILPLYLGLFIPESRFLADVRILRLLRMFRILKLSRHLSEALELRRALAASRRKITVFLATVILLVIILGTLMYVIEGPEHGFTSIPISIYWAIVTLTTVGFGDITPKTPLGQALASLVMITGYGIIAVPTGIVTAEIARSKPAANADNQSATRLCPHCFSEGHDWDARFCKHCGGQLPRPARDQVS

SEQ ID NO: 8164 - protein, 170 aa, Chromobacterium substugae
MQSDWLQCCQGDITAQQVDAIVNAANSSLLGGGGVDGAIHRAAGPGLLAECRGLGGCPTGEARLTQGYLLPARYVIHTVGPVWRGGACGEAALLAACYRSCLALAEQQGIASIAFPAISCGAYGYPLDHACRVAAAALRDWLRRGPHSLRLVRLVAFDARALAAYRRALS

SEQ ID NO: 8165 - protein, 457 aa, Chromobacterium substugae
MDHLTRQNFFDRSQDVISVSSLNRMARDLLEAGIPPVWIGGEISNLTLAASGHAYFSLKDGGAQVRCVMFRHKVSALPFRPREGMQVELRGQVTLYEARGDFQINVGEMRSAGLGRLFEAFERLKAKLQAEGLFDNGRKRELPAHPAAIGIVTSPAAAALRDVVSTLRRRMPGIPLILYPAQVQGEGSAQQIAKAIQTAGERREVEVLIVCRGGGSIEDLWSFNEEVVARAVAACPIPTVSGVGHETDFTICDFVADRRAPTPTAAAELVSPNREHLAMQLEQTRRGLERALSRLLMDKTQQLDFLGRRLLHPGAKLQARRERLAALSQGLRRRVDAAFEQGRWRLQLAGSRMARHQPDFGALSQSLRQRQDRLQRARDRLLDNRRQQLAQLSATLTALNPDAVLARGYAIVQKRDGKAVKHPSELLNHEKVTLRLAEGSTEARIEHPQGAQPELPF

SEQ ID NO: 8166 - protein, 80 aa, Chromobacterium substugae
MNLAKLMPLLSCALLLAACATTPGASAVAGDDSGREEPKYLTGSNIPHRGGKTEVLTDQAMQDLADQIHRGSPVTSFGKP

SEQ ID NO: 8167 - protein, 310 aa, Chromobacterium substugae
MTKTIMLANPRGFCAGVDRAIAIVERAIELYGAPIYVRHEVVHNRFVVDDLRGKGAVFIEELKDVPAGSTLIYSAHGVPLSVRAEAEALGLQVFDATCPLVTKVHVEVKRMHKAGMEIIMIGHAGHPEVEGTMGQVDGGMYLVQTVADVATLQVARPDALSYVSQTTLSVDETRDIIEALKARFPAIHSPKKDDICYATQNRQDAVKQLAEDCDIVIVVGSPNSSNSNRLREVAALKGVDAYMVDNASLLEPQWFVGKQRVGLTAGASAPEVLVQAVIDRIKTFGIGQVAELPGVEESTVFALPPALRQA

SEQ ID NO: 8168 - protein, 166 aa, Chromobacterium substugae
MDSAMTMPGARRWSKWFVLAALVIVLDQFSKLYFNGHFQYGEVRSVVEGFFSFTLVYNPGAAFSFLHDAGGWQKYLFTVLAFAVSGWLGWNIVKGRFSGLMNLAAAFIIGGALGNVIDRLAYGHVIDFIMVHYYNQWYYPAFNLADSFICVGAALMVLDSFKKPSR

SEQ ID NO: 8169 - protein, 925 aa, Chromobacterium substugae
MSIDYRKTVNLLDTPFAMRGDLAKREPAWVKRWQEEKRYEKLRKLSAGRPKFILHDGPPYANNDIHLGHAVNKVLKDIIVRSKTLAGFDAPYVPGWDCHGLPIELMVEKLHGKDIPAAKFRELCREYAKEQVARQKKGFIRLGVLGDWDNPYLTMDFKTEADIVRTLGKIHENGYLTKGEKPVHWCIECGSSLAEAEVEYEDKVSPAIDVGFKVVDADKAGAAFGADANGAMAVIWTTTPWTLPANQAVAAGANLDYQLVDTPKGKLILGKDLVESAMKRYGVDEYRVLGEAKGEALELIQLQHPFYARQVPVILGDHVTTDAGTGLVHTAPAHGLEDFQAGLQYKLPIANPVADDGRYKSTTEIFAGMLVWDANPRVIETLESHGALVHKAKLEHSYPHCWRHKTPIIFRATPQWFISMDRQANGGETLREVSQRAVDATEFFPSWGRARLDAMIKNSPDWCVSRQRNWGVPMTFFIHKESGELHPRSAQLLEEVALRIEQQGIEAWFSLDAKELLGDEAEQYRKLTDTLDVWFDSGATHFAVLKQRPELAWPADLYLEGSDQHRGWFQSSLKTGCATIGRAPYKQLLTHGFTVDDKGYKMSKSKGNGIAPEEICGTLGADILRLWVASADYSGDMSLSQEILKRTTESYRRLRNTIRFLLANLSDFSPLENTVPLADMVELDQYALLRAREVQEKVVGELYSRYAFHHVVQDVVGYCSEDLGAFYLDVIKDRLYTTQADSHARRSAQTALYHITRSLLLMVAPILCFTADEAWNVLVDSEEESTLYHIWHEFPSQAPEREQALAGKWQAIRELRAQVNKQIEELRSADKLGSSLQAEIEIDAPVALAQQLLSLGDELKFVLIVSKASVKEAAEVAVRVHASTHDKCERCWHYRADVGRQAGHGAVCGRCVDNLDGQGEHRRHA

SEQ ID NO: 8170 - protein, 311 aa, Chromobacterium substugae
MQVFLGDPRRFALPGCALTIGNFDGVHQGHRRMLERLRLEARARGMPTALLTFEPHPREFFSRGNPPARLSTLRDKFVMLEELGLVDYVFVYRFNHSFSNMPAGEFVDKVLVEELKTRYLLIGDDFQFGFARKGNFDLLASCPHFATEAMPSVLVQGERASSTLVRERLAAGDLDSATSLLGSCYRISGKVMHGKKLGRTIGFPTANIHLPHLKPALQGVFVVEADTPFGRLGGVASLGLNPTVSDTPDYKLEVHLFDFAGDLYGKRLTVRFLKKLRDEARYDDLATLVAQIERDAASAKTYLTSLQREQA

SEQ ID NO: 8171 - protein, 228 aa, Chromobacterium substugae
MTKQLKLSALVAALLVSASAFAAKPGYAVDQSTDAVTRNSYGECWKTTYFDKAKDGLVECGDREAAKPVVVKEAPKPVMVSVKEKVTLSAKVLFDFNKNTLRPDAKNELDPLVAKLKAHAGQGHLNGVEIDGYTDFMGSDKLNNALSQKRADAVKAYFENAGVPAEKITAVGKGKAEAKMTEECKAKFPRYVKNKKQNAEIKACIESDRRVEVVIDAVKESVVEKPAN

SEQ ID NO: 8172 - protein, 167 aa, Chromobacterium substugae
MPQYIKDGRIRADGWTRLLPDEQGALPASPADSDVIVPLVAWLADAGKWQARGGRVGVCLAPDDDPALLEPYLADLVLIAIDFPAFTDGRGYSLARLLRERYDYAGELRAVGDVWADLIRPLWQVGFDAFQIKDGKALGDGDYYNTFSDSYQVTYRQPLPLFRRRVT

SEQ ID NO: 8173 - protein, 552 aa, Chromobacterium substugae
MYRYDEVDHRLVKERVAQFRDQTRRFLAGELSEDEFRPLRLMNGLYIQRHAPMLRVAIPYGHLRSEQLRKLADIARRYDKGYGHLTTRQNIQFNWPALSSVPDILEELSTVEMHAIQTSGNCVRNTTTDAFAGVAADQLFDPRPYCEIIRQWSTMHPEFSFLPRKFKIAVSGSEEDRAATMVHDIGLHVSRNEAGEVGFRVMVGGGLGRTPMVGEVVREFLPRQHLLTYLDAVLRVYNRFGRRDNKYKARIKILVKAMTREGFAAKVEDEWLHLKDGPSTLRDEDVAHYASFFVDPDYQPLADMPEALRSALAEDKAFARWYERNTRPHRQTGYRSVILSLKETGAPPGDITDAQMDAAADWADRFGFGELRVAHEQNLVLPDVAQKDLHALWLEARQARMATPNIGLLTDIISCPGGDFCSLANARSIPVANAIQQTFDDLDYLYDLGDIACNFSGCMNACGHHHIGNIGILGVDKNGEEWYQITLGGSQGRDTTIGKVIGPSFAQADVPRAFSKIMQVYLERRQVGEPFIDTLRRVGVEPFKERVYAPVH

SEQ ID NO: 8174 - protein, 234 aa, Chromobacterium substugae
MSLESKLAATTALLKTIAQAHPDAALANSYGAEDMVLTDLIASLGLPLQSFSLDTGRLPAETYALMQQVAERYPGHPVRVYFPDTAATEQYVNLHGINGFYQSVDLRKSCCQVRKIEPLRRALAGRSAWITGLRREQSPTRQDLASQEYDADNGLQKFSPLLDWTEAEVWQYLRERQVPYNALHDRHYPSIGCAPCTRAISVGEDIRAGRWWWENPETKECGLHVKASPLQRPV

SEQ ID NO: 8175 - protein, 314 aa, Chromobacterium substugae
MKLQQLRYLVEVAKQGLNVSEAAEKLHTSQPGISKQIRLLEDELGIQVFIRNGKRVVSVSEPGKEVLRISERILREAQNLKRVGDEFSRESEGALTIATTHTQARYALPQAIAEFVRRYPKVRLSLKQGSPTQICEMVVSGEADLAIATEGISLYKELAMLPCYEWNRSVVVPRGHPLSQLDRKMTLADIADYPIVTYDFAFAGRSKINKSFADQGLTPNVVLTAIDTDVIKTYVSLGLGIGIIASMAFEPERDQNLVAIDAGHLFEPSTTKIGIRKDAYLRGFAYTFVELFAPHLHRREVDSALLAHEGELDD

SEQ ID NO: 8176 - protein, 252 aa, Chromobacterium substugae
MKEGNTMRLKGKVSIITGSASGIGKATAEKFVKEGAIVAVCDLNPDAVKTVVDELKALGGEAYGYRVDVTDKAQIADMVADLKTRCGRIDVLVNNAGIVQDAQLIKMSEDQFDKVIDINLKGVYNCARAVVDTMVEQGGGVILNASSVVGVYGNFGQTNYAAAKFGVIGFVKTWAKELGKKGIRANAVCPGFVATPILKAMPEKVLQAMEDKVPMRRMADPAEIANVYAFLASDEASYINGAAIEVTGGLTL

SEQ ID NO: 8177 - protein, 535 aa, Chromobacterium substugae
MQFGVKPLFEKVSVKFGEGNRYGLIGANGSGKSTFMKILGGDLEQTAGEVAIENGLRLGKLRQDQFGYEDQRVIDVVMMGHTEMWAAMSERDAIYANLEATEDDYMHAAELEAKFAEYDGYTAEARAGELLMGVGIPVEQHFGPMSEVAPGWKLRVLLAQALFSNPDILLLDEPTNNLDINTIRWLEHVLNERNSTMIIISHDRHFLNSVCTHMADLDYNTIRIYPGNYDDYMIASAQARERQLSSNSKAKERIQELQEFVARFSANKSKARQATSRLKQVDKLKSEMVEVKPSSRQNPFIRFEMDDKFKLHRQAVEVESLNKAYENKVLFKDLNLILEAGARLAVIGPNGAGKTSLVKLLAGAFEAKFAEGLSADYGSIKWAEKAQIGYFAQDHEADFDSDMTLTEWMREWGQEGDDEQVIRGTLGRLLFGGDEVGKAVRVLSGGEKGRMLYGKLILQKPNVMIMDEPTNHMDMESIESLNMALEKYKGTLIFVSHDRQFVSSLATHVLELDGKGGYDYYTGNYEDYLASKGLE

SEQ ID NO: 8178 - protein, 279 aa, Chromobacterium substugae
MSQDGAVDFAALQRLVEFHIENGTAGIVAVGTTGESATLSVEEHIEVVAAVVKYAAGRVKVIAGAGGNATAEAIELGQRSADAGADMVLSVVPYYNKPTQEGIYQHFKAIADASPLPVILYNVPGRTVADMSNDTALRLAEHPNIVGLKDATGDIGRACDLALRAPKDFALYSGDDATGMAFMLCGGHGVISVTANIAPKQMSALCVAATSGDARQARAINDKLQGLHKQLFIEPNPIPAKWALVRMQHIREGIRLPLTPLSQAAEAAVEAALKQAEIL

SEQ ID NO: 8179 - protein, 328 aa, Chromobacterium substugae
MPPDLTTPQIQNKYNLPGGVTTASADPAVAAATSPIAINQLDKVRMERAGTQRWLLVGDKKAAELWPVLKAFWQENGFVIKTEDPSVGIMETDWAENRAKLPNDGLRKLLETVGLGSVYSTGERDKFRIRLENTPQGTEVYFSHRGMEEVYADNSKTNTIWQARPTDPNLEAELLGRFMIRLGMTEEKAKAQVQQTLAKPAKPQDPIVDGQLQLADGFDRAWRRVGLALDRVGLIVTDRDRSQGLYYVKPAKGETDSKEDSGSGFWSSLAFWKSGDGKAVKPTEQEYRIKLLEQTGGSTTLQIQDKQGKPLSDDFVKAALGKLQTELQ

SEQ ID NO: 8180 - protein, 67 aa, Chromobacterium substugae
MKQSLLVAALLAVALSACGKKEAPAEASAPAVEASAPAASAPAAEASAPAASAPAADASAPAASAAK

SEQ ID NO: 8181 - protein, 377 aa, Chromobacterium substugae
MNTTTLLGGMSPEQFLAEYWHKKPLLIRGALTDVGPHVDFSVLSELAQRDDAESRLIEFKRGRWHLERGPFRASRFRRLAETDWTLLVQGVNHHLPHIDEILWRFNFIPYARLDDLMISYAPPGGTVGPHFDAYDVFLLQVGGRKRWQISAQHDDDFIEDAPIRVLKDFRVEEEFVLEHGDMLYLPPHYAHHGVALEPGMTYSIGFRAPPAQELATQFLVYLQDRMCLDGVYADPNLKLQADPARISAEMIEQVSGLLSRIRWDKDTVCDFLGHYLTEPKAHVFYDAPEEELDEDEFAEALASQGLALDRKSQILFCDDCVYCNGEKLAADAGDFAHWRQFANQRKLAPGTFSADMLASLYDGYLSGYWHLLTDVAQ

SEQ ID NO: 8182 - protein, 159 aa, Chromobacterium substugae
MQIAKNTIVTLHYEMFDVDNNLLDKTEEPISYLHGGYDGIFPLVEEALEGKNVGESVDVKLTADDAFGDPEEELVRVEDLEVFPADVEIGMVFEADDPETGELLLFRVTDIADGKAIVDANHPLAGQSIRFAAKVVEVRAASAEEISHGHAHGEHGHHH

SEQ ID NO: 8183 - protein, 249 aa, Chromobacterium substugae
MSPRWKSCWPAWLLTPPIACLALWPEANRQLFLALHPWLQQLPAPFWRFASVFGDWPTVLALLLALSWRAPQRLPALLAGSVAAIVLAVALKAGFAVPRPPLVLPPGAVDLLDRLPGNGSFPSGHAMAAAALATFARHGARWGWAAAWCLLAAAVLLSRIAIGVHWPLDLLAGALLGWATMRLALRHAWPGGWARDITRTAWMILLVLLAGSLAWQLGHHGVFAEYWLRVAIGAAVLLWGFVRLGRSGH

SEQ ID NO: 8184 - protein, 274 aa, Chromobacterium substugae
MMLTIEQALRRHSLPRLESRMLLMRVWPGLTHAAIVGHPERELAADIAAAFDALAARRLAGEPMAYLIGAREFYGRDFQVSPAVLIPRPETEHLIELALARVDPAAPARAVDLGTGSGIIAVTLALEAPGWSVGAVDVSADALAVARGNADALAARVDFRLGSWFAPLDADARFDLIVSNPPYIERGDHHLAEGDLRFEPRGALTDEADGLACLREIAAGAPARLADGGWLMVEHGYDQGEAVRALFADSGLSQVETIRDLAGQDRVTIGRKAG

SEQ ID NO: 8185 - protein, 480 aa, Chromobacterium substugae
MTVAYKQQSADRLQESLGLVQSLIERQRQLEHLVSRQDAAESAAADGLAPQHNLTELRQKLAQLHPADIAHILEALPLEDRLLAWDMAEAARGGAILLEVSDAVRESLVEVMDQERLVAAVSGLEADELAELAPDLPRQVVYEVMGRLDEEERGQLQAVLSYDDDRVGALMDFELVTIRADVSCEVVLRYLRRFDELPGQTDKIFVTDEAGRLKGVLSIRKLLVSDPDAEVAQAMATEVVSFHPDEAALDAALAFERYDLVTAPVVDERGVLLGRLTVDAMVDVIREESDSEVRNLAGLKEEEDLFAPVMDSVKNRWSWLAINLCTAFFASRVIGAFEHSIAQLVALAALMPIVAGIGGNSGNQTITMIVRALAMGQMRMGQTGRLWRKELGVSVINGMVWGSVIGAIAWLLYGSASLGLVMLAAMTLNLMLAATMGVMIPTLMQKLGKDPALGSSVLITACTDSGGFLIFLGLATLFLL

SEQ ID NO: 8186 - protein, 41 aa, Chromobacterium substugae
MLLVGNRHARLLPPTGRTRCRRCEAGLFAKGVTGLDYGITG

SEQ ID NO: 8187 - protein, 228 aa, Chromobacterium substugae
MSRILLKILAALVAAFVLYNLWVFGHVVYWRDHNPSASSFMNERLAKMQADDPDAELSQRWVPYAKISPNLKRALIASEDARFVDHEGFDWDGIEAAFEKNLKKGKIVAGGSTISQQLAKNLFLSSGKTPWRKLEEALITMMLEAVLDKRRIYEIYLNVIEWGDGVFGAEAAARYYYHTSAARLSSSQAAKLAAMVPNPRYYDAHRNAPGLARKTRIIQRRMAYVELP

SEQ ID NO: 8188 - protein, 273 aa, Chromobacterium substugae
MTDRYAVIGNPISHSQSPFIHQEFARALGQDISYEKLFAELGAFRPQVEAFVAAGGKGLNITLPFKGDAFRFAQEVTERARAAEAVNTLTFRDGKVYGDNTDGVGLVRDIVENLDYPIAGQRVLILGAGGAVRGVLEPILQQKPASLTIANRTVIKAEALAHHFARYGKVEAVGYDALAGRSFDIIINATSTSLSNEMPPLPHGVFTARTLAYDMVYSSGLTPFLQRAQGENAGMLADGLGMLVEQAAESFSIWRGIQPDTRKVTNMLREVLA

SEQ ID NO: 8189 - protein, 150 aa, Chromobacterium substugae
MSKVKQILQTAHQRAERSGLPYSGALLPDEAYELLQSLPKTVLLDVRSHAEWQFVGTVPGAVNIEWKSYPGMAANPNFLAQLTHQVDPEAVLLVMCRSGARSDQVARLAAANGYSEVYNVLEGFEGDLDASGHRNSVGGWRQRGLPWMQG

SEQ ID NO: 8190 - protein, 49 aa, Chromobacterium substugae
MDQLDYVGYCHGLSPERQRAPKGKCEKIGTPGFKQEACQLQNRCCCIVS

SEQ ID NO: 8191 - protein, 472 aa, Chromobacterium substugae
MAVADVVKLIQENDVKFVDLRFTDTRGKEQHVSIPAHVLLEDADAWFERGHAFDGSSIAGWKGIQASDMLLMADPATARIDPFFDEPTVFMSCDVIDPADGKGYDRDPRSIAKRAEAYLKASGVGDTAYFGPEPEFFIFDSITWGTDMSGCFVKIKAEEAAWASAEEFEGGNMGHRPGVKGGYFPVPPVDSSQDIRSAMVLLLEELGVPVEVHHHEVATAGQNEIGTKFSTLTQRADWTQILKYVVHNVAHSYGKTATFMPKPIVGDNGSGMHVHQSIWKDGVNLFAGDGYAGLSDTALYYIGGIIKHAKALNAITNPGTNSYKRLVPHYEAPVKLAYSAKNRSASVRIPHVASPKGRRIETRFPDPLANPYLCFSALLMAGLDGIQNKIHPGDAADKNLYDLPPEEDKLIPTVCASLDEALAALDKDREFLTRGGVFSNDWIDSYIELKMQEVNLTRMTTHPVEFAMYYSL

SEQ ID NO: 8192 - protein, 152 aa, Chromobacterium substugae
MKTLALLLLLACGGVQAATIYKYVDANGNVTYTNVPIRGAQPIKLNPLSSYPGGKSGGASAGKPAASGGYPSVDANIQKQRDNGRKKILEQELANEAKALDAAKKALADGKATRLGDEARNYQKYLDRVQKLQDEVTDRQKNVEALRRELGM

SEQ ID NO: 8193 - protein, 353 aa, Chromobacterium substugae
MPLPSFAGLELLDTPVLICDAAASLRFVNPACENLLALGSREMLRHSLLELFQPCPALRQALTTALLQGASYIEHDLELKPQHNDAVLHVALTITPVDADGSLALIELRPLDQQLKIANEERSLLQHQANRELIRNLAHEIKNPLGGIRGAAQLLEHELADRPELKEYTAVITEEALRLQALVDRLLAPHRSHSRAPINIHEVLERVRSIALAQHPQGLAVIRDYDTSLPLLSADKEQLIQVVLNIVNNAVQALRGQGRIVLRTRVARQITLARKRHQLALKLQIEDNGPGVPDDIRDHIFYPLVTGRAEGTGLGLTLAQAFVHQHGGSIEFESRPGQTCFTVLLPFAADAAS

SEQ ID NO: 8194 - protein, 469 aa, Chromobacterium substugae
MTKPVWIIDDDKAIRWVLEKALTRAEIGFDSFSSADDALNALYDATPQAIISDIRMPGTDGLKFLAKVKNEHPQLPVIIMTAHSDLDSAVSAFQGGAFEYLPKPFDIDQAVLLIERALAESQAQAAGPDSPEAMPVLLGQAPAMQDVFRAIGRLAQSSVTVLITGESGTGKERVAEALHRHSVRSGKPFIALNTAAIPKDLLESELFGHEKGAFTGALAARRGRFEEAEGGTLFLDEIGDMPTELQTRLLRVLSDGHFYRVGGHTPIKANVRVIAATHQNLEQRVRDGQFREDLYHRLNVIRLRLPPLRERREDIPLLTRHFLAKSASQLGVEAKRLSEAAMALIQRSAFSGNVRELENLCQWICVMAPGQTVEVADLPPELRDPQGQPAAAAASGWDQQLAEEIRQRLLAGETGIVDELTHRFESCCIRAGLAHTGGRRVEAAHLLGWGRNTLTRKIQELGLDHGDPS

SEQ ID NO: 8195 - protein, 251 aa, Chromobacterium substugae
MPRLVLALACLTPLAAPAAPLQIAISDALTSPYVIEDPSAAAPPRGRAIELAQAALEHCRLEGGFNRQPGERIVQNLALNRIDSALLLSYKSERAGQMAFPMRAGQADPERRMATFHYAFYVRSDSRLRWNGRALVGLAGAVGINQGWSIGRDLLSQGIPVEESHGIADNFAKLQAGRTDAYALHQLAGDLYLRHHPELKIRRLSPPLQSKTYYWVFSRGYASRHPQQVDCLWRQMPALRARYLPESVAAR

SEQ ID NO: 8196 - protein, 227 aa, Chromobacterium substugae
MDGGALGGIAARVGGKRLPAFQPLAGLRAAALARPGPGISEQPAAAGRSGLAISMGITGIDMGIKRLNHAVLYVSDVAGSTAFYRDVLGFRPKGDAGSSRAVFTQAAHSDNDHDLALFSRNLGQQRSGPFSPRGEAPDPHQPKAGLYHLAWEVDTLAELKRIRDELAALGKLGMEEDHGVHKSVYGHDPDGLLFEVCWFVPPQLLDAAPAPAEDGRLDWARELARYG

SEQ ID NO: 8197 - protein, 307 aa, Chromobacterium substugae
MSVLELRHLKSLLALAESGSVSQAAQRVYLTQSALSHQLKQLETAYGLALFERKTQPLRFTPAGERLLGLARDLLARVAAAERDLARIRQGEAGEIRVAVECHTCFDWLMPAMDQFRQHWPAVELDIVSGFHADPVGLLLSGRADLAIVSEAEAQAGIVHQPLFAYEMVAIAAREHPLAGKACWRAEDFVGETLIHYPVPDDMLDLLRKVLLPAGVNPARRTAELTIAIIQLVASRRGVAVLPYWTVQPYLERGYVVARQVGEAGLQSELYAALRGDDAGQAYMQDFLQTVRDCSFASLPGLSPLPA

SEQ ID NO: 8198 - protein, 759 aa, Chromobacterium substugae
MTTTHLPGFPRIGAKRELKILLESYWKRDIGEAELLAGARELRQRHWLLQKGAGVDLPPVGDFSLYDHVLDAQLLVGAAPARFGFAADAIDTERYFQLARGNASQPALEMTKWFDTNYHYLVPEWQADTAFRAQPERLLGQVREALALGVRAKPVLLGPLSLLWLGKCKGRTFERLQLLPGLLAAYRQILAALREAGVEWVQIDEPILALDLPPAWLDAFPASYRQLQADAPAILLASYFGGVAEHADLLKALPVAGLHLDLARAPQQLSAFLAGFPADKVLSAGVIDGRNVWRADLSAILRQLQAAHAQLGDRLWLAPSCSLLHSPFDLAAEIALAPDIKAWLAFAVQKLNELRTLQRGLRLGRDAIAGELAGSDFAQQQKQHSPLIHLPGVRQRIAALPTGADRRASPYPVRAPLQQAWLRLPPLPTTTIGSFPQTAAIRASRAAYKRGELAAADYQKAMEGEIELAIRRQEALGLDVLVHGEAERNDMVEYFGEQLSGFAFTAGGWVQSYGSRCVKPPILYGDVSRPAAMTVDWARYAQSLTAKPVKGMLTGPVTILQWSFVRDDLPRSEVCRQIALALNDEVRGLEAAGIRVIQIDEPAIREGLPLKRADRDGYLAWAGQAFRLSCHGVDDATQIHTHMCYSEFGDILPAIAALDADVITIETSRSDMALLADFGRFRYPNAIGPGVYDIHSPRVPAPAEIRQLLEKALQVIPAAQLWVNPDCGLKTRDWPEVEAALAAMVQVGRELREEIAPAV

SEQ ID NO: 8199 - protein, 152 aa, Chromobacterium substugae
MDLILWRHAEAEEGADDLSRALTRRGQQQASQMASWLRQRLPDNYLLLASEAKRSQQTANYLAKSYTVLPELNPGSDVDEVLAAVGWPDAERAVVLVGHQPYIGWLAARLLAEQQQLWSVKKGSVWWLNRRERHGMEQIRLKLMLTPGMLEP

SEQ ID NO: 8200 - protein, 238 aa, Chromobacterium substugae
MIPILPSAVLDSPLTGIFVTLLAYRLALAASRRSHGHPLANPVLLGVLMVLLWLWLSGSSYQQYMGGARFIQLLLGPATVALAVPLYGNLPRLKRAAVPLLLSVCVGGLAGMASAAGLGWWLGLDHAVLVSLATRAVTTPIAMSLAGKLGGAPELAAMFVIVSGIVGAVLAPPLCRLLGWDDDMLMGVATGVTAHGIGTARVFHLSEAAGAFAGLAMGLNGVFTAMLLPWLVRWLQVG

SEQ ID NO: 8201 - protein, 114 aa, Chromobacterium substugae
MLDLLLWLLAYQLLGEALARHFGWPLPGPVLGMLLLFATLWLRRAVPATLQREAPRFLGHMSLLFIPAGGALLAYAPLLRSHGWQLLLILLASTLLTALVSAGMLKLLLRGRRR

SEQ ID NO: 8202 - protein, 486 aa, Chromobacterium substugae
MITASRPRRVATSPLGFWHNARHGRCPMALRAARPARPLTGLSDRARLAQPAPAGRRPPFRRAGAGPGRQPRAARRGRGAGSAVRRAAVRAPCAADAGRDAGGVRPQRHPPRLPRLDAGADARQPLAGPDLVRRIARAAARAAALPIAGQPPSAGGRSRRRRSRRDLPGAALPLPAGRLAAAADRTVPARPEGFTVISSATLRDRYDNYKQLMRWDKPIGTLLLLWPTLWGLWIAADGKPDALIAAIFCLGTFLMRSAGCVINDYADRDFDAHVARTSQRPFARGAVSKKEALLLAAFLALLSFLLVLPLNHLTWLLSVPAVLIAASYPFTKRFFPMPQAYLGIAFSFGIPMAFAAQTNQVPALAWILLLANVFWVLAYDTAYAIADKPDDLKIGIKTSAITLGDYDVAAVMAFHLLFLAVMAGVGLRLGLLWPYYLGLALAAALMALQYRDIRHRDRALCFKAFLDNNRVGAAIFAGLLLSYWLR

SEQ ID NO: 8203 - protein, 71 aa, Chromobacterium substugae
MKKLLTALIAAAFAGSAFAAPAASAPAAEKKMEHKAEHKKSHHKKAHKKHASGAAHEKHKKAEHKAASATK

SEQ ID NO: 8204 - protein, 143 aa, Chromobacterium substugae
MTAKQRKLLWLGVALIVFGALKAGLIYWYLHNKPAAAKPLTLSCDIGRGGCALPGGGRLAFSAPPEHGRPFELRLSGLAGETPPAVDFSMPDMDMGFNRYVFVRDGAGWKATVTLPMCVSGSRNWVAELKDGKAAYRLPFTVR

SEQ ID NO: 8205 - protein, 311 aa, Chromobacterium substugae
MTSNKIIEVVAGALMRPDGGFMLGSRPEGKPYAGYWEFPGGKVEPGETPLEALKREFHEEMGIIVTAATPWLTKIHHYEHASVHLRFFRIWDWQGEPQPREAQSFAWQRPGRYTVAPMLPANGPILKSLELPACYAITCAAEIGVEAQLARLVERDWGMVQVREHGMGHEELADFVARAAAIVRPRGGKLVVNADPAWLEGWPVDGVHLTGARLAALTARPAFDWVGASIHGADELARAGELGLDYALLSPVAPTASHPDAALLGWDGFAACLAGGVPVPVYALGGLTAEDLPPAREHGAHGVALMRGAWR

SEQ ID NO: 8206 - protein, 230 aa, Chromobacterium substugae
MTTATPTQRNLALFDLDHTLLAGDSDFEWPRFLIKRGILDAAQYDERNSYFYRQYQNGTLDMQEYLAFILAPLTRFSRAQLDELHADYLENHIKPLIPNKARQRLAAHAAEGDQIVIITATNRFITGPIARDLGVEHLIAIELEEDADGNFTGRPTGVLSFKEGKITRIEQWLAERGESWDSYGTSFFYSDSHNDLPLMKLVDKPVAVDPDDKLRAHAEAHGWPVISLRD

SEQ ID NO: 8207 - protein, 224 aa, Chromobacterium substugae
MDQLVLDLTPTPLPAFDNFLAERNREVITALTATEGERFIYLWGEPGCGKTHLLQAWIAHAERLGRAAIYLDGKGDHLPDFAREASFIAVDHVDDLAPDDQITLFSFYNSLKESGESRLLMAGRNPPMALSVRDDLRTRLGWGLVLEVKALSDDDKLAALRSHAATRQLSIPDDVYRYLLTHWRRDLSSLIGMIDMLDRYSLAMRRPITVPLVKNVLQTATPES

SEQ ID NO: 8208 - protein, 55 aa, Chromobacterium substugae
MFDFTPIRPFGGTAFCRGGGDGRGDAAAREKPPAAFASLFAIFQLKYSAFAPAKA

SEQ ID NO: 8209 - protein, 345 aa, Chromobacterium substugae
MNTTSLSYRDAGVDIDAGDALVENIKPFAKRTMRPEVLGGIGGFGALVEISKKYKEPVLVSGTDGVGTKLKLAFDWNRHDTVGIDLVAMSVNDILVQGAEPLFFLDYFACGKLDVAQATEVIKGIAAGCEMAGCALTGGETAEMPGMYVPGEYDLAGFAVGVVEKSKVISGRDIAAGDVVLGLASNGVHSNGYSLVRKIIDRAQPELDAPFDGGKTLRDAVIAPTRIYVKPLLKLMETLPVKGMAHITGGGITENTPRVLPDNAVAQIDAKSWELPKLFQWLQREGKVDTQEMYRTFNCGIGMVVVVAAEHAEQAMALLREAGETVYRIGTVRERQGDEHQTQIA

SEQ ID NO: 8210 - protein, 213 aa, Chromobacterium substugae
MKNIVILISGRGSNMQAIVNAGIAGARVAAVIANRPDAAGLAWAAERGIATAALDHKAYPSREAFDAALAEAIDAHAPDLVVLAGFMRILTAGFTRRYEGRMLNIHPSLLPAFPGLHTHERALEMGCKLAGCTVHFVTAELDHGPIVAQGAVSVQDGDTPDSLAARVLKLEHQLYPEAVRRFAAGELSIVNGKVASGPAAACDLMSPPPSYKV

SEQ ID NO: 8211 - protein, 391 aa, Chromobacterium substugae
MSRRRLLLIALFLSLALHFALLGSGMLPAISLPPAEDTKLEKIDIKMQAMGLEEAARPAPPAGAGVNLAPAAARPNPRRNPNQSRNRSAKRPPRKRRTNRKPRRRRPRPKPPPAKASAPPARHTPRPPPRRPPARHTRKPGMRRRRPRPKTKPQDPAGFLHPPQPLRKFPAAAKLSYQLYWNGVYAGTGELNWQQGHGRYLLETVATPAFAYRMFTRGYRYRVEGGIDAGGLRPDSMLSFEGDKAKEEARFDYAAGQLRYGMGAGQQVALRAGAQDIYSLAFQLGLKGGHLGDKALQITTAKKVYDYPMAPTGAFDYDTNAGKMRVAVFQAKGGGDTTEFWLATDFANLPVRITRIDDKKRIELRAVRIEVNGALQWELPPQPTRLNKNAH

SEQ ID NO: 8212 - protein, 419 aa, Chromobacterium substugae
MHISHSQLKHLETVIGQMTRFDRPADAVLSAYFREHNKLGGADRHLIAETAFGALRRLIQLRALIAPEKATPRRLALVALMKFNKLNVKELTEATSAGEREWLGTVKGKTLEDSLEIRAELPQWVIERLGEQEPSAVEALGQGLMSMAPLDLRVNTLKMKREELLDRLNAEGIHCEATPYSPLGIRLKDKPALSKHELFKAGAFEVQDEGSQLLGLITGARRGEMVVDFCAGAGGKTLLLGAQMSSSGRLYAFDVSEKRLANFKPRQARSGLSNVHPQLLAHENDAKVKRLAGKADRVLVDAPCSGLGTLRRNPDLKFRQSPDSVAELNAKQASILASASRLVKSGGRLVYATCSLLPQENQAIVEAFLAEHADFRLLKMDEVLAEQKIPLQCGDYLELKPHLHNTDGFFAAVLERSAG

SEQ ID NO: 8213 - protein, 455 aa, Chromobacterium substugae
MQDYLSRRNSRQKMNRQLRYLYLSAAQWRRQLPVWIAAILIGVVAYVFALGSHLSHDLFYQAYSYSPYWSLLITPAGLALAIWIMHRFFPGSAGGGIPQSIAALEPGMEKLRETCFTLRAAFGKVLLTLIGISSGATFGYEGPIVQVGAAIKYSLNRKAALRHEGAARSFILAGAAAAVAAAFNAPLAGIVFAIEEMGRTFDMRASSTILLSVIVAGLTTFAINGNYNYFGVVQVAMDSNQTWLAIPVCGVIGGLVGGLACRVLLALSQRLPGPLHGWRVRYPIRFAAGCGLALAVIGIASHGSTFGTGYFRARDIIEGHGAALQDYGALKLISMFVSHISAVPGGMFAPSLAVGAGFGLNMSQLLPFLPQTMVVLLGMVGFFAGMTRAPMTGFVIVMEMTDTSGMIIPLMATALVAASVSRLVSRRALYEGQVRLFLPQWHARLRQIDQPGGRT

SEQ ID NO: 8214 - protein, 103 aa, Chromobacterium substugae
MSIQQDIQQTVAANTVVLFMKGSAQFPQCGFSSRAVQILKACGVEDFLTVDVLRDPDIRQGIKDFSNWPTIPQLYVKGEFVGGSDIMYEMFQNGELQEMLKDL

SEQ ID NO: 8215 - protein, 211 aa, Chromobacterium substugae
MNITIVDHPLVQHKLGLLREADTSTMKFRQLTQELARLLAYEATRDFELETVSIDGWCGKIDVKQIKGKKVTVVPILRAGIGMLDGVLDLVPSAKISVVGLARNEETLEPVSYFEKFVGNLDERIAIIIDPMLATGGSLVATIDLLKRNGCKTIKAVVMVAAPEGVKIVNDAHPDVQIYAASLDSHLNEHGYIIPGLGDAGDKIFGTKQQA

SEQ ID NO: 8216 - protein, 212 aa, Chromobacterium substugae
MDRYAAIDADFLARFPGGFQDPDWQTLARRHKSYAKAEALCQSELTRAKLDAALASGKLADATHACRQIISLATTVSTFEKIAFRNYLDNRDLNLPFVQALRDVLHDFSPDSFAAYVDTLAMARTDPKANAAKWPIVSCFLACFDPQVHVCVKPTTVKKVAARLGVDIRYQAKPNYECYEAVQRMVQDFKRRSMVAADVDNVLAQAVMYCAV

SEQ ID NO: 8217 - protein, 413 aa, Chromobacterium substugae
MQQLKLAVSGAQILFVAFGALVLVPLLTGLNPAMALLGAGLGTLLFQACTGRQVPIFLGSSFAFIGPIIYSIHTWGQGATMFGLFAAGFMYFVFAAIVRWRGMALVNKLLPSVVIGPVIMIIGLSVATAASGMAMGQAGGKQVLPYETSLLLAAISLATTIVVSIYARGMFKLVPILAGVVVGYIAAAFLGAVDFAKLAAAPWFAAPAFHSPEVNWAAAAFMLPVAIAPAIEHIGGVMAIGGVTGKDYTKAPGLHRTLAGDGLGVCVAGLIGGPPVTTYAEVTGAVMITRNFNPVTMTWAAIFAICMAFFGKFNALLQSIPMPVMGGIMVLLFGTIASIGLKTLIEAKVDLMEPRNLVIISVVLTAGIGGLTLKLGDFALAGVGLCSLLAILLNLILPRQAASHDGIVEGQDI

SEQ ID NO: 8218 - protein, 58 aa, Chromobacterium substugae
MLKTILASSLSLLLLSASAMAGSDGLSVMWAMRGRMDAQLHNQPAPMVPQFNSIPSDR

SEQ ID NO: 8219 - protein, 302 aa, Chromobacterium substugae
MAQMKLTLEALQVLDAIEQHGSFAAAAEALYKVPSALTYTIQKLEQGLGVAIYDRSGHRARLTPAGERLLRDGRHLLDAARQLELRVSKQAQGWEDKLRIVVGDLVGFEQLLPSIADFDQLQSDTRLQFIRESFGGIWDALYDDRADLVIGAPNQPPPGDYFTRNIGDYDFALVVAAGHPLADAPNPLPPHLLRRHRAVAVGDTSRRLPARTGGLLEGQQVLTVHSSQAKLKAILAGLGSGHLPRSHVQRWLDSGHLVEKEEEENGTFPPMCFAWKLEQPGRALQWFVQRLERAVADGELTI

SEQ ID NO: 8220 - protein, 52 aa, Chromobacterium substugae
MLKQTTLAALSLILLSGAAMAGSDGYANMKAMRDRMASEQTQQVQQQAPAQK

SEQ ID NO: 8221 - protein, 168 aa, Chromobacterium substugae
MSELRIRHLEPADAADLQELASDPSVYGNTLQLPFPSSATMASRMGKLLCAGRYQLVSQNAAGKVVGSAGLWRLDEARLEHIAGLGINVHRDWQRRGVGTLLMAAMLDLADSWIGFERIELTVYPDNQAAQALYRKFGFVEEARMRAHSFRNGAYHDALLMGRLRPDS

SEQ ID NO: 8222 - protein, 169 aa, Chromobacterium substugae
MNDYRIRHAEPSDAEALNALFSDPAVFGSMLGLPCPALSKRREWLQKHEPGRTVLVAVDAAGLAIGWAALIPARRERLLRGAEIGIGVASAQHGRGVGSLLMAATLDLADNWQGLRRIELTVFADNLRAQALYRKFGFVEEARLRAYALRDGVYHDVLAMARLREGEWK

SEQ ID NO: 8223 - protein, 172 aa, Chromobacterium substugae
MSQSLSIRSVEPSDAAAIHRITTAPSVYPDTLQLPYQPLSATEKRLSERPANLYQLVACSGDGEVVGTVGLIVNEGMRVRHSASLFLIVRDDWQGKGVGGALMRAIVDLADNWLGLIRIELKVVHDNARAIALYEKCGFEYEGRMRQEQLRAGKLEDVLVMGRLNWPGRAQA

SEQ ID NO: 8224 - protein, 249 aa, Chromobacterium substugae
MAADALMAGGVRLTPLKRRAGDHTAMHAHEGGQLTLVRRGALELVAAERRMLLPAGCLGWLPAGLPHGAHYHGDLEGWSLEGRGAALDRLPAQLQAWSGSPLLDGIFQRLAAWPEAGGAAAAARLLQVLVDELGWAAPHPSCLPWPKHPALRRLAQDLLREPALDWDLQRWAGHIGMSRRSLIRHFRAETGLGLGEWRERLRMMRAQALLAEGRAVGFCALELGYCDSSAFIAAFRRCFGATPGRFLSG

SEQ ID NO: 8225 - protein, 113 aa, Chromobacterium substugae
MKPSIQTVAHTNELAAINSKVIADGETLPAVKLRDGSTVQTGTVAAMLVNIAAYNRGERGEVERQLELAVPTLFKVGLFDLFPVEEWLRGDNPGRALLGAMAALHLADQANNT

SEQ ID NO: 8226 - protein, 183 aa, Chromobacterium substugae
MLMQRQDAALLVVDIQDKLLPAVHDADGLLKRSRWLVAAARDHQLPIVFSEQYPRGLGGTAAALREAAPEAPTVDKLHFSCVAADCLPPLLTDKRQIIVCGMEAHVCVLQTALELLQAGKQVFVVADAVSSRKASDVELALARMRAAGAQIVSREMVLFELLRQSGSDHFKQMSQRYLMGEQP

SEQ ID NO: 8227 - protein, 109 aa, Chromobacterium substugae
MTTFQEQLSTLPATDGVAAIVLLNPAGEAVHRLENQPGTAGSLRVYHALVKRHGHIDRKAAREGLELFAEHTAAARAQPGSHPNIDRLLAIAEQDAPGLRARLVLASED

SEQ ID NO: 8228 - protein, 438 aa, Chromobacterium substugae
MVYLQLLVVLGAIFLGVRMGGIGLGVTGGAGLFILTFVFGLKPGHAPIDVILIIISVITASAALQSARGLDYMVGIAARFLRRNPRHIVLLAPLVGWLSTFLAGTGFIALALMPIVVEVAEKTGIRPERPLAGLTVASQNAIVACPVSAATVALATVLAPHGVALTDIIMISIPATLIGALAGSLVMLRYGRELADDPVYRHRLASGGIARPQAAGVQALPRTAAWSVYGFLFTVALIVLLAAMPQLRPAWQGAKGLEPVAMVDVIQMCMLSYSALAVLLCKADLQAMVSGSMFRSGAVAAVTILGAAWMSDTFIQANLPLFQHNIVSIIHQAPWLFAFAVFTMAVILFSQGATTKVMMPLGVSLGLAAPTLIAIFPAVVGVYVLPSYPSLIAAVEMDYTGSTRIGRWVFNHSFILPGLATTAASIAAGFALMALRGV

SEQ ID NO: 8229 - protein, 303 aa, Chromobacterium substugae
MRERELRALSRDVVRALGMLSSHCGEVALTPVEAHLLIELESGPASNQQLADRLRVDKSNSSRPLQRLSERGLIAWRADPADGRSKQAELTGSGRDWLARLHAAMDADMARVLAQLDEAERARLEDGLRLYRRALRDADSQQGFAIRPLAAADNGPLAALIRRVSAEYGLGDGCSFLDPQLDALFPAYNRLDSRYLVVVAPDGRLLGGGGIAPLAGGAQGVCELQKMYFDPALRGRGLGRRLLRLLLAKARALGYRQCYLETTAALAEATALYRAEGFALLDERWGDTGHGGCEIRMALALQR

SEQ ID NO: 8230 - protein, 149 aa, Chromobacterium substugae
MQIILLEKVANLGQLGDVVNVKNGFARNFLIPQGKAKRATENNLKEFEARRAELEAKQAEILADAKVRAEKLVDAVITIAQKAGVDGRLFGSVTNVDVAEAVTAFGVEVKRFEVRLPNGPFKAIGEYDIEIALHHDVVSPIKVVVVAEA

SEQ ID NO: 8231 - protein, 75 aa, Chromobacterium substugae
MARQLFKRKKFCRFTAEGIKEIDYKSVDLLKDFIAENGKIIPARITGTKARYQRQLTTAIKRARFLAFLPYTDQH

SEQ ID NO: 8232 - protein, 99 aa, Chromobacterium substugae
MQNRLVLTVTVEREDALRYTPAGLPVVEMWLKHQSRQTAGGFERDVACDIQAVWIGDDARKHSGKLAGQVINVTGFLGQRSLRNPRLVLNIEYVEFVKG

SEQ ID NO: 8233 - protein, 125 aa, Chromobacterium substugae
MRHYEIVFIVHPDQSEQVPAMIERYKGMVLAAEGKIHRLEDWGRRQLAYPIQKLHKAHYVLMNVECQSETLAEIEHAFKFNDAVLRHLSIKLDRAITDASPMMKDEKAKNLLDAQQPAAEAEASA

SEQ ID NO: 8234 - protein, 99 aa, Chromobacterium substugae
MKTTLAIAALLLTGAASADPIPFETFIKLHNGMLEAELVSVAGKPDYGSDSNQGGLASGIATVSTTRQLSWLANGNIPYTTIVTLRDGVVVNIKRSKKL

SEQ ID NO: 8235 - protein, 139 aa, Chromobacterium substugae
MAMAAWARVEYDQLNARQKENYNFQKLAAVLADYGFNCLRLTDDWQGADFIACHIDGETFLKVQLKGCRLLFDRKYCGKNFHIAFRDGEQFYLYPHDELLRQMMELGIIAGTKSWESGGNYHFPRMTEKQLRLLHPYRL

SEQ ID NO: 8236 - protein, 108 aa, Chromobacterium substugae
MTDTRHPHEECCHDAPAAERVVVQPGKAALLKRLARIEGQVRGIGGMIEADRYCVDVLTQVAAVKSAMDAVALQLLENHMKGCVARALQQGDATGMVTELIDVVKKVR

SEQ ID NO: 8237 - protein, 486 aa, Chromobacterium substugae
MQWGGALALSSWLGRPALAASSHAGHGGQDIAAALPAAAGLELARGQPLPALPRLPLEGKEGALSGCLTAAALNLPLLPGKAATAFWAYNDSVPGPAIELYEGDALHLRFDNRLPQATTVHWHGLPIPADQDGNPHDPVAPGQTRDYRFALPPGCAGTYWYHPHPHGHTAEQVYRGLAGVFVVKRRDDPLAHLPERWLVLSDLKLDEQGQIAANSEADQMDGREGQFVLVNGAWQPKLTLGVGERQRWRVWNATSARVLKLALPAHEVWLVGTDGGLIEKPLRIDSLLLPPGARAELAVTGRFAAGKPAGLLALPYARGKMMGPEQDKVLPLLDVEAGPAVATAALPSRLRTIAPLPKPAVRRRVAFSEDMANPAAMFLINGKTFDMDRMDFTGKVGVVEEWEIDNQADMDHPFHLHGTQFQVTERHDGKGWRREPYLAWRDVVNVPPEQKVRLRFRQDLPGPRMFHCHILEHEDAGMMGMLDVSA

SEQ ID NO: 8238 - protein, 260 aa, Chromobacterium substugae
MLNVAVKAARRAGSVIQRASLNLDTIRVEKKKHNDFVTEVDRAAEEAIIQTILEAYPKHAILAEESGAKGVGSSEYEWIIDPIDGTTNFLRGHQQFAISIALAHKGQIQQAVVYDPSRNDLFTASRGVGSFLNDRRIRVSKRFMMNECVIATGFPVSDQSYLDQYMGMLKDVIGKAAGVRREGAASLDLCNVACGRVEGFFELNLKPWDIAAGSLIVQEAGGIVTDFTGEQGWLESGDIVAANPKVLAQLLHTLAPHVGK

SEQ ID NO: 8239 - protein, 254 aa, Chromobacterium substugae
MNKPQVPDFLKNIRIVLARPNHPGNIGSAARAMKTMGLTRLYLVEPKVFPSDEANALASGAVDVLESATVVGSLQEALADVTVACALTSRRRELTTPLSTPRETTPELVARARDGEQVALVFGNETFGLSIEEVEQCNRLVTIPGNPDYFSLNLAMAVQVMTYELFSHTGVNVEYLRADGEAATQGEVEGMCGHLEQAMDDIGYFRRRNSERLMRRMRALFNRSGVLRDEIDILRGFFKQVQRAADGSLKRDED

SEQ ID NO: 8240 - protein, 301 aa, Chromobacterium substugae
MKTEQPFSLPYAHPAVRDLAFLLTSPSPWPSGADLPPERLLGADGAALLGRLEREPAPLLDWLAASHPKRLGKYAERLFSFWFRTAPHIRLAAENLTVINETRRTLGEFDFLLWLDGEPWHLETASKFYLQLGNGPDTLVGPSLRDAWRLKATKLATQLQLSRHPAAAAQLPDGFAACQTGARLSGWLFYPAGQAWPPPSGALRGWHAPLLPAWPQTLPGSRWAWLPRLSWLAPALLDASRVHSQAALREQLLACAAPQLVAELQPAGGGLWRETARGFVTPDGWPDPARLAELQSKLPQP

SEQ ID NO: 8241 - protein, 248 aa, Chromobacterium substugae
MSEQNHTALHTLKISCSSCSLRELCLPVGLNREEMSQLDTVIRQSRRLKRGEYLFRSGEGFKSLYAVRTGFFKTCVASQDGREQVTGFLMSGELMGLDGISTNNHSCDAIALEDSEVCELPFNRMESLSRDIPSLQHHFYRLMSREIVRDQNVMLLLGNMKAEERIAAFLLNLSQRLSTRGFAANDFILRMSREEIGSFLGLKLETVSRTLSKFQQQGWITVDHKHIQLVKVEELKNLIAGCVHANGH

SEQ ID NO: 8242 - protein, 484 aa, Chromobacterium substugae
MRKFTSPPEVLPSEYDMKTTHPFSPAHFEFDRELIERLDGSGPRYTSYPTADRFTPGFSAHDYQHGLQQRRIGANRKPLSLYAHIPFCNTVCYYCACNKIITKNKSKADQYLGYLEKEILLVAEQLGCREKVIQLHFGGGTPTFLDDGQLARLMTMLGTHFEFLSDGEYSIEIDPRKVKRETMFRLAEYGFNRISVGVQDFDPAVQRAVNRVQSEQETRQVIAAGREAGMKSVSLDLIYGLPLQSRDSMLRTLEKAIALDPDRLALYNYAHLPTVFMPQRRINEADLPSAAAKLDILQDAVKMLSDAGYVFIGMDHFAKPDDELAVALRQGRLQRNFQGYSTHADCDMLAFGVSSIGKVGSSYSQNDKTLEGYYAALDEGRLPVVRGLTLDKDDVLRRTIIQGLMCRFSLSIEAIEDIYAINFAQYFAAEMPQIREFQQQGLLSFDGDFLMVEPKGRFLIRNIAMIFDRHLRERRTHARYSKTI

SEQ ID NO: 8243 - protein, 671 aa, Chromobacterium substugae
MSTPIVRLMQRLSYPQRFAVIGLVFAIALLYLVYGLYRSNQDNIDSTAKERVGVVYMQPLAAMLAQAQQAQELAVRAALGDAQAGNELPAAAQQLQARWQALQDSNSRLGAELASDAAWKDAAAAWDKLKTAPSGSAEQWIAAYGNLSDKLNNLIGAISDNSNLTLDPDIDTYYLMDAATAKLTTLVSHLGEANAVAALAAANHPLAPAQRDRLVELRPLIAEVNDGLAGDIAKAVAYNPSLKPDMATQADKLAAVLKNQLPAIDDAVGGKTGAAGLKVAGHSADAAQAVSAYIAAGLRQLDQLLQARIDRTANQRNTYIAIGVASMLLAIFLFQQLYLSITLQLGGEPLYVQQVVEQLAAGRLDTRIQLRDRDEISLLAAIRQMRNQLRETVAQLLDTARETHRAADAMALSAQSITAGSAQQNEAAASMAAAIEQLSTSLSVCAEQSEQADRLSSDAASRSSDGNRVIAATASSMDGIVRDVSSVSDTISDLGRQSQSIAGIVDVIRDVADQTNLLALNAAIEAARAGEMGRGFAVVADEVRKLAERTALSTTEISTIVGQIQNTAQKGNDSMQLGMKAIMTGQERAREAGSSMDNIRHCVGDVLDSIHQITSSLREQSSASQTLALSVEQVARMSEQNSLAMRDSAQTAGELQAISQRLMGLAERFTV

SEQ ID NO: 8244 - protein, 471 aa, Chromobacterium substugae
MQLFHSLIGAINDVLWGKILIALLLAVGLYFSLRSGLLQLRLFSRGWREMVGGRGGHVSKDDISPFQAFATGLASRVGTGNIAGVAIAIAAGGPGAVFWMWLTALLGMSSAFVESTLAQLFKTSHHDDTFRGGPAYYIQKGLGQRWLGVLFALCLILAFGLVFNAVQANSIVAATQGAWGWQPWAVGLALVALTAPVIFGGVRAVARVAEWLVPVMALIYLAMAFYVLAIHAAELPGLVLLIVKSALGLEQAAGGVAGYAVSQAMMLGIKRGLFSNEAGMGSAPNAAATATSKHPASQGAIQMFGVFIDTMVICTATAAIILLSGAHDQGLSGVALTQKAIESQFGPIGVSFLAVAMFLFAFSSILGNYAYAEGNVEFIRNSKKALLAFRLVVLAMVLFGSLASLPLVWDMADLAMGLMALINLAAIALLSRYFFIVLGDYQRQLKAGVAAPEFKADQYPELAAKVEKGIW

SEQ ID NO: 8245 - protein, 243 aa, Chromobacterium substugae
MKYGSVLFLLWSLFCMAAAPAPWRLVADASFEPYSYLGQDERTPQGLDVELVRAVMLEIGAPFRISLLPWERVKLQLAQKEADAGFVFTGTAERRAQYDLVGPLRKGQTVFITLSQGPLQYWRVLDDLKPYLIGQVHGYAYDTDFDKADLERDLHATSPRQLVAMLLAGRVDVIVGDKLQLLYFIQQLQGESQVRVLSKPLVEMPRYVAFAKGDPRARQFEAALKRLQQNGALQPIFQRWSQR

SEQ ID NO: 8246 - protein, 250 aa, Chromobacterium substugae
MPQQNKQAWPYPEFVAHRGGGTLAPENTVAGFREGIRYGYRAAECDVKLSADNVCFLLHDDTVDRTSNGKGAAQGKTMAELSQLDAGGWKGGAFAGEALPTLANVAAYCLAQDMLLNIEIKPCPGRFEETGRLVAQEAARLWAGAAVPPLLSSFEIEALRAAQAAEPALPRAFLCEEIPADWRAILAELDCVALHCDHKTLTEPLARGIKAAGYQLLCYTVNDPADARRLLAWGVDSLCTDRLDLLPARG

SEQ ID NO: 8247 - protein, 370 aa, Chromobacterium substugae
MAKLSLKNIAKRYPGAERRVLEEISVEIADGEFVVIVGPSGCGKSTLLRMVAGLESTEDGEIRIGERLVNQLEPKDRDIAMVFQNYALYPHMTVAENMGYALKLKGLKKAEVMERVLKVAAVLELEQLLQRKPRELSGGQRQRVAMGRAIVREPAVFLFDEPLSNLDAKLRGQMRLEIQRLHRRLATTSLYVTHDQVEAMTLADRVIVLNKGHIEQIGAPDEIYDRPASAFVAGFMGSPGMNLFDAQADERGERLLLGDGVSLALPAAAPALAGRKLKVGIRPEHLRAADEGGEALSLRVDSVEMLGADNYVYGLMAGHNVVARLAHGHRPEPGSRLEVTVRAEALHLFDAENQRRIAHAAAEQASLAVS

SEQ ID NO: 8248 - protein, 279 aa, Chromobacterium substugae
MVENRKGLDLFCHAMLIAGMLVVAFPLYLMFAAASQDADQVTRVPLSLLPGSQLWTNLSTVLWSGSGGLAVPLARTLWNSFVMAMLIAVGKIVISFLSAYAIVYFRFPLRKTGFALIFATLMLPVEVRIFPTVEVVTKMGLINSYTGLTLPLIASATATFLLRQFFMTLPKELMEASRVDGAGPIRFLIDVVLPLSRTNIAALFVITFIYGWNQYLWPLLVTHDPAMSTSVIAIKGMLGEGAVQWHLVMASALLTLLPPLLVVIGMQRWFVKGLVDNEK

SEQ ID NO: 8249 - protein, 293 aa, Chromobacterium substugae
MQNRIHFSNRWLGFALMAPQLAITLIFFLWPALEALWQSVQQQDPFGLDSQFVGLANFSLLFHDPLYLGTIQTTLLFSALVTLLGTGSALILAVMANQITRGRRIYQTVLIAPYAIAPSVVAVLWLFLFNPSLGWISYLLREAGYEWNHALNGGQALLLVVLASAWKQISYNFLFFYAGLQAIPASLIEAAAIDGAGPLRRFRDLVFPLLSPTSFFLLVVNLVYAFFDTFAVIDAATGGGPGKSTETMILKVYLEGFKGLDLGSSAAQSVVLMAVVGLLTLVQFRYVERKVQY

SEQ ID NO: 8250 - protein, 442 aa, Chromobacterium substugae
MSLALSRTLRRAAALAPLTLALSLPAHAATEIQFWHSMEGSLGDRVNAIAAQFNASQKDYKVVPVYKGQYDESLAAAIAAYRSGNAPAIVQVFEVGTATMIQAKKAVKPVYQVMADAGEKLDEKAFIPAVASYYSDAKTGHLLSLPFNASTPVLYYNKDAFKKAGLPEAPPKTWPELAAAAAKLKASGMRCGYSTGWQGWVQLENFSAWHSLPFASLDNGFGGAGATLQFNGPVQVKHIEFLAKMAKDGAFSYAGRKDEATLKFYSGECGIMTGSSGSLANIRKNAKFNFGMGMMPYDPAVKGAPQNALIGGASLWVMAGKSPAEYKGVARFFKMLVSPEVMAKWHQDTGYLPVVNAAYDLSRKQGFYDKNPGADIATRQMQNKPPKSYTRGLRLGYMPQIRTVMDEELEEVWTGKKTAKQALDSAVLRGNELLRRFEKTAN

SEQ ID NO: 8251 - protein, 336 aa, Chromobacterium substugae
MNEAYFLPAIFAGLMALSMLVYVVLDGFDLGVGILLPLADDEEKDLMIASIGPFWDANETWLVLGAGLLLVAFPLAHGVVFGALYLPVLAMLVGLILRGVAFDFRVKAQDPHKPWWNAAFAGGSLLAALAQGVMLGRYLTGFADSSTSWLFSLVVGVGLALAYALLGACWLVMKTHGTLQAKAIRWAQLSLYGAGAAVAAVSLVTPLANPAIAAKWFALPQFLLLLPLPLGSLALFGLLMLSLPRLARRQAAGNDAFCWLPFAASVGIVLLSFWGLAYSVFPEVVLGQMTIWQAAADPEALWVILWGAIVVLPCIIGYTAFAYRVFWGKADKLSYQ

SEQ ID NO: 8252 - protein, 446 aa, Chromobacterium substugae
MELDPVTLARIQFATNISFHILFPTINIAMAWVLLFFKVRFRQTGDQGWMDAYAFWVKIFALSFALGVVSGVTMSFQFGTNWPGYMQTVGNIAGPLLAYEILTAFFLEAGFLGIMLFGRSRVPEKVHTLATLLVAGGNTLSAFWIIALNSWMQTPAGFVMRDGRAHVLSWIEVIFNPSMPYRLTHMLLASGLTVAFLIAGLSAYRYLRGDRGRGVMLALKSGVFLAALLIPLQMFVGDMHGLNTLKHQPAKLAAIEGIWHTEKNVPLLLFALPNAETRSNDYAVGVPELGSLILTHKWGGEIKGLNEFEQHPPVAKVFWSFRVMVAMGGLMLLASWLAAWQLKKRGELAKPLARLLVGMTFAGWIATLAGWFVTEIGRQPWLVTGVLTTAQAAGKATAPMLFTSLGTYLALYALLLLAYISVLFHLARKAGAHETADAKQLKEQLA

SEQ ID NO: 8253 - protein, 188 aa, Chromobacterium substugae
MNTPPLVQAFVLHFGEMGSRWGINRTVGQIYALLYVSEKPLNADEIGEAIGCSRSNVSMGLKELQSWRLVKLQHFPGDRREYFSTPEDVWLIFKTLAEERKKREVEPTLTMLRGAMMEHPASEAEQHAQARMKEMYQLIELVTTWFSDIQHMDVETLQRLMKLGSQVQKVLQFTQSLSRLGHREEEKE

SEQ ID NO: 8254 - protein, 420 aa, Chromobacterium substugae
MSDLDSQSTLRRLFDAAVASALPKRLVDHLPPPTKGRTVVVGAGKAAAAMARELERAWPGELSGVVATRYGHAVATERIAVLEAAHPVPDKAGCAAAQRILEAVSGLTADDLVICLLSGGGSALLTLPADGVSLADKQEVSRQLLACGAGIDEMNAVRKHLSAIKGGRLALACAPAKLVTLAISDVVGDDPAVIASGPTAADPSTYADARAVVAKYGLTLPPAARALLAAEPDETPAPGDARLAHAEYRLIATPQLALRAAAAEAKRLGLNVLLLGDSIEGEAREAAKVHAGIARQIAAHGSPVARPALILSGGETTVTLKGKGRGGRNSEFLLALAIALNGLPGVYALAADTDGIDGSEDNAGAFISPDTLARAAALGVDAGARLADNDGYGFFAALGDLLVTGPTHTNVNDFRAILLL

SEQ ID NO: 8255 - protein, 846 aa, Chromobacterium substugae
MSTPQHTPMMAQYFSLKRDHADKLLFYRMGDFYELFYEDAEKAARLLDITLTARGASAGVPIKMAGIPYHAAEGYLARLVKMGESVAIAEQIGDPALAKGPVERKVVRIVTPGTLTDAALLDDKRDNLVLAVNMVKGVLGLAWLSLASGEFKVMQADVEDLSSELERLKPAELVIPDDTGLAAFEGISTPKKKLPPWQFDIESSKLALTRHFGTRDLAGFGADTLPVAVGAAGALLEYVKSTQGVNPAHIAALSVEEAGELIRMDAATRRNLELTETIRGEASPTLASLLDTCATSMGSRLLGHWLHHPMRNHGKLARRHGAVRALLARYQDIHAELDQVSDIERITSRVALRSARPRDLSALRDSLTALSGVKALAASLDSELLKELAGVLPVDSPVQKMLVASILPEPATFLRDGGVINNGFSPTLDELRAIQTDCGDFLLKLEAREKERTGITTLKVEFNRVHGFYIEVSKAQSDKVPDDYRRRQTLKNAERYITPELKEFEDKALTAQDRALALEKQLYEALLDELAPHIAELKLIAQAVAALDVLSAFAQRAAIGNYAEPQFVPEPKLDIVAGRHPVVEAEVERFIANDTRLSAERKLLLITGPNMGGKSTYMRQNALITLLAHVGSFVPADSAVIGPIDRIFTRIGASDDLAGGRSTFMVEMTETANILNNASEHSLVLMDEVGRGTSTFDGLALAWAIARALIEKNRAYTLFATHYFELTTLAGEYPAVANVHLSAVEHKDRIVFLHHVEDGPASQSYGLAVAQLAGVPGKVIRDARRHLADLENQSAARVQPDLFAAPAPAAEPEPHPALEKLQELNPDNLSPRQAMEILYELKKLTD

SEQ ID NO: 8256 - protein, 141 aa, Chromobacterium substugae
MSFETASAVSSLSQLLGQIEDDGTIALSDIREKANQELSYFANLAQQELHQFDISMPPAISLVSNDQCQLVLENQHPHEAEIHEWLDGNLILARKFKEIEVLFELVRAAESAGELFSENSNFHVGLTSAGPIAYFEDHHSH

SEQ ID NO: 8257 - protein, 225 aa, Chromobacterium substugae
MPQLILLNKPYGVICQFSDHPTHPTLKSCVQQPGVYPAGRLDTDSEGLLLLTGDGALQHRIADPRWKLPKTYWVQVEGEPKEEQLELLRRGVDLGDFVTRPAEVRRIDNPELWPRNPPVRFRKTVPDCWLEIIISEGKNRQVRRMTAKAGLPTLRLVRVAIGPWKLDGLQPGEMRALEVDLAALPRSGSAGRGGKPGDRTPPRQAQAADRGGKAPTFRFARGKKP

SEQ ID NO: 8258 - protein, 745 aa, Chromobacterium substugae
MPAEQSKIIYTLTDEAPALATSSFLPIVQAFAGSAGVQVDTADISVASRVLAEFPDYLTDAQKVPNTLAELGKLTLQPEANIIKLPNISASVAQLAACVKELQSKGYNVPDYPENPANDAEKAIKDRYSKCLGSAVNPVLREGNSDRRAPLAVKNYAKKHPHSMGEWKQWSQTHVSHMHHGDFYHGEKSITLDKAREVKMELTTKSGQTVVLKPKVALQAGEIIDSMFMSKKALCDFYEREMEDCRESGILFSLHVKATMMKVSHPIVFGHCVKIYYKDAFEKHGKLFDELGVNVNNGMATLYEKIETLPASKREEIIRDLHACQEHRPRLAMVDSAKGITNFHSPNDIIVDASMPAMIRAGGKMWGADGKPYDAKAVMPESTFARIYQEMINFCKWHGNFDPRTMGTVPNVGLMAQKAEEYGSHDKTFEIQQDGVANIVDLATGEVLLSQNVEAGDIWRMCQVKDAPIRDWVKLAVTRARNSGMPAVFWLDPYRPHENELIKKVHAYLKDHDTNGLDIHIMSQVRAMRFTLERVARGLDTISVTGNILRDYLTDLFPIMELGTSAKMLSIVPLMAGGGMYETGAGGSAPKHVQQLLEENHLRWDSLGEFLALAVSLEDLGIKTGNAKAKILAKTLDLATGKLLDENKSPSRRTGELDNRGSQFYLSMYWAQALAEQAEDKDLQARFAPVAKQLADNEQTILAELKAVQGKSADIGGYYLPDAAKCSAVMRPSATFNAAIAAVQG

SEQ ID NO: 8259 - protein, 81 aa, Chromobacterium substugae
MVGFTSLFSQGCEMAFGTVKWFNDAKGFGFITPDEGGEDLFAHFSAINMQGFKTLKEGQRVSFEVVSGPKGKQASNIQNAA

SEQ ID NO: 8260 - protein, 295 aa, Chromobacterium substugae
MNSDKDGIDAFLDQLWLSDGLSQNTLAAYRRDLAKLSGRLQAAGATLAQADAEQLRQALLAGVDSEKPATRARLTSALRRYYQHLAQSGQRADDPSAGLATPKQGLRLPKSMSEQAVEALLLAPDVATPLGLRDRAMLEVLYASGLRVSELVGMTLTQLNLLDGVVKTMGKGSKERLVPLGEIAQDWLLRYMREARPLLLAGLPCDAVFVTQRKAGMTRQMAWHLISQYAARQGLAKVSPHVLRHAFATHLVNHGADLRVVQLLLGHADISTTQIYTHVARERLKQLHARHHPRG

SEQ ID NO: 8261 - protein, 171 aa, Chromobacterium substugae
MIKAQGSALRFFYWETGMEYPVVIAAPFGRLGVRCEDGELRGLRFLPAGAVLRPPAPGSLEAEVERQLDAYYADADHAFSVPWRLLGTPYQLRVWQQIAAIPRGETRRYLDLSRDLASSPRAVGGACGRNPIPIIVPCHRVVASAGLGGFNQSRGDETLDIKRWLLRHELG

SEQ ID NO: 8262 - protein, 122 aa, Chromobacterium substugae
MDLIQKLEQEEIARLGKTLPEFAPGDTVVVQVKVKEGNRERLQAYEGVVIAKRNRGLNSAFTVRKMSAGEGVERTFQTYSPLVASVEVKRRGDVRRAKLYYLRGRTGKSARIKEKLPARKQG

SEQ ID NO: 8263 - protein, 255 aa, Chromobacterium substugae
MQIDAVTLFPEMFDSIARFGVSQRALDLNLWGFKAWNPRDFTHDNYRRVDDRPYGGGPGMVMQIEPLEQAIASARNRQQAAGVERSHVIYLSPQGARLSHAKAVELSQRPGLILLCGRYEGIDERLIETAVDEEISIGDYVLSGGELPAMVLTDAVVRLLPGALNDAQSAYEDSFVDGLLDCPHYTRPEEYRGMRVPDVLLSGNHALIAKWRLKQSLGRTWKRRPELLQDRVLTKQESRLLAEYQQEQDIRKKPE

SEQ ID NO: 8264 - protein, 168 aa, Chromobacterium substugae
MRDEDLVVMGFVRGAFGIKGWVKIHADTEHADGLFDYPVWWLGKDGSWKPHAFENGTIQPKALAAKLEGVEDRDGAEALRGMQIAVPRSELPEAGEGEYYWSDLIGLAVVNQQGETLGAVDSLMETGANDVLVVKGEHGQRLIPFVDQYVLEVMPAEGRILVDWGLDY

SEQ ID NO: 8265 - protein, 83 aa, Chromobacterium substugae
MVVIRLARGGAKNRPFYNIVVTDSRNRRDGRFIERVGFYNPVANEKQERVRFTMDRLNYWVGVGAQLSDSVAKLLKEQKVVAA

SEQ ID NO: 8266 - protein, 892 aa, Chromobacterium substugae
MRPHYLTPLFSPRTVAVVGASDRPGSIGQAVFANLLASSFQGKLFPVNLNHKVVGGIPAVASVRQIDEPVELAVVVTAIRSLPAIVKDCGKKGVKAVLLAKEFSDSEQLEQELINEALSIARHFGIRILGPNVLGLMRPVAGFNASNYSGKVRPGNLALVSESSALCAAMLDWADSKEIGFSSVISLGGALDVGFGEILDYLVADNATQGILLHVHHIHDARRFMSALRAAARTKPVVVIKSGRFESDARGLTHSSNLVASGEVFDAALARAGVLRVSSIAQLFTAAKVLAANYRVGGKRLAIVTNGFGPGMLAADSAVDYGVELAKLGEGTVKLLDSVLPRNWSRGNPLDIIGDASPMRFRTAVKACVDDSGVDGVMVIFTPQAGTDHLTTAQLMIGLQRETTKPLFLSWLGDAKVSESRELFSKAKCAHFRAPEYGIEVFRHLAAYQHNQQLLLQTPGPLEGKRSGPDAAAARKVIDRALAEGRNILSERESKQVLAAFRIPVNPTTLARNADEAVKQADKIGYPVVLKIDSPDIIYKSDVGGVELNISNEATLRAAFDAILSRTRQARPDARIDGISVQPMRKRRFAREVMVGVAHDIAFGPVIAFGAGGIAVEVMRDLALALPPLNDYLVDNMVAQTRIGELLGPFKNLPPVDLDELRHVLLQVSEMVCELPQLREMDINPLVADEKGVIALDARIFVEPARADLKRYGHMAIMPYPSHMVICAKLSDGTPVMIRPIRPEDADMQQAFVRNLSEESRYNRYLSSIKQLSQSMLVRFTQLDYDREMALAMTRDDQGAEQMLAVARFITDPDNEACEFALEVADDWQGRGIGNLLMQALFDAAREQGLKIMRGEVLAGNKGMLKLMHKLGFSIEAHPEDRALSLVLKTLQ

SEQ ID NO: 8267 - protein, 116 aa, Chromobacterium substugae
MWPHARSSSETMSIGAGALGQPLRAPAYAIPGPRGAAARPALIMRAKSFRHIDFGQAADKCISCHRQRRFSPPPRPASSADFTILLIFTIPQQTLLRCTIQPPRPARPVRQEPTQP

SEQ ID NO: 8268 - protein, 305 aa, Chromobacterium substugae
MTKRVVTLAHYYTQPEIQQMADKVGDSLELSLYAKEAQADIIVFAGVRFMAETAKILNPQATVILPDAGSTCSLVTQTDVAELTQWRKRYPDHVHVSYINSSAEHKAVSDWIVTSRNVDDIIAHLYAEGKKVIFSPDRNMGGYLNDQYGYDMPLWSAVCEVHDKFNEAALNEAFEAVPGEKYLIAHPESPLPVLKKADYVGSTSGMLNWVKAYQGDAKAVIFVATEDGILYNMGLARPDLDLRQAPIYAGCQCNSCPYMKMNTIEAVKRAQQGQGLEIDYLTPAQMDAARVPIERMLEFSQRYYA

SEQ ID NO: 8269 - protein, 247 aa, Chromobacterium substugae
MKFLLSNDDGYSAPGLAMLAATLSRYGEVVVVAPERDRSGASNSLTLDRPLTVRTAANGFHYVNGTPTDCVHLAVTGMLDFKPDMVFSGINNGPNMGDDTLYSGTVAAATEGFMLGIPSIAVSLAGYSGRHFSTAGKVVAQLVERCLEQPFQQPVLLNVNVPDVPEDALGPLSVTRLGRRHAAQPAIKSQNPRGETIYWVGPVGAVQDAAAGTDFGCVAASQASITPLMLDLTAFGQLDRISTWLHR

SEQ ID NO: 8270 - protein, 222 aa, Chromobacterium substugae
MASPLTQNGQAYGMLSERTRRRMTDRLRQNGISDERVLKAMHEVPRHLFVDQALATRAYDDVSLPIGHGQTISQPLTVARMTELLLQGRQPGKILEIGTGCGYQAAVLLKTGAEVYSMERLAAILDQARRNLRASKLVNARLVHGDGNAGLPEAAPFDGIIVAAAARSIPGALVDQLAEGGRMVLPLGETEQHLWLLEKTSQGVQKTKLDPVKFVPLLNGRS

SEQ ID NO: 8271 - protein, 385 aa, Chromobacterium substugae
MKLQKRNTIAVRQSSKTLIQRFNKKNMLKMHCRYAYILVAALGAGLAGCSSMVQQAAPVESAAPAPVGQSKPAQTAPAVPAATTGNTVATPYRDQGSLAVQPVDSGAAAAGEQTYVVKPGDNLFRISLNHGLKYKDVAAWNNLPDTGIKVGQVLRLTPPGGSMPSAAAGTAPVTVATSPAAGQSAAGAGAVKAYPKALKLPYGSDAAKELAAQSEGRQVGKNNAQASGSAAAPAPGKKPEASAAVIAPAPAKDASAPAAKADEDAVAWGWPTEGKVSKGYSDSNKGVEIAGRMGQPVLAAGDGKVVYSGAGLRGYGKLIIIKHNKTFLSAYAHNSQLLVKEGQSVKKGQKIAEMGNSDADQVKLHFEIRRFGKPVDPMQYLEHKS

SEQ ID NO: 8272 - protein, 312 aa, Chromobacterium substugae
MDILDENELLDEEGGEEAAAETEAEEAAESTAVFEDVVADVTQIYLNDIGNNALLTPQEELALARRVVAGEFEARQKMIEHNLRLVVNIAKHYINRGLALLDLIEEGNIGLMHALEKFDPERGFRFSTYATWWIRQSIERAIMNQSRTIRLPVHVIKELNVYLRASRHLESQIGREPSIEEIAHLVGKPVEDVRKVMNLNERMASLDAPLDIDPMLSIGESIPDEQHEEPELQLHNNQLEMFVHDWLSQLNEKQRLVIERRYGLNGYEICTLEELAASLSLTRERVRQIQIEGLEQLRRILRRKGISRDFLL

SEQ ID NO: 8273 - protein, 316 aa, Chromobacterium substugae
MSPFRERLRRWLLARLPLEERCELSQRRIYLLPTRFGLLLLAVALAVWVGALNYQVSLAYALAFWIVSLVLVAVLMAYRQLSGLRLRAEPGAAVFAGDAARFRLLLDNPSPLQRQLQAYVQQPGAPRLPCTLDAMASGCVELELRADSRGWLALPACVVASEAPFGLIRAWAVLRLQARLLVYPAPLPDAASGVSEGEGGEGRESLPDGDDFSHLDAYRHGDTPRRIAWKVLAQRDVLASKRFAGEGGGELMLLRWSDYALEPDAERRLSRLAWRVERCERRRQPYRLCLPGGEIGPQPRQREQALSALALYGERP

SEQ ID NO: 8274 - protein, 300 aa, Chromobacterium substugae
MQSLSQAYRQLNTLILGKPQALRLAFACLIARGHLLIEDVPGVGKTTLAHGLATVLGLDYRRVQFTSDLLPADILGVSIYQRDSGRFELHKGPVFTQVLLADEINRASPKVQSALLEAMEERQASIDGDTHALPSPFFVIATQNPGEQMGTFPLPESQLDRFLMRISLGYPPREAERALLMGEDRRSLLERFQAVMKPDELLALQRKAAAVVVSPALAEYLLALLEATRQSGVFATGLSPRAGQALAAAARGWALLAGRDHLLPEDVKAVFLPVAAHRLQAAAGGVERELERLLTHVAIP

SEQ ID NO: 8275 - protein, 319 aa, Chromobacterium substugae
MFTWLKNRLQRNGLTAYVTHADCLQHNMGAGHPECPERLTAIRDQLMASQIYDSLQEVEAPEATYEQLARVHPPRYVEYLEACAPSVGTFRMDPDTAMSPGTLQAARRAAGAVVKAVELVAEDKAANAFCAVRPPGHHAESDKAMGFCFFNNIAVGVTHALTHYKFERVAVVDFDVHHGNGTEEILHDDPRVLMVSIFQHPFYPYCGDEPSGPNMHNVPLKAGSGGREFREAVENVWLPLLHDFQPQMLFISAGFDAHREDDMGSLGLVESDYEWVTRHLMQIADQYCAGRVVSVLEGGYDLSALGRSVAAHIRALSDG

SEQ ID NO: 8276 - protein, 222 aa, Chromobacterium substugae
MKNWLRNNRGFLVFLLVFGLFRTAVADWNPIPSASMRPTLLEGDVVLVNRLAYDLKLPLSNIVIHPLGEPRRGDIVTFSSPKDGTRLIKRLVALPGDVVEMRDEELWINGRSAHYQPLQRLMENVAADTALPALRAEESGVLPAHRVQWLSGVDARSSFGPITVPAGQYLMLGDNRDDSADSRYFGMVPRHLLIGRAVGVIASADITANWMPRWERFASGFR

SEQ ID NO: 8277 - protein, 206 aa, Chromobacterium substugae
MTTTAFAFVIAAYLIGSLSFAVIVSKAMGMADPRSYGSGNPGATNVLRTGKKLAAALTLLGDGAKGWLAVALANWLGPRYGLGEQGIALCALAVLFGHMWPVFFGFKGGKGVATAVGILLGINVWLALAALATWLFMAFVVKISSLSAIIACVLVPVYAFFILGPHSVFFGTCIIIAIVVVHRHKSNLIKLMTGQEDKIGNKGDAG

SEQ ID NO: 8278 - protein, 119 aa, Chromobacterium substugae
MDIIFLREVRADTVIGVYDWERKAAQTIEIDLEIGIPSDTPCHSDNIGDTIHYGVVVERLRKSLAEQHFLLIEALAEHIAKLVREEFGAPWVRVAVTKLGILPGVKRVGVEIERGHRPH

SEQ ID NO: 8279 - protein, 93 aa, Chromobacterium substugae
MGRRLLLLLALGCQSAWGACLPQALMCASPRDAAVQKQDLDPKGFQLGPIRFESDPASQTLRLTPAMDLGKHTHLSVRMHHKDVGLRLKFNTD

SEQ ID NO: 8280 - protein, 129 aa, Chromobacterium substugae
MSEVQEMTPYQLLGGEGVVRWLCDRFYQIMDSEPAVAPLRAMHPADLAGSSQKLFMFLSGWLGGPALYMEAFGHPRLRMRHMPFAVDEAARDQWMWCMSRAVDELVAEDWLKQKLLEAFYNTADFMRNQ

SEQ ID NO: 8281 - protein, 416 aa, Chromobacterium substugae
MAVLGAGVVGVSTAWFLARMGHEVVVLERACGAARETSFANGGQLSVSQSEPWANPRAPWQVLRWLWRDDAPLLFRPRLDPSQWRWAADFLRECLPGRHLANMRQMVALGLYSRDAMRQLRDETDISYRRLSRGILSLHYDASQLRRAERSAAHLQALGVDKRVLSPGQLLALEPALEPVLPQLAGASWCPDDESGDVHLFTRGLAEAAAGLGVEFRYNTRINALETADGAVAAVSVTGPDGSYQQVKADAYVLALGSHSPLLAAPAGLRLPIYPAKGYSATVPVKSLVAAPMVSITDEACKLVFSRLGNELRIAGTAELAGYSSSLNPVRCQALIRRGRALFPDACDWDAARFWSGLRPATPGNVPLIGKSALDGLYLNTGHGTLGWTEGAGSGRALAEIISGKRPRLDFAFCGL

SEQ ID NO: 8282 - protein, 285 aa, Chromobacterium substugae
MNKLPPVVLPKIEFNREFAFSDADFERIRKLIYKEAGIALNPSKKDMVYGRLVRRIRELKLPGFAAYVDFLESAGGKREFEQFVNALTTNLTFFFREEHHFPILSEHLKKKAAASGELSIWCAAASTGEEPYSLAITALEAFPGMTKPNISVLATDLDTSVLETGRKGIYPADKIARLPAGHAVKYFDKLPDGSYQAKPALRNMITFQRLNLVEGNWSVKKQFDAIFCRNVMIYFDRDTQFGVLKRFAPLLKPDGLLFVGHSENFYFASDYFHLRGKTVYEHAKK

SEQ ID NO: 8283 - protein, 117 aa, Chromobacterium substugae
MTEAATEMPCPINFTDSACAKVQDLIAEEGNPDLKLRVFVTGGGCSGFQYGFTFDEIANEDDTAIERQGVTFLVDPMSYQYLVGAEIDYQESLEGSQFVIRNPNATTTCGCGSSFSV

SEQ ID NO: 8284 - protein, 342 aa, Chromobacterium substugae
MVKVGIVGGTGYTGVELLRLLAKHPQARVTAVTSRKDAGIRVDEMFPSLRGRIDLAFSTPDEARLSECDVVFFATPNGIAMQEAAALLDAGVRVIDLAADFRIQNVSEWEKWYGMPHAAPQLVEQAVYGLPEVNRAAIRSARLVANPGCYPTAVQLGFLPLLEAGAVDASSLIADCKSGVSGAGRKGEIGALLAEAGDSFKAYGVAGHRHLPEIRQGLARATGKPAGLTFVPHLTPMIRGIHATLYARLSKDVDLQQLFENRYAGEAFVDVLPAGSHPETRSVRGANLCRIAVHRPQGGDTVVVLSVIDNLVKGAAGQAVQNMNLMFGLPEQDGLDVVPLMP

SEQ ID NO: 8285 - protein, 130 aa, Chromobacterium substugae
MNGKYYYGTGRRKSSVARVFMQKGSGQIIVNGKPVDEYFARETGRMVIRQPLVLTENLESFDIKVNVVGGGETGQAGAIRHGITRALIDFDAVLKPALSAAGYVTRDAREVERKKVGLRKARRAKQFSKR

SEQ ID NO: 8286 - protein, 142 aa, Chromobacterium substugae
MKTFSAKPHEVKREWYVVDAADKVLGRLAAEIARRLRGKHKPEFTPHVDTGDFIVVVNVEKLRVTGTKALDKKYYRHSGYPGGIYERTFTELQNQFPERVLEKAVKGMLPKGPLGYAMIKKLKVYSGSEHPHSAQQPKVLEI

SEQ ID NO: 8287 - protein, 236 aa, Chromobacterium substugae
MATPHINAKDGAFAETVLMPGDPLRAQLIAETFLEGAELVTNVRNVFGYTGTYKGKRLSVMAHGMGIPSASIYTTELVKDYGVKNIIRIGSCGAVTPDIKLRELFVAMGASTDSKVNRMRFNDHDYAAIADYTLLRTVVDTAAEQGKKITVGNVFSADLFYGVQPNMLDVLSKMQVNVIEMELAGIYSVAAQYGARAVGILTVSDIIPTGEATSAEERQTSFRDMMEVALDAAIKL

SEQ ID NO: 8288 - protein, 405 aa, Chromobacterium substugae
MKRAIILILDSLGIGAAADAPKFGDAGSNTLGHIAMEAAAGRADIGRCGPLNLPNLSKMGLGHACQLSSGYFPEGMDPAAPLAAYGYAREISSGKDTPSGHWEIAGVPVLFDWGYFSDHDDSFPQQLLDAIVEKAGLPGYLGNCHASGTEILDRLGEEHMKTGKPIFYTSADSVFQIACHEETYGLERLYELCKITRELLEPYNIGRVIARPFVGEGKGKFARTGNRKDLAVEPPAATVLQKLADAGGDVVSIGKIADIYAHVGITHKHKATGFDQLWDATLTAMDQHQDKPAIIMANFVDFDSSYGHRRNTAGYAAALEEFDARLPEVMAAMGDDDILILSADHGCDPTWPGTDHTREHIPVLCYGKKVKAGAIGERATFADIGQSVAAHLGLPRMDYGASFLD

SEQ ID NO: 8289 - protein, 441 aa, Chromobacterium substugae
MFLPQEIIRKKRDGLMLSQQDIQQFVAGITDDSVADSQIAALAMAIYFNGMELEENVHLALAMRDSGRRMHWKDLNLPGPIVDKHSTGGVGDVVSLMLGPMVAACGGFVPMISGRGLGHTGGTLDKLSAVPGYNPFPDPELFRKVVKGVGVAIIGQTSDLAPADRRFYATRDVTATVESIALITASILSKKLAAGLDVLVMDVKAGSGAFMPTMEKSIELASRIVKVGNGAGVATTALITEMSQPLASTAGNSIETREAVRYLKGDERNPRLHEVTMALCAQMLIGGKLASDEADARAKLQAGLDSGRAAEIFGRMVTALGGPADFLENYDRHLAPAPIVRPVYADKAGYVGAMDTRGIGMAVCALGGGRRLASDVLDFRVGLSQFAELGQNIGKDTPLMMIHAADEASFEDAARRVKAAIRIDEIAPAALPQVYQIIRGE

SEQ ID NO: 8290 - protein, 255 aa, Chromobacterium substugae
MSALIEAARRALSLMDLTTLNDDDTDAKVIALCKKAKSQDGTVAAVCVYPRFVPITKKTLREAGCPEVLVATVTNFPHGNDDIAIAVAETRAAIAYGADEVDVVFPYRALMAGDRDIGFELVKACKEACGGKLLKVIIESGELKDAALIRAASEISIRAGADFIKTSTGKVPVNATLEAADVMLNVIREQGGKCGFKAAGGVKSAAEAKQYLELAGGLLGDAWVNADHFRFGASSLLANLQAEIAGGVAKPTAGY

SEQ ID NO: 8291 - protein, 84 aa, Chromobacterium substugae
MTLDAAKPAEMSVCRAFRPVWLSRGRRGDAGRFAFKQAAVVCDLLSREEIFIIHVIAFGKPPSCRPRFLSIGRISREIDHVCTD

SEQ ID NO: 8292 - protein, 734 aa, Chromobacterium substugae
MVSVVRTVADTLADAADPARWLEHMSAAFPAEDGALLARAFDAARELYAGKTVAATGEDLFTHAVAAAAVVADLNLLPDAIVATLMFAAPDFKPEWQAWLTETFNPTVAMLVDGVGGVRRITELARIDKMATPEDGARQAETMRKMLLAMVADIRVVLIKLAWRTQTMHYLAQVPDEALRRRIAGETLELFAPLANRLGVWQIKWELEDLGLRHTEPDTYKKIAKLLDERRLERIDYIERVLDILREELRKAGVKAEVAGRPKHIYSIWKKMKKKKLDFTELYDIRAVRILVDKLPDCYTALGIIHGMWQPIRGEFDDYISHPKANNYRSLHTAVIGPEEKALEVQIRTFDMHEHAEFGVAAHWRYKEGGKGDAAYEEKISWLRQLLDWREEMSDREGLAEAFKTELFADTIYVLTPQGRVLALPQGATPIDFAYAIHSGLGNRCRGAKVEGQIVPLSTPLQNGQRVEILTAKEGGPSVNWLHDGWVKSHRAISRIRQYIRLQNADTVRETGKALFERELARRPHIQPNLQQLAEKLGYDKLEEVHGALGHGELTTRAVANAIGSFAPPPTVEVLPESLVKASKGGPETGGVLIEGVDNLMTVLAKCCKPAPPDQVMGFVTKGRGISIHRSSCITLKKLSQEVPERLIAAEWGKLKNSVFPIDIEVISQDRPGLLRDLSDTLSREKLNLIGVNTLSRDLRSKLRLTVEVRNVQDISRVLSRLMELSGVQEARRV

SEQ ID NO: 8293 - protein, 348 aa, Chromobacterium substugae
MLHSSFATRLVDWQRRHGRHDLPWQVSDPYRVWLSEIMLQQTQVKSVLDYYPRFLARFPDVASLAAAPVDDVLAQWSGLGYYSRARNLHKAAQMVMAEFGGSFPPERERLEQLPGVGRSTAAAISAFAFGRRETILDGNVKRVLARCFGIDGFPGDKAIEKRMWALAEDILPADAAAIQPYVQGLMDLGATVCCRGKPACAACPMVDGCVAAREGRTGELPTPRPKKTVPTRQTVMLLARHGNRVWLERRPPTGIWGGLLSLPEFGATLEIEDWLNARGDGDMLPAWPELEHVFTHFRLIITPQPVRIDQLRAHGAAEADGQWLALDQAVDAGVPAPVRRLLLRLAQV

SEQ ID NO: 8294 - protein, 848 aa, Chromobacterium substugae
MSSFRSRQRNNQRRDLTSRERSANSPAGGNQSPPAASGKPPRADKRQDAGQPRAPYSGQRPGPGKPDWKQTPRQGERSFDKRGPAARAPQEGGFQDKRYDRDRGPSGRKPMPADDARAPAFRREDQPQDKRYSRDRGPSGRKPLHTEDAPPRQFKPRAEGEPRRDDKPQWQNREDSAPRDDNGPRKLFGKGGDNRPPRDDKPWQPREERAPRQFDNRDGERDNRFRRDDKPQWQNREERAPRQSHDRDGERDNRFRRDDKPQWQNREERAPRQSHDRDGERDNRFRRDDKPQWQNREERAPRDDNGPRKLFGKGGDNRPPREDKPWQPREERAPRQFDNRDGERDNRFRRDDKPQWQNREQRAPREDQPARKPLFGKPSADRDAVERDNRFRRENHHDERPRQHPSQGLQPFGDSHRVDSPERRQQFEQRRHDKPQWQASGSKPEITLTGRLDSKLALFAPCPRGLEALLADELKALGADDIAPADGGVAFGGDARLMMAVNLHSRTASRVLLRLAHGPYHAEQDIYRLALSVDWPRWFDVSRTIKLKADGIAARVKSLDYIALTVKDAICDRFRQAQLGRPNVDTRAPDVRVNVFLTADTATIYLDTSGEPLFKRGWREEAGEAPLRENLAAGILMLAGYDGSQPLIDPMCGSGTFLVEAADIALNRAPGRNRRFGFEALASFDQVGWETLRLAASQAEKAPAALDIRGSDRDKKMIAIARANLQRAGLAGLVEAMPADILDVRPGAQAGLIVSNPPYGIRLDELDQLAAWYPLLGDWLKAHFSGWTACLFSGDLRLGKLIRLSPKRRTPLYNGSLACRLFVINMVEGSARKQKDGGEAADDDAAEE

SEQ ID NO: 8295 - protein, 195 aa, Chromobacterium substugae
MQKIIKLAIVALLGASSLLLTGCAQMVMSPAKPSMENIAKIRESNLTPVAVGAFKPAASLSADADKSLSVRGANSLTAPTDGSFSQYLGATLKAELQAAGLLDDKSGAQVSGELLENALDPAMSTGTAALAARFVVTRDGAVRYDRKVEAKSQWESSFIGAVAIPLAASQYEGLYRKLVSQLLADEDFRKALAKN

SEQ ID NO: 8296 - protein, 207 aa, Chromobacterium substugae
MIFKNYKLFSGANRWFAACLLAGSSLLTGCASVYVDTATKNVPVSELKKPASPQPVQLVFEFQNQGMPVPRATEFLQAAVKTQVAESGLFSAVATQPTAGAPILNISLNNIPLNQGNAGGFVTGLTFGAVGTAVTDGYVCTVSYLPAGSSKPIVKTARHAIHTTIGNAEPPAGAKKSANVGEAVLQMTHEVLSNALRDLSQDSGFGN

SEQ ID NO: 8297 - protein, 200 aa, Chromobacterium substugae
MQTSFLSATILLILITDPLGNIPLFIAALKQVKPERRRRVVYRECLIAFLVLTIFMLFGRNFLELMHLTDESMRIAGGVILFLIAIKMIFPGEGSVFGGDKLHGEPFIVPIAIPLIAGPSAMATVLLLSTREPGRMLEWMGALTICMLVTTVTFLFSSRLQKLLGEQAITALERLMGLVLTAISVEMLLSGFASYLKQLH

SEQ ID NO: 8298 - protein, 441 aa, Chromobacterium substugae
MQTKTPFYSRLYVQVLIAIAAGVLLGSFMPDFAAKMKPLGDAFIKLIKMLIAPIIFSTVVVGIAKMGDMKEVGRVGVKSLLYFEAVTTLALVIGLIVVNLLQPGAGLNIDPHTLHAKDIAKFTAGAKDMNTVDFLLHIIPDSVVGAFASGEILQVLTFSVLLGLALTKMGDNGKNIVHILDEFSHALFGVINMLMKLAPIGAFGAMAFTIGKYGIGSLKQLGFLMACVYLTCFAFVFIVLGAIARFSGFSLWKFLVYIKEEILLVLGTSSSESALPGIMKKLENLGCAKPVVGMVVPTGYSFNLDGTSIYLTMAAIFIAQATNVNLTLGEELAIIGVLLLTSKGAAAVTGGGFITLAATLATLGGKLPVEGLALLIGIDRFMSEARAITNLIGNGVATVVIAKWEKALDVEKMRLVLEGGEPPAPPKERREAMPEPALQTR

SEQ ID NO: 8299 - protein, 220 aa, Chromobacterium substugae
MEDFWIQYGDDMLPVIGDFPRKGNYLPSFMLVDDQKHDAALESFSHTPKLIVTLLSVDEDEHAGLLLLRETRRFLDSWPHLKLIVITVDSPSSLERARHEHGLPNIALLSTLRGRDFHKRYGVLITEYPLSGYTAPSIILADTANVVHYSERLANTRDFFDFDAIEKLLQEGEQQAMAAEREAEEARQQQDAEREKGTERLLEKAKQIQDQLGRNIDPGR

SEQ ID NO: 8300 - protein, 795 aa, Chromobacterium substugae
MAENYVIWFEKLRMTDVEEVGGKNASLGEMISQLAGSGVRVPGGFATTAQAYRDFLQHNGLADKISAALAKLDIDDVSELARVGKEIRQWIIDTPFPAKLDADIKEAWVQMVADAGGADISVAVRSSATAEDLPDASFAGQQETFLNIRGLDNVKDAMKHVFASLYNDRAISYRVHKGFAHDVVALSAGVQRMVRSDTGAAGVMFTIDTESGFEDVVFITASYGLGETVVQGAVNPDEFYVHKPTLRAGRPAVLRKTMGSKLIKMEFTDASQAGRSVKTVDVAPELRKQFSITDAEVAELAQYALIIEKHYGRPMDIEWGRDGLDGKLYILQARPETVKSQEDRKDTLRRYRLNGKSEILCEGRAIGQKIGQGTVRTIRDASEMDQVKPGDVLVTDMTDPDWEPVMKRAAAIVTNRGGRTCHAAIIARELGIPAVVGCGDATRVLKAGMEVTVSCAEGDTGNIYDGLLDVEIIDLELDKMPKAPVKIMMNVGNPELAFDFAQLPNEGVGLARMEFVINRQIGIHPKALLEFDKQTPELKATIADRIAGYASPVDFYVDKIAEGVSTLAAAFYPKKVIVRMSDFKSNEYANLIGGQLYEPHEENPMIGFRGAARYVAESFRDCFELECRAIKKVRDVMGLTNVEVMIPFVRTLAEAEKVVEILADNGLKRGDNGLRLIMMCELPANAVLAEQFLQHFDGFSIGSNDMTQLTLGVDRDSGGPIASTFDERNEAVKAMLHMSIQACRKMGKYVGICGQGPSDHPDFAKWLVEEGIETVSLNPDTVVETWLYLAKELNS

SEQ ID NO: 8301 - protein, 273 aa, Chromobacterium substugae
MSHRRSAFFISDRTGITAESLGHTLLTQFDALDFKRETVPFVDTVDKAKTLAQRISDIAERDHLRPLVFTSIVNPEVREALRLENVVLIDFFETFIGHLEAEIGQKASLSVGKAHGMVNEEKYDHRMEAVNFSLNHDDGVKLKDLDEADVILVGVSRSGKTPTCLYLALQYGIRAANYPLTPEDLGSPTLPKLLLPFKDKIFGLTIDPARLHNIRSERRPDSKYASMDNCRREVNEAESMFRHHGVTFISTTHKSIEEIASTIMHKAALGRKF

SEQ ID NO: 8302 - protein, 77 aa, Chromobacterium substugae
MDEHQVDVGLAVAWPRTMEPVINAQPASGKRLLATCLATMSGAGRTRTLSCYEKDILHARAVGGKPLKTYVPAPPCA

SEQ ID NO: 8303 - protein, 205 aa, Chromobacterium substugae
MLIHRQLPAARRESLREQGWPVEAFIHDLHTLQYFFDHVDRPSGVPSLASMVNDGRLLCGDEALAAQAKAMAQAALRRGPPPWDAAARDASRYALTDLVDDIRAPFSDFALRAALAQLLPLLANHYLRGRGLWSAKGKAIARRLAQVDPGYAARFDAAFRLAFHSGETAPLIQLAADTLQADGGWLFQSYQFTAPADWRCEPVYG

SEQ ID NO: 8304 - protein, 179 aa, Chromobacterium substugae
MLFLKASGFYCSCLNKKFTNKQRDRVLLLILSLAYQGAGLVGARIPRNHGGDGEKRSIKMKSKQNEAGGLVYSTEHGRMCPQCRQPLAQCECGKPAAPAGDGIARVARQTKGRGGKEVTVVKGLPLAADALARVGKQLRTRCGSGGTVKDGVLEIQGDHVDTVIAELEKLGFKSKRAGG

SEQ ID NO: 8305 - protein, 99 aa, Chromobacterium substugae
MNIPDFNLPPIAAARRWPQQLAGVQAGRQLTSEQQHEFAEMLFRTVLQNPPHGASPFTLAGGPVDHPARPPARPARQRSAARAYGKDLPQAGFLLQTQA

SEQ ID NO: 8306 - protein, 340 aa, Chromobacterium substugae
MNLDNISSQDIILTGDRTTGQLHLGHYVGSLRNRVILQERCAQFLLLADAQALTDNMGNYLKVRDNVLQVALDYLAVGIDPAKSTIFIQSLVPELTELASYYLNLVTVARLERNPTIKDEIKQRGYERDIPAGFLTYPAAQAADITAFKATIVPVGDDQIPMIEQTNEIVRRFNASVDQTVLVEARAVVPEVGSRLPGIDGKAKMSKSLGNTLTLSASPDEIRQAVKMMYTDPNHLRVADPGQVEGNVVFTYLDAFHPDQALVAQLKAHYQRGGLGDTVIKKHLEDCLQEMLAPIRERRERYAQDPAAVLEMLKSGTRRARDVAARTLAEVKAAMGLNYY

SEQ ID NO: 8307 - protein, 102 aa, Chromobacterium substugae
MEHLYQCQSLDEVRGQIDRIDRELVALIAERGIYVRQAARFKESRAEVEGGKRVDQVMRRVERLAGEMGADAALTAAIYRAMITHFVADELQAYRQRFANSD

SEQ ID NO: 8308 - protein, 155 aa, Chromobacterium substugae
MKKTALLLACLLAAPFARAEEIGEVSTTFKLLSPNDKVVVEAFDDPAVQGVACYVSRAKTGGYKGAIGLAKDPSRFSVACRQVGQIRFGRPLPPQEQVFKESASFVFKHVRVVRIVDAKRNVLTYLTYSDKLVDGSPDNAISAVAVLDQKIPLKK

SEQ ID NO: 8309 - protein, 258 aa, Chromobacterium substugae
MNTLEVTILGCGSSSGTPAIGCRCATCLSDEPRNQRTRASAYVRVGELGFLIDTGPDLRQQALREGLSRLDAVLYTHPHADHLNGIDDLRAFCYLKQGPISLYGNDFTMSNIRERFGYALQAPSKMWDKPVLLPETVHGPFEHQGVKLTPIPLRHGSWPCLGWRIGNMAWLTDLSDIPESSLPLLQGLELLFLDCLNHDPYPSHLGVGQAFDWAARIGARRTVLIHMTHRLEYHALGALCPPGVEVGFDGWQAKLAMG

SEQ ID NO: 8310 - protein, 129 aa, Chromobacterium substugae
MHLRHFAAGMLIGLASLAAAANCVNLGGRSFCAPPGGQAVLHQGNAYCGAGACVADEFGNLFCSPYPGGGAIRAGGAFYAGPGMCLLGPDGSPRCAARPGGSCQVAADGQIQCDGGTVAAPAVRPLLCQ

SEQ ID NO: 8311 - protein, 256 aa, Chromobacterium substugae
MLIDSHCHINFPDLAARLPEVLGNMRENRVTHALVIGVSRPKYPQVLALAEAHANLYATVGVHPDDPEAEEYSEDELVELAGHPRVVGIGETGLDYHWCKGDLAWQHQRFRTHIRAARRVNLPLVIHTRESAADTIRIMQEEHAEQCGGVMHCFTETWEVAEAALALGFYISFSGVVTFKNAKQVQEVAQKVPLERMLIETDSPYLAPVPHRGKQNEPAYVRHVAEFIAELRGVPVEQVAAATTENFFRLFAKAER

SEQ ID NO: 8312 - protein, 125 aa, Chromobacterium substugae
MDAANTRPDLNNPNRPGVLSLHIKERSALFAAYMPFVRNGGIFIPTNKEMQLGEEVFLLLTLMEDPQRIAVQAKVVWITPGGANNSRVQGVGVEFVSGEAGKQAKDKIEALLGGVLNSSRPTHTM

SEQ ID NO: 8313 - protein, 334 aa, Chromobacterium substugae
MLYPWQNHDWRRLNAERQRMPGAWLFTGGAGIGKLAFARHLAQSLLCEAPQAEHQPCGQCQGCRWFASGTHPDFRLLSPFADEEEEGKEAKAVRKLPQIKIEAVRDVIDFAHLSAHRAGRRVILVEPAENLNPAAANALLKILEEPPEAVLFLLVSHAQQRLLPTIRSRCRQFALTRPGAAAALAWLREQGVANAEIELAHNGGAPLFDHDPELAALRGQFVKALGQPSFAGMLQLAELADKNKQLSLLQPLNWLQKWLHDLAALCLAGRVRYYPDQERALSALAPRCDLAQLMACQQALAALAPFSQHTLNIRLQLEAVLMDYLKIFAGAKPA

SEQ ID NO: 8314 - protein, 214 aa, Chromobacterium substugae
MPIEQSARRGRFITLEGIDGAGKSTHLGFIRDWLAGRDIDAAFSREPGGTPLSEKIRELLLAPETVVSLDAEALLAFAARQQHIAEVIEPALAAGRWLVSDRFTDSTYAFQGGGRGIPFERIRVLEDWVQRGLQPDLTLLFDLPLEVAAQRMSGTRQLDRFEQEAAGFHQRVRDAYLARAAAEPGRFAVLDSSRGIAEIQADIALHLQRLLERG

SEQ ID NO: 8315 - protein, 329 aa, Chromobacterium substugae
MKKLSGFLLIVLLCAAGWLAWAALLPVALPEGGYKLLVGPNRTMKQIARTLEQDGAIRNRQLMTALARLSGADRKVKAGLYRFQGPQSMLDVLQRLVQGHPDEASVTAIEGWTFRQLRQALDRNPDVQHEAKPLSDAEVMAQLGMPGASPEGLFFPSTYLFTPGASDLDIYRQAFNVMQQQLNAAWAARKADLPYRTPYELLTMASLIEKETSSDADRGMVASVFVNRLKKGMRLQTDPSVIYGMGASYQGNIGKADLRRDTPYNTYTRAGLTPTPISLPGKAALYAAAQPAESDALYFVARGDGSSQFSSTLEQHNQAVRKYILKKGQ

SEQ ID NO: 8316 - protein, 212 aa, Chromobacterium substugae
MKPFFNFGCALVAWSELCRVARTPGALAGADPLPPQALCQGSQSHQFVYAGSPQSLASYQAVLLEPLWLLDQRRDGRWQLVSTALGNSMNLRLQALLRAWMPALPLAEEAGPRVARLRLALRSFQGEIGSLPAARQSDDRAPLTRGIAPYLEQVSSIVQLEDAGDGRLLGGGVNLRGGRAGQAAAAGKGWPDLLACNWQQVLQVEQAPLAAG

SEQ ID NO: 8317 - protein, 242 aa, Chromobacterium substugae
MPRLRLALLCLCLSPLALADTVNVAVASNFQQTLDKIAAAFKAATGHEIKASAGASGKLAAQIRQGAPFDVFLSADDERPTELVRAGVGQPASQFTYAYGQLALWSKKRDDAGEAALRQGKFNKLAVANPATAPYGRAAMETLAALKLEAAVKAKLLTGDNIGQTMQFAEVGGADFAFVAYSQLLEQGIRSRYWLVPEKLHQPIRQDALLIKPSPAATALMAFLKGEQARALMAQAGYRFKP

SEQ ID NO: 8318 - protein, 224 aa, Chromobacterium substugae
MTPQDWGAIGLTLKLAGISTLLLLLLCVPCSWWLARSRSPLRPMLEAAAMLPLVLPPTVLGFYLLLAFGPRGPLGKLTSALDLPGLAFTFHGVVIASVLYSLPFVLQPLLASFRAVRQEELESALLLGAGRWQRMRHVILPSCRNGVLSAACLGFAHTVGEFGVVLMIGGNIDGETRVISIALYNQVEQANYGAAHQLALMLLLFALAALTAVYWLNARRDKDA

SEQ ID NO: 8319 - protein, 84 aa, Chromobacterium substugae
MRKTLLLALFALFSANLALADAACDAKAADKKLAGAAKQSFLKKCEKDTAAAQASCDAKAADKKLAGAAKQSFAKKCVKDALAK

SEQ ID NO: 8320 - protein, 60 aa, Chromobacterium substugae
MGSAVELAEALPVLLLAPSSKPLDNKLLKFGKRLSKDEREELYPDSEFIANTHKPYLVQV

SEQ ID NO: 8321 - protein, 457 aa, Chromobacterium substugae
MELSGLGQLMSILNTFQSSLQQLYAPELQYNNSSASSSNPGVASVSAASGAQNANYLLTVSQLAQAQSASTSFTLPDTSSTSVGTGSLTITTGSYTYTSSTSASSFTANDTPVTVSITNGTLSGIASAINGANAGVVANVIQNASGAYQLQVSAASTGSSNNFRIAVSDNDGTNTDQSGLSRLAFDQTLAVGSGQNLTQTQSALNAAYTVNGASASSSSNFGIQLGSGVSANLLATGSSTISVNIDFGQLNTNAQSLATAFNTAQGSINSLLGNQVSFSNDPIASQLPQLLNQQAQTTYSNGSSLLTSLSQIGLSYQSPAQYGLGGTLNLNVSSLQAAYNSDSTGTANLLYAVEQALNSLANSYTTYGNGSLVNETNALLKQQRTNQLASNTPLTPNTFPFNLNDLLQTNSNLSAQQISGLATYALVYSLGAPYALDSLLVGQGLGLSPNGTFSATA

SEQ ID NO: 8322 - protein, 231 aa, Chromobacterium substugae
MNPNPAIKRSLVDIALDSLGRQLADGRWPVGSRIPTEPELADELGISRNTVREAVRVLLYAGLLEVRQGDGTYVRATVNPGEAMRAISRASLREHLEVRCLLEESAARLAALRAGADDLVRIEATLHTLARQADDTPESYAERDIAFHLAIADASGNQALAGLYRYFSRAVQQSVQDAIRDEALPDPGLAEHAAIFEAIRQKRPDAAGDAAAAITRPLLATLDQLLAAQNQ

SEQ ID NO: 8323 - protein, 420 aa, Chromobacterium substugae
MPDRDIQNPPIADELLIDDDAPPATSLPASRGSALLLLLGLVLVGLNLRPALSSLAPVLAMVSRDTGLTPALAGLLTTLPVACLGLFGPLAPHLARRLGSEKTIALVLALLAAGIALRTQLGVFGLFAGSALAGAGIGVIGVLLPGIVKRDFASRAGLMTGVYTMALCLGAALAAGFTVPVAEHFGRDWRPALALWALPALLAIAVWWPQLKTRHAAAAGQWQVRGLLRDPLAWQVTLFMGLQSSLAYIVFGWLPSILMDRGLSAMEGGLMLSLSTMVQVPASLLVPMLAHRCRNQRPPIAITLLAVIAGLLGMLYAPTGSLLLWAILLGFGQGGLFSTALSLLAHRSPDQHVAAHLSGMAQGIGYMLASLGPFAVGVIRGHSHAAWPLAMLFCLIAAAALTVGMLAGRKQLVGVRAVAV

SEQ ID NO: 8324 - protein, 173 aa, Chromobacterium substugae
MDAMVLAAMAKWPNVPAVFGWLRLDARGQWWIKDERLQHEAMVEFFNRNYGRDGQGRCYVQNGPQKVYVTLDAAPLAARRTPRGWSTLPYDDDVAARTAWLTPDGMLLLEIGGELAVVDDRDLPALLDEALPDWDGAADSLPASLRLGEAELPLAREELAALWRRYGIVAKPR

SEQ ID NO: 8325 - protein, 831 aa, Chromobacterium substugae
MTLRGRLTLLLRFIRRELVSGELTILGLALLVAVAAMSSVAFFSDRVEKALTTQATQLLAADLVLSGNAPAPEAIRAEARRRGLAMADNIVFPSMAFAGGQAALAQYKAVSAGYPLRGETTVRLADGSEQSGRLQLQPGQAWMDARLMSRLKLKLGDEIGVGNLQLKLSGLIVREPDGSMDVYNFIPRLMFNSADLAATGLVQEGSRIRWRLLFAGEDRKVAAFRGWLSARKPPGSRLEDVEEMRPEIRTGLERARRFLGLTAMLTVALAASAVALVVRRYLQRHWQQVAVLRCLGLGSGEVWGLFVSLFLLLGLLAGLLGTLAGFLIQLGLMQLFSGYVGEMLPDPGWLPWLIGPLAALLLLSGLALPPLMGIRDVSPAAVLRNELPPTRQGVIAPVLALATLLGLASWQVGEFALAGWLLAAMLGFLGVAGALALGMVMLLRRLPRGGKVGWRFGIANLARRRWLAVLQIASLSVGLMALLTLTVVRDDLIGAWQRSVPADAPNKFVINIQPGQLDALRDAFAVAGRPQPELSPMARARLIAINEQPVRPAAYDSEQARRLAEREFNLSWRRDLPPGNQVTAGKWWPDEKRVKPQFSVERGLADKLGIRLGDTLAFDLAGTTYRAKVTSLREVPWDSFRVNFFVIGTPGQFRQQPASWITSFRLEAADESFASALVERFPNITVIDVGSILAEVRAMVDKLTRGIEAMFLLALAAGVLVLWASLTATRDERLADIGLMRALGASRRQLRSVVLAELVWLGAVSGLLAALGAMGIGVLAAVKLFSLPVLINWWLLPLGMGGGVLVVTLTGWPLVGRVTRAPPLAALRAAA

SEQ ID NO: 8326 - protein, 237 aa, Chromobacterium substugae
MQTIERMSNPEKKAVLAARELAKQVHFRGDVLHILRSASLTLYPGESVAIVGTSGSGKSTLLSLLAGLDHPSDGEVALFGKPLSRLSEDARALLRRDRVGFVFQNFQLLPQLTALENVMLPLELAGRNDAREAARQMLERVGLAARLGHYPRHLSGGEQQRVALARAFVIHPGLLFADEPTGNLDPHTGRQIIDLLFQLNAEQGTALVLVTHDNELASRCDAIHRLVDGKLNGARAG

SEQ ID NO: 8327 - protein, 187 aa, Chromobacterium substugae
MLLLWQLPAHAATILVYGDSLSAGYGLAPGQGWAALLARELAPRHKVVNASVSGETSAGGLSRLPDALARHKPDVLILELGANDGLRGLPLADMRRNLQQMVDLASQRGARVLLVGMALPPNYGPRYGAEFRAAYDEIAKRNHLAYVPLLVAGFAGDLASFQPDGLHPRAEKQSTMMRTVKAKLPVK

SEQ ID NO: 8328 - protein, 407 aa, Chromobacterium substugae
MPDHPPSLWRRWLRPYRGLPAGVYIQTLCSFINNVGGISKLFLPLYLRESYHLPYSQIGALMAFYGAGMLAGSLKGGSLSDRFDSRALAVLALSLSGLCMLLLALRIPVWLFMPVLVLSGMADGGFRPVNQRLALEPCTPQQRPVAQGMMRVAFNLGVAIAGISSGFLAAYGYQWVYAANAGGTLLAACWLAWSYSRRRALTLPVRRDEESGGALAGPWRDVSFLRSIAALILVTLAFDQMYVTLALFLREHYQLGAQWVGYLFTVNGLMVVALQIPISRRILRWGLGRSTQLGILLTGCSFLWLNAGHGAPWAVLMMVTLTCGELLLSPCYALLVMHRSEGRLRGSYLGLYNAAWNGRTLVAPALGTALYGHLGGAALWWLCALAACLGVAIQHGALKRMLSPAAA

SEQ ID NO: 8329 - protein, 204 aa, Chromobacterium substugae
MAVLVGKQAPFFAGEKTFSAVLGDGQIVDNYSFKQATAGKYAVVFFYPLDFTFVCPSELIAFDHRLADFKAKNVEVIGVSIDSQFTHAAWRNTPVEKGGIGQVGYTLVADIQHDLCKAFDVEADGGVAFRGSFLIDKSGVVQHQVVNNLPLGRNVDEMLRMVDALQFTEEHGEVCPAGWNKGKKGMKPSAEGVASYLAENAKDL

SEQ ID NO: 8330 - protein, 597 aa, Chromobacterium substugae
MRTDYCGLIDKKYLGQTVTVKGWAHRRRDHGGVIFIDLRDREGLVQVVIDPDTPEAFKLADSSRGEYVLSISGIVRERPAGTANSKMISGEIEILAKEIEILNAAATPPFQIDDENLSENVRLTNRVIDLRRPAMQKNLRLRYKVAMGVRNHLDKQGFIDIETPMLTRSTPEGARDYLVPSRVHPGEFFALPQSPQLFKQLLMVAGFDRYYQITKCFRDEDLRADRQPEFTQIDIETSFLNEDQIMDITETMTKEIFSDVLGVTLPTFPRMTYGDAMFYYGSDKPDMRVSLKFTELTDVMKSEEFKVFRGAADMANGRVVALRVPNGAGISRKEIDDYTQFVAIYGAKGLAYIKVNDITKLNEEGLQSPIVKFLSADGIKAIIERTGAQNGDIIFFGADKAKVVNEAIGALRIKIGHERGEKDGYFVREWRPLWVVDFPMFEHDEEADRWTACHHPFTSPKPGHEDLMATDPGKCLARAYDMVLNGWEIGGGSIRIHRADIQEKVFGALKISPEEQQNKFGFLLDNLKFGAPPHGGLAFGLDRLVTLMCGAESIRDVIAFPKTQRAQCLLTNAPNAVDDKQLRELNLRLRQKAEPSA

SEQ ID NO: 8331 - protein, 225 aa, Chromobacterium substugae
MSVSPKIKMTLRGYLIAGLLIWLPLAVTLWVLNLIIGSLDQTLTLLPVEWRPEALFGRHVPGLGVVFAVLVVMGTGMLAANVLGRKLVAFWHGLLSRTPVVRSIYNSVKQVSDTLFSDSGNAFKNALLVRWPHQNAWTVAFQTGTPAQEILRHAENGEELVSVYVPTTPNPTSGYFIVVPRSDTRQLDMSVDDALKYVISMGVVVPNPPPGAQRPRLNDEHNRQG

SEQ ID NO: 8332 - protein, 85 aa, Chromobacterium substugae
MPIYEYRCGACGVAKEHLQKLSDAPLAACPDCGSADYHKQLSAAGFQLKGSGWYATDFKGGSSSSAAGGAASSGGHSCGTGCGCD

SEQ ID NO: 8333 - protein, 265 aa, Chromobacterium substugae
MVYQEGQMESIRNILAGKKGLIVGIANENSIAYGCASVLRQLGAECAVTYLNEKAEKHVRPLAEALQAPLLLPLDVEQPEQMRAVFERIAGHWGELDFIIHSIAYCPADDLHGRVADCSLAGFQQAMRVSCYSFIEMARLAEPLMKKGGSLITMSYYGADKVVENYNIMGPVKAALESVSRYLANELGPKRIRVHAVSPGPLKTRAASGIAHFDQLIEDAIARAPQNRLVDIEEVGMTCAFLISDAASGLTGQTIYVDGGHHIKA

SEQ ID NO: 8334 - protein, 311 aa, Chromobacterium substugae
MTHDDHAFDDILQQARQLGALPMAVAHPCSRESLLGAVEAAENGIATPILVAPLAKLKKLAGELEIDLKRFECIDVEHSHAAAERAVQLVRDGYADILMKGSLHTDEFMSAALARDTGIRTDRRISHVWVMKVESYPRYLFITDAAINIEPDLVTKRDICQNAIDLTHALGIPCPKVAILAAVETINPDMRSTLDAAALCKMADRGQITGAVLDGPLAFDNAISKEAAQSKGIVSAVAGDPDILLVPDLEAGNMLGKQLTYLANAASAGIVMGARVPMVLTSRADDASGRLASSAIANLLAHTRRQDGERP

SEQ ID NO: 8335 - protein, 383 aa, Chromobacterium substugae
MSACLLAINAGSSTLKFRAFSADGQTLLARGMVDRFGAKDARLSLADAKGQQLDERGLGDAAHDTALAAVLHGLADQGLEARALAHRVVHGGSRFLQAVKIDADVRAALDDYIALAPLHQPVSLEVIDAFAGLDSRLPQIACFDTAFHAGQPAIATRFGIARHWHDEGVRRYGFHGLSYAAIARRLPEVGLAHAKVVVCHLGSGASACAIESGQSVASSMGFSAVDGLMMGTRPGYIDPEVILYWQEHEGMGVKDVRRELYKNSGLLGVSGISADMRELLASEQPAAREAVELFCYRAAREAASLAAALRGLDALVFTAGIGEHSAEVRARILQQLSWLGFELDHAANLAHARRLTTAGSRLPAYVLPTDEEGEMARQAARLL

SEQ ID NO: 8336 - protein, 53 aa, Chromobacterium substugae
MLKAIEAGDKAAAKVVFHASEKVIDRIADKGVFHKNKAARHKSRLSAQVKAMA

SEQ ID NO: 8337 - protein, 511 aa, Chromobacterium substugae
MNLLKALAAVSSMTMVSRVLGLVRDTLVARTFGAGLSADAFNAAFKIPNMLRRLFAEGAFSQAFVPILGEYKQNKTHEETREFVAKVTGVLGSVLLLVTAIGMLFAPLIMWISAPGFYREPAKAALFADILRVSFPYIFFISLSSMTGSILNSWGKFSIPAFTPTFLNLSFIVFTLAFTHYFHPPIMALAWAVFLGGLVQLVWQLPFLKQIGMLARPVFAFRDPEVWRVIRQMGPAIFGVSVAQISLLINSTFASFLPTGSVSWMYYADRLMEFPSGVLGVALGTILLPSLSKHAASKSDAEFSVLLDWGIRLSLLLAVPATVGLGLLSGPLLYTMFMYGKFSAHDALMSQQAVIAYSFGLLGLILVKVLAPGFYARQDIKTPVRIAVTTLIATQAMNLAFVFPLKHAGLALSIGLASCLNAGLLMHTLQKRGIYRPEAGWKSFLAKLATAIAAMAAALLAAQWLLPIDWHGHAWLRALWLLLLVVIGAVVYFAVLFALGFRPRQFMRREH

SEQ ID NO: 8338 - protein, 278 aa, Chromobacterium substugae
MSTHATPEHSPLGKTVSYQDQYDSSLLFPIARQTKRDEIGVAEAALPFAGVDIWTGFELSWLNARGKPQVGIATFRIPAASPRLIESKSFKLYLNSYNQTRMDSVNALAAQLARDLTDAAGAEVAVSIALPQAFAAEQVRELAGEYIDDLDIEVDHYAPCPEILKADAADIVSETLCSNLLKSNCLVTGQPDWGSVSIRYTGPKIDREALLRYLIGFRQHNEFHEQCVERIFVDVLRACAPTELTVYARYTRRGGLDINPWRSNADAAPTDNIRTARQ

SEQ ID NO: 8339 - protein, 225 aa, Chromobacterium substugae
MQRHNLEHYNPPPDTGLSVIYADSCLLVLDKPSGLLSVPGRGEDKADCLISRAQKAYPDALTVHRLDMATSGLVVMGRGPEMQRALSIAFMERKVKKRYIAVVDGIVENNSGTIDLPLLIDWPNRPRQKVDLEHGKEAITHFRVISRDTGRDITRVELDPQTGRAHQLRMHMLHLDMGHPILGDDIYAPPEALAKADRLLLHASRLVLRHPVTFEEMEFEAPAPF

SEQ ID NO: 8340 - protein, 235 aa, Chromobacterium substugae
MTERFYQDPYQTRLSTRVLSHDDAGLILEDTLCYPLGGGQPGDSAMLTLADGAALRVADTRRDRDTRAIRHQTEGDVRLAPGTEVTLELDWDRRHRHMRIHTCLHLLSVVIKAGVTGGNLTAESGRLDFDLPEGMELDKDQIEAELNRLVAADLPLAVKMTSGEALKAQPELIKTMSVTPPLHLPEIRLIEVEGVDLQPCGGTHVARTGEIGRVRVKKIESKGARNKRVVVELAD

SEQ ID NO: 8341 - protein, 495 aa, Chromobacterium substugae
MTSTALNPLRQPKPFYLIFSIEFWERFGFYGLQGILAVYLVKALGLREADSFTLFSSFIALVYGLIAVGGWLGDKVLGTKRTILLGALVLAAGYGMVTASAEHIGLLYLGMGTIAVGNGLFKANPSSLLSKCYEENDPRLDGAFTMYYMAINIGSLLSMLATPWLADKFGYAHAFALSVVGMLITVANFLLMQGWVKHYGSDADFRQPKLSTWLAVLAGVVVACGAAALLLKHEIIANVVLAALSIGVVGLYVKETLLLKGAERKKMIVAAILMLQATVFFVLYNQMPLSLNFFAIHNTEHTLFGIPVQPEQFQSLNPFWIMLASPLLAVCYNKLGNRLPMPHKFAIGMVLCAGAFLVLPLGAKYANAQGLVSSNWMVLSYLLQSVGELLISGLGLAMVAQLVPQRLMGFIMGAWFLTSAASSVIAGWVAGLTAAPDNVTSPLATLEIYSRVFTQIGVVTGAIALLTIIIAPWLHRMTLDEKPEQPEHEMALDAR

SEQ ID NO: 8342 - protein, 323 aa, Chromobacterium substugae
MPLPRLSLALLCLLALPVRAAPNPTFDPTPLPWQELAARLRHTYYTGGVHNEKWCLPPFNCTYPRSPGQPSNPLFPKWWVSDWTMYRVFKNYEQYPPPYSSPPAGLSPDDYEVSYGASYYDASYVPADGDGKGAMMEHYEKRCLPIFPGSNHYSCSFVSLGNKAYFLTYADRLPGMPQCCQFSLNNHPPRQDFIRHLPYNKAESSHLDNSLQAYSRLVGPQKILFGYAFYKQAAPDADGGKPYRHPQSFYFSGDPSPEPDAPIVSQNYSHFRAEKPDPAQTWDQVAQMCPAKPQWCCLFASDCPDKPATPDENNPKSWATARP

SEQ ID NO: 8343 - protein, 305 aa, Chromobacterium substugae
MSVNLRHIEVFRAVMTSGSVSGAARLLHTSQPTVSRELARCEQLLGLALFERSRGRLRPTQQALQLFAEVERSFIGLERIVGSAAAIRQFAGGQLAIACLPVFAQTLLPAACADFVAGFPDVGIDISPQESPWLEDWLAAQRFDLGLTEQQQAPAGCQTQTLWQGDEVCVLPAGHPLAAKRRLEAADFAGLSFISLAASDSYRQQVDAWFARERVSRRMQLSSHSAASVCAMVRLGLGVAIVNPLTALAEAGDGLVARPLAASIPFSVQLALPQYRPASPLPGRFADSLRRQAAAQERLLAALLA

SEQ ID NO: 8344 - protein, 408 aa, Chromobacterium substugae
MHAFDTRQLAAIAQQYGAPLWIYHADTIRRRIAELSHFDTIRYAQKANSNTHILRLMREQGVKVDAVSLGEIERALAAGYQGGAQADIIFTADVLDRATLARVAELGIPVNAGSIDMLSQLGAASPGHPVWLRINPGFGHGHSQKTNTGGENSKHGIWHADLELALAEIRRHRLQLVGIHMHIGSGVDYGHLQRVCGAMVELVQRLDCDIEAISAGGGLSIPYRDGDARIDADHYFELWDEARRQIADRLGHPLRLEIEPGRFLVAESGVLLSEVRAVKNMGSRRFVLVDAGFNDLMRPSLYGSYHHITVLDAQGAAKSGSVDTVVAGPLCESGDVFTQREGGTVEARPLPPAAVGDLLLFHDAGAYGATMSSNYNSRPLLAEVLVDGGAVRQIRRRQTMAELLALEA

SEQ ID NO: 8345 - protein, 125 aa, Chromobacterium substugae
MWCAGWELRQPAFVARNLEKMMKRFASQTLLLAALAFSGAFATQAYAEGAVAVAAPTDAELAASVKQALDSDAELKALGLKVSSNKSEVTIEGQMSDDQQMFRAGQIAEQIPGVKFVINKMELKN

SEQ ID NO: 8346 - protein, 418 aa, Chromobacterium substugae
MTHILSPKRWPLWLALLLLAGCGTTTPTGSLPSLPSAGGGDASSLAALPAWNTQTLGDTLQGLRQSCKSLQKKPAWRGVCREAGQLADNDGDAVRRFFENRFTAWKLRDGNRDSGLITGYYEPLLSGSRTRSERTPWPVYGVPRDMVSVDVPISQRNRGALRARQIGPNRLALAAGGDIEVNPADFPADPRGIRLKGRLSGSRLLPYFTRGQINQGSIAGSAPVLAWVEDPVELFFLQVQGSGRIQLDDGSFIHVGFADQNGYPYQSIGKWLVDQRQLTLSDASMQGIKDWLARNPQRRDELFAVNPSYIFFKTTPGDNGGPVGALGVPLTGGYSIAVDPRYIPLGAPIYLSTTWPHSAEPLVRLVHAQDTGSAIKGALRADLFWGYGTEAGMYAGRMKQQGSLWLLLPKGLSPSATL

SEQ ID NO: 8347 - protein, 90 aa, Chromobacterium substugae
MPPLAVFDQPEVIRALFLAARALEMMDGRARRAPPDHAGHPWSELEETQLLQAFDSGLPLKQIAADHGRSRGAINARLQRLGRIGEQVEG

SEQ ID NO: 8348 - protein, 255 aa, Chromobacterium substugae
MIRIFIACCLSAAAWAAPAASPPCRAHGESGPARQVSLLELYTSEGCSSCPPAERWLSALPPAFVDGRQALALAFHVDYWDGLGWRDRFASAAYSERQRRHAAQAGGAVVYTPQFLLNGRDWRPGGDGELAQALPQSASGATLQLDSRTFADGVDVTLRAQTPVKTGQRLMLALFENGLQSWVEAGENRGSLLRHDAVVRGLWGPFALDGGGHAALSRHLAFAAGQRPEFSGVAAWLEDVDSGAVSQAVVAACRR

SEQ ID NO: 8349 - protein, 64 aa, Chromobacterium substugae
MLVGRTCAALQAKRHPLRSRPASSPARNAAPEARRMECGKRKRGASPKSAGGRMQCHSIKTAAD

SEQ ID NO: 8350 - protein, 658 aa, Chromobacterium substugae
MCYNQLFFSAFFQAGSEMAASPENQKDVQDSQQEVMSLEEQRKRLRQLIALGKERGYLTYAEINDHLPEDVSDAEQIENIVTMISGLGIQVCEEAPDAETLLMSDATPAVADEDAVEEAEAALSSVDSEFGRTTDPVRMYMREMGSVELLTREGEIEIAKRIEDGLKYMIQAISACPGTIAEVLELMERVARDEIRVDEVVDGFIDLNAPSGDEAAYAEPEAEDELLEEDEDEEEDAEEVDADADAAANLEELKQEALEHFAGVRLLFDKMVKVLNSKGHQSKEYLELQDAITTEFMLVRFATRQVESLCESLRGRVNEIRTYERDIQDICVSRVRMERAHFIKVFPGNEINLDWVESEISSGKAWSEALTRFKHAIIEKQTRLSDLQDRAMLSIKALKEINRQMSAGESKARRAKKEMIEANLRLVISIAKKYTNRGLQFLDLIQEGNIGLMKAVDKFEYRRGYKFSTYATWWIRQAITRSIADQARTIRIPVHMIETINKMNRISRQILQESGREPDPAELAEKMEMPEEKIRKIMKISKEPISMETPIGDDDDSHLGDFIEDQNNLAPSDAAMYSSLKDATKEVLDTLTPREAKVLRMRFGIDMNTDHTLEEVGKQFDVTRERIRQIEAKALRKLRHPTRSERLRSFLDNEPGGQ

SEQ ID NO: 8351 - protein, 595 aa, Chromobacterium substugae
MIPQDFIDQLLSRVDIVDVVDRYVPLKKGGQNYMACCPFHKEKSPSFTVSPSKQFYHCFGCGAHGSAIGFVMEYQGVGFVDAVKLLAEGIGMQVPDERAVNPEASRKAREKQVSLEQLMQMASDYYRRELKGGPNAVAYCKGRGLSGEIAARFGLGYAPDGWQNLEAITANYQDEKLVEAGLVIVAEDSGRRYDRFRDRLMFPIRNQRGAIVGFGGRVLGKGEPKYLNSPETPLFEKGRELYGLYEARQAIRDKNRVLVVEGYMDVVALAQYGVGYAVATLGTATTGEHVRKLLKHADQVYFCFDGDKAGQKAAWRALENSLPQLVDGKALSFLFLPAEHDPDSYVREFGTDAFEEVLEQQSLPLSVYFTRELCKEVNLSTPEGKADLIRRAAPLLAQISAPALGFIIKKRLAELAGVEVDEFDMLTGGKPRQASGKSGRRDYKLPAESQRVMNTSMVRKLIKWLLMNPGWAPDVRLPDSLALSDELACFAMLAERVQEHGEEPNTAQLVEGLRGTPYEGLIDSVLQQAMQDPDEFADPGADDRQQFQDGNARLLKMLHAAQLERLKQKDRHEGLTSEEKALLGQLLREMFSSPN

SEQ ID NO: 8352 - protein, 148 aa, Chromobacterium substugae
MSLKVRITDDMKSAMKAKEADKLGAIRLLLAAVKQKEVDERIELDDAGITAVIDKMLKQRRDSIAQYQSAQRLDLVAKEQAEMDVLMVYMPQQLSQAEIEALIAKAVADTGAAGMQDMGKVMGALRPQLAGRADMAQVSGWIKAALSA

SEQ ID NO: 8353 - protein, 48 aa, Chromobacterium substugae
MEKTGLLTELRAREFYEKPTTERKRKHAAAVKRHYKRIRSQMLPPKLY

SEQ ID NO: 8354 - protein, 249 aa, Chromobacterium substugae
MLVGTGKYKDFEQTAAALDASGTEIVTAAIRRVNLGQNANEPNLLDFLPKSRYNLLPNTAGCYSAEDAIRTLRLARELLDDHRFVKLEVLGDPNNLYPNVKETLKAAEVLVAEGFDVLVYTSDDPIIARELEQIGCCAIMPLASLIGSGMGILNPWNLQLIIEQSKVPVIVDAGVGTASDAAIAMELGCDGVLMNTAIAGARNPVLMARAMKLAVEAGRAAYQAGRMPKRFYSATPSSPSEGVISSVKS

SEQ ID NO: 8355 - protein, 69 aa, Chromobacterium substugae
MSQLNLRINGEDRSFAGIATFAELVDALQLGGKRIAIERNGEIVPRSQHAAELLADGDVLEIVVAVGGG

SEQ ID NO: 8356 - protein, 718 aa, Chromobacterium substugae
MGTGIETGIDYNALIDSDAAAFFENAGRYLKPEDIELLKLAFAVSREAHEGQTRKSGEPYITHPLAVATMLAEWRLDVQGLAAALLHDVLEDTGVTKPTLIEKFGKIVADLVDGLSKLERLEYQTKEAAQAESFRKMVLAMARDIRVIIVKLADRLHNMRTLDSMREDKRRRIALETLEIYAPIANRIGLNKVYRELQDLAFKHLHPHRYGVLSKAVRAARGNRREVVNKILQAVSQRLVQSNIEATIKGREKNLYSIYKKMQEKHLSFSEVLDIYGFRVVVNDIPACYLALGALHSLYKPIPGKFKDYIAIPKGNGYQSLHTTLFGPYGTPVEMQIRTREMHSVAEAGVASHWMYKSGGGVNTAQQRTHQWLQKLLDMQEESDDAVEFLEHIKIDLFPDEVYVFTPKGKIMVMPQGATPVDFAYAVHTDVGHRCIAARVNHALVPLRTVLRNGDTVEIITSTQAKPNPSWLAFVQSGRARSGIRNYLKSLQREEAVALGEKLLRQAVGALATTPLAVSDDLRVEYFAAYGEKMSSFDDVLAEIGTGKLLPIVVARRMLELAGERLGEGVRVGPITIRGNEAGMVQLSPCCNPLPGDEILGVITKGQGLVIHRVDCPNARRADHDKLLEVNWEAQRDRMFGVTVGVLSRNERGALADIATAISQASANIESADTQDSSRDGDGLFNIHFRLQVEGVEHLERVLNAVRQLAVVQRVERR

SEQ ID NO: 8357 - protein, 68 aa, Chromobacterium substugae
MARITVDDCLDRIQNRFDLTLAAAYRARQVASGASAFVEPGRHKPTVVALREIAAGHVGKEILNRGKA

SEQ ID NO: 8358 - protein, 210 aa, Chromobacterium substugae
MSQLIGNIYIVVAPSGAGKTSLVAALLQAEPSVELSVSYSTRAARKGEIDGKHYHFVERSVFDAMVERGDFLEHAEVYGNCYGTSAPWIRGRLEAGQDILLEIDWQGAEQVRAVFPDAIGIFIAPPSIEELERRLRGRDTDAEEVILRRLASARAEIDKIAEYDYIVVNDDFERARQDLISIVRAQRLKSGPQCRRLAEMFRRMGTAGAQ

SEQ ID NO: 8359 - protein, 432 aa, Chromobacterium substugae
MQLLESLFKLKEHGTTVKTEVIAGFTTFLTMAYIILVNPLILSSTGMDLNAVFVATCLAAALGTAIMGLVANYPIALAPGMGLNAYFTFSVVKGMGLSWETALGAVFISGLVFLAVSLFKVREAIVNAIPQSLKFAISAGVGMFLAIIALKNAGVIAAHPATYLTLGNIHSPTTLLAILGFFLIVALEYRKVPGSIIIGILVVTVLSIALGLSPFKGIVAPVPSMAPTFMAMDIKGALNAGLIGVIFVFFFVDLFDTTGTLVGVSHRAGLLDKDGKLPRLKRALMADSIAITAGAVMGTSSTTAYIESAAGTAVGGRTGLTAMVVALLFLAALWLSPLAATVPAYATAPALCYVAVLMARGLAEIEWNDLTESAPAVMTALAMPFTFSIADGIAFGFISYAVIKILAGRFADLKPAVLVIAALWVFKLAFFA

SEQ ID NO: 8360 - protein, 39 aa, Chromobacterium substugae
MALLYFEIKRLRGLPTGGAQQKGLPQRRQARFASRLLCF

SEQ ID NO: 8361 - protein, 185 aa, Chromobacterium substugae
MENLSNLDYSSYLKGWIRTVPNWPQQGVMFRDITPLLQNPKTFRMLIDIYVHRYMTEKVDLVAGLDARGFIIGSVLAYELNVGFVPIRKKGKLPFTTVEEEYELEYGNAAVEIHTDACKPGDRVVLIDDLVATGGTMLAGYKLLKRMGADVLEAAAIIELPELGGGQLVRDGGLDLFTVCSYKGH

SEQ ID NO: 8362 - protein, 253 aa, Chromobacterium substugae
MDIAKTAACLLLIGSGAARAEEAGNIDRLIFRGDAARLELTADAAKPYKLSLEKRNWSDADCKVAATRQGGDLTFRIDLGAVAAERCRLVIRGNVKPGKKLDVDLKAVDGDVSGRFDQVQMRGQALHVDLNGEYGAVRLSGEAVKSDVKGQVGELRLKGNAVNLDFDGASRAVALDGQAIKADIALQGAQPAASVDVNGQMVKLEFTGSKAAKLDYQVSGQASKVSGDWANTPGAPLKLRVKGQAVKVSLEQN

SEQ ID NO: 8363 - protein, 97 aa, Chromobacterium substugae
MKNDACLQQLQLTLVGLPEAELRKILNDYRCYIRDAVSDRGSENRLLAILTETRQLAAAAFARRRILRHSRGQLAIHALAAAAAVAVNVASYWLYLH

SEQ ID NO: 8364 - protein, 365 aa, Chromobacterium substugae
MTRKDFLQQLERALSGQRPEMVREILSDYEEYFNDALADGRDEADVVAALGSPQKLARELKAQNHYRQWEQHRSFGNLSRVVASIAGLGVLNFFLAIPFMVYLMFLTIGYVVSVSFLVAGLAVVLGWGSHSLFGWPEFSVDSLDIGHRGAPGLVDVKADDGSASGEFRIEHGRLVLEPDSGSTIRLTTRQGDPIVVSRNGDSLKVDASQPARLLLQQTDDDEVSINSHAVAALAYSGSGGDQAAFRVDDNGRLTSLQASAGGQEVKIEASGPHGLTVLKDGNSVLEISEKKITVKDGISFVHLDALPGMSVGMSAAIVGLGLLLAGALGLVFCVWLTRLTWRVLVSYVKYQIELVSGKDRENAAA

SEQ ID NO: 8365 - protein, 113 aa, Chromobacterium substugae
MKTQLKKGTLDMCVLAVLSQADSYAYELVSKLSQGMEISEGTIYPLMRRLQNESWVSTYLVESSSGPSRKYYKLTDIGRRELAVMRQEWQEFVTEVENVLRDEPAASTEGTSQ

SEQ ID NO: 8366 - protein, 390 aa, Chromobacterium substugae
MPMAMTFFRHNIVIPAALQKPDQQPYFSHAFVFANDMKREKRVMAESAKPSIALVLGGGAPNATLMAGALVALTEAGVSFDIISASGAGAIVGLLYAAPRQGDAISALSKLADLGVSDPIYNLFPVNYKVFNKPGSLADAWRRLQSSNPLLQAIQSQADQGPAQRLLADWTSLLLASFCPSSLASDSQGLCAHVPFIEQVVDFAKLKDIRPEFYLNAYNISHGAMRCWDKREVTHEHFLAALSFPFIYPPYPLEDGYYIEGAAIDTLNFKRLFELHPHIDYTVVFDVLGSDRLLHPPRNLYDAWVQSIIAPLTAIARDDLRLFEALHNRDEQGQPRTEVLRINFDAHIGKESAREELDWSYSNLARLYQAGYQAGKDACRQHARQLGIQA

SEQ ID NO: 8367 - protein, 99 aa, Chromobacterium substugae
MALPTAVNSQITDAVTQANVKVVGDAPAMAMGDLYQSLAHSAGILYENAASSQQQLAIAGQAASNQGVIQIYSVDAGEPALGPMDAAELEALIHQLKSE

SEQ ID NO: 8368 - protein, 314 aa, Chromobacterium substugae
MRVVVALGGNALQRRGEAMTADNQRANVKVAAEQLAAVTRLGHNLVMCHGNGPQVGLLGLQNDAYARHVDGKVTPYPLDVLGAQTEGMIGYMVEQELGNVLPFEVPIATILTQTEVDAKDPAFKNPTKFVGPVYSKDEAEKLAAEKGWAVKADGEYFRRVVPSPKPKRIFEMRPIKWLIEKGVVVIAAGGGGIPTMYQGDKLVGVEAVIDKDLASALLAREVDADYFVIATDVKSVFVGWGTPEAKAIRHAHPDEMDKLGFAAGSMGPKVEAACEFARLTGKKAVIGALEDIEKIVKGEAGTVISTAKAGIDWY

SEQ ID NO: 8369 - protein, 336 aa, Chromobacterium substugae
MAFNLRNRNFLRMLDFTPREIRYMLDLARDLKRAKYSGTEQQHLKGKNVALIFEKTSTRTRCAFEVACFDQGANVTYLGPSGSQIGIKESMKDTARVLGRMYDAIEYRGFDQDMVENELAKFAGVPVYNGLTDEWHPTQMLADVLTMWENSDKPISQIRYTYLGDARNNMGNSLLVIGAKLGMDVRIGAPKHLWPTDELVAECREIAAKTGARITLTEDAKAAVKGTDFIHTDVWVSMGEPAEVWAERIRLLKPYQVNSALMAAAENPQVKFMHCLPAYHNSETKVGKEIAAQYPELANGIEVTEDVFESEACIAFEQAENRMHTIKAILVATLGE

SEQ ID NO: 8370 - protein, 410 aa, Chromobacterium substugae
MTKFGVHSECGKLRTVMVCRPGLAHKRLTPDNCHDLLFDDVIWVERAQRDHAYMVEQMRARGIEVIEVHDALAKVLDDKAARNWVLDRKVKADNVGIGMLQDLRSWLNEMPSSQLADHLVGGIAKFELPFDPKGLFGGYLDQSEFVIPPIPNSLFQRDPSCWIYEGVTLNPMYWPARRQETLILQSIYQFHPYFAGKVNIWWGGCDSDHGPATLEGGDVMPIGNGTVLIGMGERTSPQAVVQVAKRVLHREGGAKRVIACQMPKSRAAMHLDTVFSFLDIDLLSVFPDVVDEITCTSMYAGDREGEIRFERHEGVKLVEVVRQALGLKEIRVIQTGGDAYQREREQWDDGNNVVALDRRVVVAYDRNTYTNRLMREHGVEVIEIPASELGRGRGGGHCMTCPIIRDEVKL

SEQ ID NO: 8371 - protein, 483 aa, Chromobacterium substugae
MSTETASQAGVAEGAAPRLKLGALTALVVGSMIGGGIFSLPQNMAAGAGAGAILIGWAITFVGMLALAFVFQMLASRKPEVSGGVYGYAKAGFGDYMGFNSAWGYWISAWIGNVSYFVVMFSALAFWIPAFGDGNTPTAIACASVLLWCLHFLVLRGVHGAAFINTITTIAKLVPLALFILLIVFAFKVDTFSLDFWGNAKLGSIVDQVKSTMLVTVWVFIGIEGASMFSGRAESMKDVGKATVIGFLLTIALLVAVSVLSLGVMTQPELAALKNPSTAYVLQKAFGTFGANLMNAGLVISVGGALLAWTLLAAEAPYLAGKDGVMPKVFGTVNGNDTPAASLWLTNGLIQLFLIITLFSSAGYLALLSLATSMILIPYLLCAGYSWLVAQRGEGYAQGEGRGKELGTAILATVYGGWLIYAAGPKYLFLSMVLYAPGLLFYLWAKKEQGQKPFNLIEAALAAIVVVLAVIAAYMLAVGKIGL

SEQ ID NO: 8372 - protein, 43 aa, Chromobacterium substugae
MELLTLLMSDDVGRLSLLTIVVTMLVVLGALWMIFKNINKPGK

SEQ ID NO: 8373 - protein, 327 aa, Chromobacterium substugae
MEAHETILEAALRQGVGLPYGCRDGACGACKGKVVEGEVSQDGFQEKALSAGERAQGMALFCCARPQGDVSIEVREVTGAGDIQIKTLPCRVEKMDKIHDVAVLKLKLPVSERLQFRAGQYIDILMKDGKKRSFSIANAPHDDAFLELHIRHQPGGSFSDYVFSQMKEREIMRFKGPLGSFFLREESDKPIVFIASGTGFAPVKGIIEHAIHHGIQRPMLFYWGARSKADLYMADLAESWQAAHPHIRYIPVLSEALPEDNWSGRTGFVHQAVLEDFADLSGHQVYACGAPVMVEAAHGSFTRERGLPEDEFFSDAFFLSKDMNGGK

SEQ ID NO: 8374 - protein, 305 aa, Chromobacterium substugae
MRTLLIIGAGDVARRALPSLLAHWRVLALCRHPAAAESWRALGARPILGDLDRGDSLARLAGIADAVLLCAPPPPSGAEDPRMRKLLYALAKGDSIPQRFVYISTSGVYGNANGMLINETAALLPQSERARRRVDAERQLRRFVGRHGGALTILRAPGIYADDRLPLARFANASPLIVDAEDSYSNHIHADDLASLCAAALRRRQGIRVYNACDDLPLPVSRWYRQLGATLQLPSLPELPRAEVQARVTPQQWSFLAESRRLDNLRIKRELGVRLRWPSVLDYLAALAQDEPRKAAILASQAKIR

SEQ ID NO: 8375 - protein, 255 aa, Chromobacterium substugae
MSRARRQYSQARPRFGNIAVFLSFQQASKMENPAFNRAIRSFVLRQGHLSAGQQRAMDEGMPKWGIAYHPETIDLEQAFGRAAPKILEIGFGMGGATAEIAAANPGNDYLGIEVHGPGVGNLCKLIAEKELTNLRLMRHDAVEVLDNMLADGCLDGVHIFFPDPWHKKRHNKRRLIQAPLVEKLLRKLKPGGYIHAATDWEDYAIQILEVMNSVDGLENSADGYAPRPDYRPLTKFEARGIKLGHGVWDVIFRRK

SEQ ID NO: 8376 - protein, 159 aa, Chromobacterium substugae
MATFYDFTTRAADGTVCDLSAYRGQVLLVVNTASECGYTRQYAGLQELQDFFAGQGFSVLGFPCNQFGGQEPGGADEILAFCQSRFGVSFPLMAKLEVNGAGADPLWRWLTQADSDHPHPVKWNFTKFLIDARGRVVKRYEPAVEPHELVDDIKALLAR

SEQ ID NO: 8377 - protein, 159 aa, Chromobacterium substugae
MLFNPSRQDARRFFFDTWSKSKSGQALSDLEQIVLSILIDHPEYHPILENPEAFLEQEWTPDMGETNPFLHLGLHVAIAEQRSIDQPFGIRALYAQLALRHGDEHRAQHEIMECLGEMIWHAQRYGGGPDVNRYISCVRGKLDMGEEEQPRVNPNDVPD

SEQ ID NO: 8378 - protein, 317 aa, Chromobacterium substugae
MTSRNIVFLDRDSLPVPVPVFSFPAHYREYPATAAEQLLEHAAGAEVLISNKVPLDREALARLPGLKLVAIAATGYNHVDVEACRERGIAVCNIRHYGDHTVAEHALTLMLALMKNLPAYQRDVAAGVWSQAKQFCHFGAPIREMRGAVLAIIGSGGIGGELAAMARAFGMEVLFAERKGAGLAREGRVPFDAALARADVVSLHCPLTDETRGMIAQAELMAMKPGAILINTARGGLVDEADLVAALKYGQLGGAGFDVLSSEPPAPDNPLLKARLPNLIVTPHVGWASAEAMRRLAAQLAENIEAFVRGEARNRIV

SEQ ID NO: 8379 - protein, 237 aa, Chromobacterium substugae
MWLKKGFRDFQKAPADCLFYGAVFVLMGYLLGVYAEQAPELVITFATIFLLAGPFLAIGIYDIAKQMEAFDGHGRVKLLHSMAAWRVNMPGFSLYAVLLAVLVFGWFRVSLLMFALFYDTAALPNLNEIVADAFNPDNLEFLIAYFAVGFLFAQVVFSVSVVSIPLLLDKEVDTITAMIASVQAVFRNVLTMGLWAVIIVAMTVVGFATYYLGLIIIMPVLALASWHAYRDLITFER

SEQ ID NO: 8380 - protein, 108 aa, Chromobacterium substugae
MSELIIEELVVGEGAEAVAGQEVTVHYTGWLTDGTKFDSSKDRMQPFSFPLAAGYVIKGWDQGVQGMKVGGKRKLTIPAELGYGARGAGGVIPPNATLVFEVELLQVG

SEQ ID NO: 8381 - protein, 205 aa, Chromobacterium substugae
MDTLQILLDFFTGYGYLAVFAVLLVCGFGVPIPEDITLVAGGVISGLGYANVHYMFLVGMAGVLVGDGIMFMAGRTFGNKVLKFRPIARILTQERFEAVQEKFAKYGNWVLFVARFLPGLRSPIFITAGMTRRVPYWRFLLMDGFAALISVPVWVYLGYYGAANREWLMTMVHRGQAGILGAVALLLLVVGGVWLKRRRVSCAKK

SEQ ID NO: 8382 - protein, 357 aa, Chromobacterium substugae
MTRPIRLEIDLSAIRHNFLFTRQRAQAKRLFAVVKANAYGHGILDTAKALADLADGFALLNIEDAVALREAGIDRPIALLEGPFDAAEAAAMGEYRLCGAVHSLEQMAWLAKGSAARPAEVWLKINSGMNRLGFRPEQAGDALARLRAEPAIRPAAIMTHFATADEAYGVDEQWRDFATLARDSALPVSAANSAALLRHPHTHGDIGRPGIVLYGASPFEDSTGAALGLRPAMTLSADIIAVQQLRNGDAVGYGRRFVADRDMRIGIVACGYADGYPRIAANGTPVAVDGAASGTVGRVSMDMLAVDLSHLPQAGVGSRVELWGPQAPIERVAAAAGTISYELMCAVAARVPRSLRA

SEQ ID NO: 8383 - protein, 662 aa, Chromobacterium substugae
MKRLFTSQPARGGLALLLAAASLPAGAACSTAATQRIHQIQGAGAASPLQGQTVVAQGVVSGLLYGKDGPVGFFMQEAPQNQDQDPATSEGIYVYTGKLAVPALRRGDVVGVRGKVVEFARKGDAGSETQLQPAAAADVQACGAQGALALTPLRLPLSGDPAQLEALAGMAVALEQPLYVADSYNYGRYGELTLSSQSRQWLPTQLHPPGSAAAQALRAANLRDRLLLDDGKTWQNADAWLPGPGGLSAAHTLRVGDRLDGLTGVVSFSNGGYRIQPLDLPRVVAANPRPASPARLAGQLRLASFNVLNFFNGDGLGGGFPTARGAKTRADFLRQKAKIVSAIRALDADAVGLMEIENDGFGLQSAIQELAAALNDGQPADKQYRFAAPGAERIGSDAISPGMLYRPARLSPQGAAEVVAVGDPARNRPMLAQTFALGDGRKLTLAVNHLKSKGSSCADSQVDGVADIDLGDGQGNCNLTRSQAARDLLKWAQARAQGPQSGLLVMGDMNAYAKEDPIRILEQGGLANQLARFQPDAYSYVYGGESGNLDHVLADATLGQWVSRAGEWHVNADEPGVLEYGSEFKSAAQQQNYYAADAYRSSDHDPLYVDLQAAAGAPQRQDPSLPPSSASPGGAAGSVAAADPLLLALLGLGGLLAVRRRR

SEQ ID NO: 8384 - protein, 444 aa, Chromobacterium substugae
MSRKYFGTDGVRGEVGKFPINPEFVMKLGYAAGRVLVNHDRDSRPTVLIGKDTRISGYMLEAALQAGFTAAGVNVLLTGPLPTPGIAYLTRALRLEAGVVISASHNPFQDNGIKFFAEGGNKLDDALELEIEAMLEQPMATNPSQELGRARRIDGAAERYIEFCKSTFPNELSLKGLKLVVDCANGATYHIAPKVFHELGAELVEIGCEPNGYNINDKVGATYPKTLQLAVLEHHADFGIALDGDGDRLIMVDAAGRVYDGDQLIYVIAKARAAKGELKGGVVGTVMTNLAMELALQKQGVPFGRAKVGDRYVLEMLHGDGWQVGGEASGHILCLDKHSTGDGIISSLQVLASVKQLGLGLAEICSDWQPFPQTLINVRHNGCDWKQAAAAPLAEAEAALQGRGRVVLRPSGTEPVVRVMVEADDKSLADNWARAIAQAIERVA

SEQ ID NO: 8385 - protein, 278 aa, Chromobacterium substugae
MKTLLCGRFTLDLSRPLLMGILNVTPDSFSDGGRFSRVDAALARAEAMLAEGADILDIGGESTRPGAPFVSPEEEMDRVLPVLEQLRGIGAPLSLDTRRAAVMREAIALDAVDLINDVSALEDEGALALAARSQAAICLMHKQGNPDSMQDKPAYEDVVAEVAGYLQRRVQLCLDAGIARERLLVDPGFGFGKTLAHNLALLKRLDEIERIAGVPQLVGLSRKSMLGAITGEETPAERLGASVAAALESARRGAAVIRAHDVKATRQALQLWQALRES

SEQ ID NO: 8386 - protein, 637 aa, Chromobacterium substugae
MNNIGKNIAIWVIIGLVLMTVFNQFNKRQDTQNQLEYSQFVSDVESGKVQSLTIEGHPLRGQWLKGKLTDGTAFSTYAPYDPELVGDLIKNNVRFSAKPEEEPSMLMSIFISWFPMLLLIGVWVFFMRQMQGGGKGGAFSFGKSKARMLDQDANTVVFADVAGCDEAKEEVKEIVDYLRDPSRYQSLGGRIPRGILLAGSPGTGKTLLAKAIAGEAKVPFFSISGSDFVEMFVGVGAARVRDMFEQAKKNSPCIIFIDEIDAVGRQRGAGLGGGNDEREQTLNQLLVEMDGFDTNSTVIVIAATNRPDVLDPALQRPGRFDRQVVVPLPDIRGREQILNVHMRKVPIAADVNAEVIARGTPGFSGADLANLINEAALFAARRNKRLVDMEDLESAKDKIMMGAERRSMVMTEEEKKNTAYHESGHAVVAKLLPKSDPVHKVTIIPRGRALGVTMQLPEQDRFAYDRGYLMDRLAILFGGRIAEELFMNQMTTGASNDFERATQMARDMVTRYGMSDKLGPMVYGENEGEVFLGRSITTHKNLSEATLQQVDQEIRRIIDEQYALARRLLDENRDKVEAMTAALLEFETIDAEQINDIMDGKPPRPPKPGSSFAAKPEDKPAEPTAPVEATSDPAQEV

SEQ ID NO: 8387 - protein, 195 aa, Chromobacterium substugae
MQEHVNDQYVQMAQKDGYRARAAYKLLEINDKDKLIRPGTVLADLGSTPGSWSQVAARIVGEQGKVFALDILDMDPVPGVSFIQGDFREEDVLRQFEALLDGRALDLVISDMAPNMSGMSAIDQARSFLLCELALDFARDHLKPGGHFLVKVFQGSDFQSYLKAMRELFDEVVTRKPKASRDRSSEIYLLGKGRR

SEQ ID NO: 8388 - protein, 106 aa, Chromobacterium substugae
MKIDLKPFQRKYLQGLAHGIDPVVMVGNNGLTEAVVREIAISLDAHELIKVRVQGDDREARVAMFEQICEELGAAPVQHIGKLLVLWRPSDKQRIALPKNKQALKG

SEQ ID NO: 8389 - protein, 128 aa, Chromobacterium substugae
MWVIGIIVAPVLFKSLDAATAGMVAGRLFAVIAWVGLVCGVILLVDQVWRNGVAGLKHGGFWLIVGMLVCTLINQFGVAPIIVTLKQQMNHAAEGLFGGGFATWHAISSLIYLLQSLLGLAYVWQDRG

SEQ ID NO: 8390 - protein, 158 aa, Chromobacterium substugae
MIKVPLTVRGAELLKEELQRLKSIERPAVIEAIAEARSHGDLSENAEYDAAKERQAFVEGRIAELEAKLSNAVIINPSELDADGRVVFGATVDLMDLETEESVTYQIVGDDEADIKVSKVSVNSPISRALIGKEAGDVAEVVAPGGIREYEVLDVKYI

SEQ ID NO: 8391 - protein, 1069 aa, Chromobacterium substugae
MPKRTDIKSILIIGAGPIVIGQACEFDYSGAQACKALREEGYKVVLVNSNPATIMTDPDMADVTYIEPITWKVVEKIIAKERPDAILPTMGGQTALNCALDLAKHGVLEKYKVELIGATEDAIDKAEDRGRFKEAMAKIGLSCPLSFVCHTMEESLEAQTKVGFPTLIRPSFTMGGSGGGIAYNKEEFLAICERGFEASPTHELLIEQSVLGWKEYEMEVVRDKNDNCIIICSIENFDPMGVHTGDSITVAPAQTLTDKEYQIMRNASLAVLREIGVDTGGSNVQFATNPATGEMIVIEMNPRVSRSSALASKATGFPIAKIAAKLAVGFTLDELKNDITGGATPASFEPSIDYVVTKIPRFAFEKFPQADDRLTTQMKSVGEVMAMGRTLQESMQKALRGLETGLSGFDPVTTDEAAIRHELGTPGPERILYVADAFRIGMSRDDIHAVSKIDPWFLAQIEDLIGEEKALGGRKIEELDYAELRRLKRKGFSDRRLGELLGSDQAAVRAKRWALGLHPVYKRVDTCAAEFATNTAYMYSTYEEECESQPTDRKKVMVLGGGPNRIGQGIEFDYCCVHAALSLRESGFETIMVNCNPETVSTDYDTSDRLYFEPLTLEDVLEICRIEKPFGVIVQYGGQTPLKLARALEANGVPIIGTTPDMIDAAEDRERFQKLLQELGLKQPPNRTARAPAEAMTLAEEIGYPLVVRPSYVLGGRAMEIVHEPADLERYMREAVKVSNDSPVLLDRFLNDAIEVDVDCVSDGEQVVIGGIMQHVEQAGVHSGDSACSLPPYSLFPALQDEIRRQTVAMARALNVVGLMNVQFAIQGETIYVLEVNPRASRTVPFVSKVTSAPLAKIAARAMAGIKLADQGFTSEVIPPFYAVKEAVFPFIKFPGVDTILGPEMKSTGEVMGVGKTFAEAYVKAQLGAGDRLPKTGKVFLSVRDSDKNGAVDVARELQRLGFGICATRGTAKHLTEAGLIVQVVNKVNEGRPHIVDMIKNGEVDLVVNTVDEKRLAIQDSHSIRRSALQARVPQYTTLSAAKAVCVGMKHAEAFDVYSVQELHAQIRG

SEQ ID NO: 8392 - protein, 217 aa, Chromobacterium substugae
MLGITDLTTYLIGTLIIVLLPGPNMMFVLSVAAQRGIRAGFSAAAGVMSGDFTLMTLAAIGAAGLLQANPALFAVIKYLGGGYLAWLGFNMVKGAIVGWRRMRRGEEASAAPSALASGHPYRKALLISLMNPKAILFFVSFFVQFVDPGYPYPALTFAGLGLIVQVCSLSYMTLLILAGNRLAAAFRRRRKLSAALGGSVGAVFVGFGAKLAAAGLG

SEQ ID NO: 8393 - protein, 345 aa, Chromobacterium substugae
MVFNTAITGYQEILTDPSYTRQIVTLTYPHIGNVGANSEDTESSAVFASGLIIRDLPLLHSNFRAEDSLSDYLKKHNVVAIADIDTRRLTRILREKGAQAGCIMAGDIDEAKALELARGFGSMAGQDLAKVVSCRKPYAWTEKQWQLGAGYQVQSSTRFHVVAYDFGVKHNILRMLAERGCQLTIVPAQTPAKDVLALNPHGVFLSNGPGDPEPCDYAIDAIREILETKLPVFGICLGHQLLGLASGAKTSKMKFGHHGANHPVQDLDSGRVMITSQNHGFQVDETSLPANVRVTHRSLFDGTVQGIALTDRPAFSFQGHPEASPGPEDVAYLFDRFIGAMTERK

SEQ ID NO: 8394 - protein, 245 aa, Chromobacterium substugae
MIKWLGLAVLLLAGALSALPASLLAVPVARWSDGRWGVSDARGTVWNGGAQLVYLGPAGEVQGMSPLGWQWQPKALLSGLLVWHLDSAGQPGLLQLGLGKQEVRGLALSMPVAALANLSKTWQVARLGGELQLNIPQLARQGKEVSGAVQLAWRGAASPLTTVLPFGSYQLDAAGTPQGLNFTLSTLEGPLMINGQGSWPAGGAFSMAGTADSPPEQYDALKPLLLMLGQPAGPTSVSWQVKPGM

SEQ ID NO: 8395 - protein, 169 aa, Chromobacterium substugae
MTAYKQQFLDYWQQRSAREQRLLAAMALVLGAALLYLAVWEPASASLQRNRASVARLQAELGAVRSLAAEADKLKRQPAQTPLPAKELIPLLQQTAKSQGLAVAALQFSQDGESGVDMEGVVGFDAWVRFAGVLAAQQQVRVVNVKMEAQPVPGQVKIKALLAHAGAAA

SEQ ID NO: 8396 - protein, 396 aa, Chromobacterium substugae
MTTLRLYLRAGWPDSEPGLPWALLGARGELSAQGDSAPGGWPKADHCELVLPAGRTLFAEARLPDAVKQPTPAVMGFALEEGLGNDPGANLYAPGPTLADGRRLVAVTEAAALRRAVAMLKSLGRLCDRIVPEECLLPPPPADGWSVTALADRYLVRAASPYAACLPRGGAAVEQALFASLLALSPPARLQLHGVERPEELLSRLPGWQGDSARGEAHDWKQGKREGGFDFAQGELAANRRWRDWAPSLKRAGWLLGGLLAAQLLLTLCQSGWYAWQKHSLSQQIKSAAAPWTGGQAMPGSSALLMTRAVDKLRLSHGLPARDDMLELMGALAAASGRDLQARSLEYEAGRLKLQVNEVPAESLARWRKVLAARQIMLDATSSQPGSKQLVVAREP

SEQ ID NO: 8397 - protein, 330 aa, Chromobacterium substugae
MRRRQSGMAVIMALLIVALATTAASLVLWQQGLWWHQLENDKSRAQLRLVADAGLGWAMEILRFNSGPAGNGVVALSQLWAQPLPQTEAQGVKVSGSLSDLQGRFNLNSLVANGQTNTRQVVFYKRLLVTLGLPSKLSEPLLKSLRGGREDDGRQPAADSGNAAAPQPNHPLLRVEMLRWLPGYTPEVMEKLAPHVAALPPGVSQINVNTATDMVMKTLLPGIGDGNLLVLLNQRKSNYFKDAADFKARLPGAVAVADTDYGAASSYFQLDSRSSFGKARLQMRAMIYSSPNAVKLLWRQDGNDGRSQSARPGGEKHDDAATLSAGGLAR

SEQ ID NO: 8398 - protein, 194 aa, Chromobacterium substugae
MSARGQGGMTLLEILVAMSLLAILSVMGYKAFGSLLIARERLMQTGEQWVDAARAFRRLESDLSGQQPQPSAGDQQQGLALGASSLTLLQDGKGQSLVLESVSARYPSGMERISYHAGGGVLSWSAGDAAGGEPIRYALLGPDMKVSWRVMLNDGSWQDAWPMGDAAQGRVARALEMRVLMPGQQPVRRIWSLP

SEQ ID NO: 8399 - protein, 126 aa, Chromobacterium substugae
MRRQQGFTLFEVLVALAIIAVALGALLRATGLAADNAEGMERRMQANWEAQNQIAALQALRQFPEPGQQAGESKEDGIAWRWERDITPTPNPNFRKVVVRILAPGSGHYVLAEVTGYLRQTAGSGG

SEQ ID NO: 8400 - protein, 157 aa, Chromobacterium substugae
MMRPRQRGFTLIEVMVVMLIIGVLATTVTLSLRPDTHRLLNDEAYRFARVLEQAGDAAEMGDTLALSWNAKGYAFSRQDDDGNWVAAGDDLLAEHPWPDGIQGEGVLLDGKPWPAGRPLLLWQDGRAATLALRLGGAGRRLTILQSPLGRVTVADGS

SEQ ID NO: 8401 - protein, 147 aa, Chromobacterium substugae
MKQLKRTAQRGFTLIEIMVVIVILGVLAALVVPKVMSRPDEARIVAAKQDIGAISQALKLYRLDNGRYPSSDQGLSALVQKPTAAPEPKNWKPGGYLERLPKDPWGNAYQYANPGTHGEIDIWSFGADGEPGGEGNDADIGNWDSGK

SEQ ID NO: 8402 - protein, 112 aa, Chromobacterium substugae
MAKDKMLDADPIRNREYRKLLDAVADRDKARAALAARRPLPIQAWHPALWLAVAASIGAVVFLQSGAWMALLALTAIAGYLFAVSALRECISLRRRVDALQTLLQQALDQEK

SEQ ID NO: 8403 - protein, 403 aa, Chromobacterium substugae
MAAFRYTAYDAAGKEQNGLLEADSARAARAQLRERGLLPVAVDSVNAKTGNSGSNVLRRGLPRAELVMLTEQLSTLLNAGLTLEKALTAVTEQAESPRARTVLAALRSDILEGKSFAQALSAAPGVFSPLYRSLVQAGEQSGHLDMVMARLAEYLDKRQNTQQKVTLALAYPAVVTFVAILVVSGLMTYVVPQVVSVFAQTKQSLPFLTRALVACSDFLRQWGLLLLASIVAAVALTVRALRAPLLKRRFHAWVLRLPVFGRLFRALNTARMASTMSILVGSGVPLLTALETARGLMTMLPMQDAVADAMAKVREGVSLSRALNASKQFPPVLIHLISSGEASGTLSQMLDRAAQQQEQEVERKLATFTTLMEPLLILVMGGMVLLIVLAIMMPIIDMNQMVH

SEQ ID NO: 8404 - protein, 486 aa, Chromobacterium substugae
MNKPTLMPLLAFPFARANGVILLDGESGRQLLLREDARPAAWAEALRLHGGTLVGVETLTQAQFEKRLSEHYASRDGAAAEMVDDIGQDMDLNQMVESLPTVEDLLESEGDAPIIRMINALLTQALRDGASDIHIEAFEDRSVVRFRLDGTLRDVVSPHRALHAAMVSRIKIMSGMDIAEKRIPQDGRISLRLGGRPVDVRVSTLPTSHGERVVLRLLDKENARLDLATLGMAADTLASVDKLINQPHGILLVTGPTGSGKTTTLYAALSRLDASHTNIMTVEDPVEYHLDGVGQTQVNPKIDMSFAKALRAILRQDPDVVMIGEIRDLETAQIAVQASLTGHLVLATLHTNDAASAVTRLTDMGVEPFLLASSLLGVMAQRLVRRVCPQCKAPHPVPLEDEPDAIHYRPVGCPACGNSGYKGRYGVYELMLVDDTMQRLIHDRASEQRLRDHAQRHGMRSLRDDGLRWVKAGETSLEEILRVTRS

SEQ ID NO: 8405 - protein, 681 aa, Chromobacterium substugae
MLNFVNADIETVVKAIGEISGKNFIIDPRVKGTVNIVSSRPVPRAMSYQVLLSSLRLQGFAAVEGNGVVKIVPEADAKLHAKASRGIPRGDGDRLITKVFALKNSNANQLVPVIRPIVSPNNTVAAYPQSNALIVTDYADNIQRIESIIESVESAAAGDTVVLPVLFGSAVELSNTLNKLMQEGGADGGKTTILADPRANVLMVRADTPGKIGKIKSLLKMLDQPSQAGSNVRVVYLKNAEAGKVAQTLRALLTGDPGPLQGRTAVTTNGGSSAGSSALSGNTSSSGLGSSASNNAVGGAPANANAPAAASPLVNDSASSGAGGGGSMIQADPTNNALILNVPDSMYQNLRNVIDMLDKRRAQVLVEALVVEVSATRAMELGVQWQAAGGAVIGGTNFSGATTSGTSGTSIIGAGAALAAGGVGGLATSLAGSGGVNLGWIRHGNLAALAKALESESGSNVVASPSLLATDNEKARILIGQEVPIPIGNQSTPSSSTSGQPVITTSYDRKTIGFNLEITPQISEGGSIRLKILQETASLVASSPNLNAGSNAGPTTNRRVLETIANVDDGSILAIGGLLQDQVDDAEQKVPLLGDIPWLGALFRYSAKTHNKTNLMIFLKPTILRGEQDGRVIAQDRYQYILGDLKRDGKKLPLDLESAIQSLPEGGIKASLERDVKAVPK

SEQ ID NO: 8406 - protein, 205 aa, Chromobacterium substugae
MGRKPDFSRWTLPGRQWHKGLPVLAMGLAAFWLGQQLTALLAPSAQTYRTLAPAQPQTAAAAAAQAHWFGEAPQQPVAAPPPIRLLGVYAPTRPGVEGFAIIDSNGHSQPLLQGKQTADGWELVKVAPNGVTIRSGGNEQFVPLQARSGGAVAGDGDAGQPLPPPQPGQAPQAGPGAVPVPVPSQNSVPDTPPQPAVDPAAMIRQ

SEQ ID NO: 8407 - protein, 51 aa, Chromobacterium substugae
MPARQRPAAEIRLATQSCLIPRTHRLPVIKIMLNSCGCRLARLSSKRVLLQ

SEQ ID NO: 8408 - protein, 593 aa, Chromobacterium substugae
MIYQAPVKDMRFVLNELAELPAICGLPGYGECSVELVDAVLEEGAKFAEGVLAPINKQGDQGAKWHDGDVTAAPGFKDAWQQYVESGWVGLRAPEEFGGQGMPALVAAAVEEMWCASNLAFSLAPLLTLGAVEAIHHHASDELKQIYLPMMAGGQWTGTMNLTEPQAGSDLAQVRSRAVPAADGSYRVSGQKIFITWGEHDMAENIVHLVLARLPDAPAGVKGISLFIVPKFLVNADGSLGARNDVRCVSLEHKLGIHGSPTAVMSFGDNDGAVGYLVGEPNKGLNYMFTMMNHARLGVGIEGMAVSERAYQKAVEYARDRVQSRAVGSPDPAGVPIIQHPDVRRMLMTMRAQIEAQRALTFYTAAALDRAGRHPAPGEAARNQALLNFLIPIVKGWNTEQANEITSLAIQVHGGMGFIEETGVAQYYRDARITAIYEGTTGIQALDLIGRKTAADHGVAARALLGEAHATVAKLQAAGFASIAANLEAASADAERCVAFILETFGSQPQLAAAGSVPFLKLMGIVLGGWQLGRAALIAKDKLQEADADVEFLNAKIVTARFFAEHLLPQVSGLAAAILHGADSALALDDSQF

SEQ ID NO: 8409 - protein, 310 aa, Chromobacterium substugae
MAILVIAEHDNQSLKAGTLNTITAAAKLGEVHVLVAGHNAAAAADAAKSVAGVAKVLLADAAHYAHGLAESLSALAVDLAKGYSHVLAPASSFGKNLLPRVAALLDVAQISEIVAIESADTFVRPIYAGNVLATVQSADAIKVITVRTTAFDAAGQGGSAAVESIAAAADGQLSAFVGQELTKSDRPELGSAKVIVSGGRALGSEEQFKAVIEPLADKLSAAVGASRAAVDAGYAPNDYQVGQTGKVVAPQLYFAVGISGAIQHLAGMKDSKVIVAINKDEEAPIFQVADYGIVGDLFTVVPELIAELSK

SEQ ID NO: 8410 - protein, 243 aa, Chromobacterium substugae
MKRVVDYNVKVRVKADGSDVDIANVKMSMNPFDEIAVEEAVRLKEAGKVSEIVVVSMGVKQCEETLRTALAMGADRAILVETDTELQPLAVAKLLKAVADKEQPQLVILGKQAIDDDANQTGQMTAALLGWAQGTFASKVDVAAETVEVIREIDGGLETVKLRLPAVVTADLRLNEPRFIKLPNIMAAKKKPLDKTTPADLGVDAAPRLKTLKVAEPAKRSAGIKVANAAELVAKLKNEAKVL

SEQ ID NO: 8411 - protein, 138 aa, Chromobacterium substugae
MTVYFEDIAVGDSAEAGRTLTEADVLLFSAVSGDNNPVHLNQVYAAATKFETRIVHGMLTASLISGVIGTQLPGYGTIYLSQSTRFKSAVRIGETVTTRVSVVELFPEKKRVKLATQCLVGDKVVLEGESLVIAPSRG

SEQ ID NO: 8412 - protein, 358 aa, Chromobacterium substugae
MTENPPQKPDYPELSRQIKAWAVEAGFAEARITRASLPAEAEQRLAAWLAAGFHGEMEYMERHGALRLRPAELVPGTLSVISLRMNYWPAARAAEQVLADPSRAYLSRYALGRDYHKVLRNRLQKLAERIEAAAGAFGYRVFTDSAPLAEVALASQAGLGWRGKHTLLLTKRQGSLFFLGEILTDLPLPADDTEDGHCGRCRKCLDVCPTGAIVEPYSVDARRCISYLTIELKAAIPQALRPLIGNRVYGCDDCQLFCPWNRFAVQTAETDFAVRHGLDDVSLVELFGWSADDFRERMAGSPIYRIGYHKWLSNLAVGLGNAPSSAEVIAALRRRLDFPDELVAEPVRWALARHGESC

SEQ ID NO: 8413 - protein, 164 aa, Chromobacterium substugae
MAMDDTSVHSGSLPDEGATLALGAAFAAAAAPGLTVQLHGDLGAGKTTFTRGLLRALGHAGKVKSPTYTLVESYALNEYSVHHFDLYRFADPEEWNDAGFSEYFGQDSLCLVEWPDKAGDLLPPADIVLELAVAGEGRTYHFKAQTQTGQSCLNRLSTPSAARC

SEQ ID NO: 8414 - protein, 413 aa, Chromobacterium substugae
MPQSTFDPKRRALLGAAAATFLLAVSRNGFAAGSQIVALRIWPSSTYTRITLESSAAIQYKQFTLANPSRLVIDLQGVQLNGVLKDISGQIAAADPYIATARAGQFDQDTVRLVLELKTDVKPQAFSLTPVAEYQHRLVVDLYPASGQQDDPLLALLQDYNKGKLEQPPAQVKPKAKNNGRPIIVMLDPGHGGEDPGAIGMVGTREKDVVLKIGHQLKQLIDAEPNMRAYMTRSDDVFIPLGVRVAKARKLNADLFVSIHADAAPNRAARGSSVFALSEKGATSAFAKALAQTQNDSDLIGGVKIGSKDKYLAHTLLDLTQTATINDSLKLGKTVLGQLGGLNKLHKNAVEQAGFAVLKAPDIPSILVETAFISNPDEEQRLLTAEFQQQMANAIFSGVKHYFASGAALAARA

SEQ ID NO: 8415 - protein, 64 aa, Chromobacterium substugae
MSDSVRIVACPTCRAEVRWEPQSRYRPFCSERCRLIDLGQWASESYKVPAEEESPSGDALPPAH

SEQ ID NO: 8416 - protein, 252 aa, Chromobacterium substugae
MISFEFPVTERTRILLRLEYLYGRLSYFVGKDDPYDHHAALLVLFELMETASRADLKADLLQELERQKQVLEALRENPNVAEETLEGVLEEIERASGKLLALTGKFGQNLRENEWLMAIKQRAGIPGGTCQFDLPSYHLWQQRSAETRRQDLLRWAAPLMPTADASDILLRLLRDSGKTHHYVARKGAFQQMSGGKVVQLIRVAYDDNLELLPELSANKYALNIRFINAVTGEARPRQIEQDVEFYLTNCKF

SEQ ID NO: 8417 - protein, 204 aa, Chromobacterium substugae
MAIPVVGLTGGIGSGKSAAADRFAELGVPVVDTDRIAHQLTGPQGAAMAAIAREFGAAALTADGALDRAAMRELAFADPACRRRLEAILHPAIHEESLRQLAAARGDYALLVVPLLFESERYTPLLARSLVVDCREEIQLERVMRRSGLEESAVRAIMAAQLPRERRRQLADDIIDNNGGLAELRLQVDAKHSYYLANLVNALL

SEQ ID NO: 8418 - protein, 299 aa, Chromobacterium substugae
MLATHPGCLTGVALVLGLLVGSFLNVVIHRLPQMLDGEFLADSVEYLAENRRFPELRLAAQGAAAAMEGEAGCNLWRPGSHCPACGAPVRPWQNVPLLSFVLLRGRCRACGVAISLRYPLVEALCAAMFGFLAWTLGWGWPLAGALALTACLLALAFIDLDTKLLPDSLTLPLLWGGLLFNLHTGLVPLSDAIWGAAFGYLSLWLVFHGFRLLTGKNGFGYGDFKLLAALGAWLGWGMLPLIVLLSSLVGAVCGLAMRCASRIGPGQEIPFGPYLAAAGWIALVWGPQIVNGYLTWLSR

SEQ ID NO: 8419 - protein, 407 aa, Chromobacterium substugae
MATTAAKKTNPGYIWEWEGKDRAGKAIRGELRAESETVAKTQLRRQGINVSKIRKRRTGFGKRITEKDIALFTRQLSTMMRAGVPLLQAFDIAAKGHSNPAVTRMLLEVRADVETGLSLAEAFRKRPLYFDKLFCNIIAAGETGGVLDTLLDKLATYKEKVMAIKAKIKSAMIYPSAIVGTAFIITAVIMIYVIPAFKDLFSSFGANLPAPTLFVIWLSDQFVHFWWLIFGTIFGGLFAFFYAFKRTPKMQEQMDRILLRLPVIGDIIRKATIARWARTLSTLFSAGVPLVEALDSVGGAAGNQVYAEATRRIQADVSTGSSLNYSMQRTDLFPNMVLQMTSIGEESGSLDQMLDKVADFYEEEVDNAVAALSSLLEPAIMVILGVLIGGLVIAMYMPIFKMGQVVG

SEQ ID NO: 8420 - protein, 568 aa, Chromobacterium substugae
MEASAGISGLGRALVQHNMLLQQDADAIMRQAGASHITFVEQLILSKKMSARDIAVFASRVFGYPLLDMSSLDTEQLPKGLIDDELIASRRLLPLLKRGNKLYIGTSDPTQTSAYHAITFKTGLTVEIVVVEDDKLSKTLGRYQDNSTSALKELENEDFGDLEFADPDAQVDSGPQVEVDDAPVVKFIHKMLLDAIAGSASDIHFEPYEKYYRIRYRIDGELKEVAQPPLILKEKIASRIKVISKLDISEKRLPQDGRLKLVISKSRAIDFRVSTLPTLYGEKIVMRILDSSAATLDIEQLGFEPEQKQLLMTTIARPYGMVLVTGPTGSGKTVSLYTFLNLLNRPDTNISTAEDPVEINLPGINQVNVNERAGLTFASALKAFLRQDPDVIMVGEIRDFETADIAIKAAQTGHMVFSTLHTNNAPATLTRMLNMGVAPFNIASSVLLIMAQRLARRLCSHCKKPVDIPEEALLRAGFRKEDLDGSWQPYGPVGCEECRNTGYRGRTGIYEVMPITDAMTRLIMKNGTAVDISDLALQEGMVDLRHAGLLKVKRGVTSLAEIEAVTND

SEQ ID NO: 8421 - protein, 393 aa, Chromobacterium substugae
MNKKLIALALAALPAAAMADVTIYGTIAAGVESLKTYNANTTSFGGALQAGGLQSRTEINDWVSYIGFKGNEDLGSGLKAIWQVESRLNMDGSNSTGFGTRDSFIGLAGDSWGKVRVGKLSDYANSDMEQVDPGHYSNNGGATFGGAPSVGGLAMFTRVDGRHNNAVRYDGPEFYGFNISVLYAADEARKNVAGIVTNGQFSNIGLSYENSGFFGKYNFGSWGSPSELASLKDWHRFEGGYNANNIYVALGFQQVRGYVGINSAGGVATSITDNGGLLYNGNAASANLAGLVAQNPGLVNSKTVQLGRTREIALTGGYTFGAFTPYLSYAKGYNVNLANFGDVSNSGYDQWVLGLDYAVSKRTDVYTSYGHVNWKLQGAQNESSFGLGLIHHF

SEQ ID NO: 8422 - protein, 99 aa, Chromobacterium substugae
MKKLFAAFAGLMLLCNFAWAAVNLNTATAPQLEALQGIGPAKAKAIIDYRAKNGPFKTVDDLKKVSGIGDKTLDKLRKDLTVGGAAPAAKPGAKPVAAK

SEQ ID NO: 8423 - protein, 273 aa, Chromobacterium substugae
MTSILLVLSLFLILSYGAFTWHYLANWRGTARWPRNPRVEHSLLGVLLLVQALVVVAPLSVSGGLSLGVGHALGVMVWIMLLIYWTCSFFYRVEGLQLFMMPLAMAALAFAIAFPGRHMVSDLSNPAFVLHILVSMLAYSLFAIGALIAVLMLLLERSLHHKRMSLLARQLPPLLTLEKMMFQVIAVGFLLLTVALVTGVVFSEEVFGKAAALTHKTVFSVISWLLFAALLLGRRLQGWRGRVAIRWTLAGFLSLMLAYVGSKVVLELILQRG

SEQ ID NO: 8424 - protein, 451 aa, Chromobacterium substugae
MLDNLTNRLSGVMKTLRGNARLTESNIQDAMREVRMALLEADVALPVVKTFIAQVKERALGQDVMGSLTPGQALVGVVNEELVKLMGDKNDELNLAAVPPAIVLMAGLQGAGKTTTVGKLAKRLKETQKKKVLVVSADVYRPAAIEQLKLLAAQVGVEWFPSDAAQKPVDIARAAIDHARRHFFDVLLVDTAGRLAIDEAMMDEIKALHAAVNPIETLFVVDAMQGQDAVNTAKAFNEALPLTGVILTKMDGDSRGGAALSVRHVTGKPIKFIGVGEKVAAIEPFHPDRIASRILGMGDVLSLIEEVQKGIDQDEAAAMAKKLKSGKGFDLEDFKAQMQQMKKMGGMSNLLEKMPGQIGQMAKGIQGAEAEKSMRRIEGIINSMTPDERRKPELIKASRKRRIATGSGVTVQEVNRLLAQFEQMQKMMKQFSSKGGLMKMMRGMKGMMPGM

SEQ ID NO: 8425 - protein, 456 aa, Chromobacterium substugae
MNLTTLTALSPLDGRYASQVEALRNLFSEFGLMKCRVKVELEWLKMLAAEPGIEEVKPFSDATIREIDDVIANFSVEHGEEVKAIEVRTNHDVKAIEYWLKERLSGNPEVMAASEFIHFACTSEDINNLSHALMLKTARNTVLLPTLDEVIHKLQKLAHELANVPMMCRTHGQPATPSTMGKELANAVHRLKRQREQLVHQEILGKINGAVGNYNAHLVAYPDIDWESLCGRFVTGLGITFNPYTIQIEPHDYMAELYQVAMRVNTILIDLNRDIWGYISLGYFKQKVKKDEVGSSTMPHKVNPIDFENSEGNLGMANAIMGHLAEKLPLSRWQRDLTDSTVLRNMGVGFGYTMLGLKSCLKGLNKLEINPALIAAELDNAWELLAEPVQTVMRRYGIANPYEQLKELTRGKGGITRETLHAFIKSLDLPESVKASLLELTPANYLGKAEELARRI

SEQ ID NO: 8426 - protein, 722 aa, Chromobacterium substugae
MIMQSMYDQSSNTPSTDDNDAATASPPPVSARHLLSLNERGHAGLYQYFIEHDTNRILQHLDTLRGMAFTQDAEDGQVGPPERPFPSVCLIGLGRCGSNIALDVATLVYNARKFYLNEFNQDDKSAPEQEQRPRRWIRRNLLSPHKAAKPAFLIEPMVMLGDLDKDIKGRIRFSRRGEQGDFINNYNKLKIMDLAEVHAGGAGNAPILGQYLAKIILNKDTLSFSDPDWTLIHSYLVDSCGIKANQSRLYFYIFSAGGGTGSGMASEFGLAQQYAYMSKTFETRSEGKPEQADDYSFVFEPIFTSGICILPNISGQHAEGSEALHINAGRLLCKYLSEEWDFSYNFDNEEAGAESVMRRIRPWNAMMLISNDIMRYAEENDAGSIENLDVNAMERHANQYISQQIFNILTAQAVTSDYDENYFLRAGIDMGETIRLDANDLFMSLAGPVAVAYAESVVSDPLGSDGFVNKLDIDDLFFRSIDLPHFNQQTQAIEGISLLPIESASYRAALADYKQSGYAAEKLNQLFFFQNCSSVVAILSLPKGYKLSYLDLNRLKRHLNDLFPSTTLKRYALVIGASTNLSLTTLVAKSPCLSDDFLTLIVAFIKRCFAHGNHRFDDSLDKTILDLITAEHFDETVLERLLNEYENPAKILDTNWFAIKPMYEKKYRELIRDSKKFVSINDIRLTREHVQKAVCYLREIYRHRIGKTRVVSLNTYAHSKHA

SEQ ID NO: 8427 - protein, 1059 aa, Chromobacterium substugae
MWIVETALKRPYTFIVMAIIILLATPLAIMRTPVDVLPEIDIPVISVIWGYGGLPPQQMADRITQIHERVLTTTVNDIEHIESQSLSGIAIIKIFFQPGVNIQTAIAQVVAVSQAVVKQMPPGATAPLIIKYTASSVPVIQLGLSSKTLSEQDVFDTAVNTLRPQLVTIPGVAITYPYGGKVRLLSVDLDTRAIAAKGLTPADVVNAVNAQNLALPSGTAKIGGTEYDVALNGSPDSIAGLNNIPVKTTNGATVFLREVAHVRDGFSPQTNIVKQNGQRGLMMSIYKNGGASTLDVVGHLKEKLPGLLPLLPKGIQVSLLADQSIFVKTAVEGVIHEALVAAALTAVMLLLFLGNWRTTSIIAVSIPLSIFSSIVALHAIGETINVMTLGGLALAVGILVDDATVTIENIERHLHMGSPLYTAILDGAGEIAIPAFVSTLCICIVFVPMFFLEGVARYLFVPMAEAVVFAMLASYVLSRTLVPTLALLLMGHQHRGGRVDAWIHRVHERFNARFERLRETYVHLLSHLLTHRKRFIAGFLGFCLASCALYLLLGRDLFPEVDTGQIKLHVRAPTGTRIENTAILADQVDAEIRKAIPPEDLDSIIDNIGLPYSGINLSYSNSGTIGTLDDEVLISLKPGHRPSAGYVDALPKALEKRFPGVEFFFQPADIITQILNFGSPAAIDVQIVGKSQADNAAFAGRLLTRIQAVPGAADVHVHQRLDAPSIRLNMDRTRLQGMGIAPFDVAQNLLLPLSGSQQTQPAFWLNPANSIVYNMQAQTPQYQIGTLDQLMQLPINPPGGHAASQQTLGNLVTAAPGREAAIVTRYNILPSIDIYASARGRDLGSVAAAIQRIIDEEKAHLPKGSQIHMRGQVETMQSSYLGLSVGILGAIVLVYLLIVVNFQSWLDPFIIVSALPAALAGIAWMLILTGTDLSVPALTGAIMTMGVATANSILVVSFARQRLDEGLPPLSAALEAGATRLRPVLMTALAMIIGMIPMAIGFGEGAEQNAPLGRAVIGGLLFATVSTLLFVPVVFASFHRHLAKRKQQAADAPAAAQDA

SEQ ID NO: 8428 - protein, 384 aa, Chromobacterium substugae
MTESRHAHQGLPELHLHHERRGAVARKARVAAAVIVILLLAGLARTLLVRHADAAALAREAERRAVLTVSVVTPSPARADARLTLPATLQGMAEAQIYARTNGYIKRWYKDIGQPVKKGELLAELDIPDIDKQVQEAQANFGLAKTAYLRWKTLRAQDAVSQQELDEKESAYRQTEAELKRLRDQQDFARVVAPFDGIVTRRNIDTGSLVNAGNGGSAQALFATAQIDRLHLYAYVPQAQAGAIRVGDKADIARQEAPGQPSVGRVARTAGAIDPATRTLQVEVEVANAGHGLLPGQYVDVSFKLPNGGKLTLPTNTLQFGAKGSRVALVDAHHRVKLQTVALGTDYGHEVEIKAGLQAGDKVIVNPPDSIRDGQAVAIAAAGE

SEQ ID NO: 8429 - protein, 471 aa, Chromobacterium substugae
MRALPLLIALSLGACSAVGPDYVRPPSELPAQWKSGDGWLPAAPADAEPKTEWWRTFGDDELNRLEAEALARSPTLQAALARLDQAEAQSRVHGAAALPAVSLGAAAARSRVSADRPLSSYGSVNSSAVQNDLKPTLSVSYEIDWLGRVRRDIESARAGAEQAAADRANVELLLTAQLASAYLQLRQEDEEIRLLDGTIAAQQRVLELTRIRHQAGLAAAGDEALQAAAVSASRAQRELLLNQRRVGEDLLATLSGAPAPAFRLAPGALPAAMPAAPAGAPSQLLQRRPDIASAERAMAAANAQIGVAKAAYFPQLTLTPTYAGSESASLAGLFSTPALIWSIGLQASQTVFDNGKTRANVGYAEAGYRAALANYRQTVLQAVQEAQDALGALRGLDEARRQQDIAVRNQDQAYAITQLRYREGLDSALTLAIAQQSQLAARRTLAQLRGSQLIASVSLLKALGGGWQSGD

SEQ ID NO: 8430 - protein, 1018 aa, Chromobacterium substugae
MEVTRRQLFKLTAAQLGASSLVAMGFAPQLALAEVRQFKLMGARETRNTCTYCSVGCGLILYGLGDGAKNTHGEIYHIEGDPDHPVSRGSLCPKGAGLLDFIHSPKRLKYPEVREAGSGEWKRISWDEAVSRIARLMKDDRDAHIVEKNAAGVPINRWLSTAMLTASAGSNETGIISQKFIRSLGIVATDAQARVCHGPTVSALASTFGRGAMTNSWVDIKNADFILVMGGNAAEAHPVGFKWAIEAKKTRGTRLIVVDPRYNRTASVSDLYLPIRVGSDIAFLGGVINWLIQNDKIHWDYVKAYTNAALIVREDYHFDDGLFSGYDAAKGKYDKSSWNYELGDDGYAKTDPTLQHPRCVWQLLKQHYARYTPEVVNNICGTPVDGFLQVCKELGETARPDKAGTILYALGWTQHTTGTQNIRTMAMIQLLLGNVGMPGGGVNALRGHSNIQGLSDLGLLSTSLPGYLTLPSEADHPDLATYLAKTTPKSLQANQFNYWSNTPKFFVSLMKWMWGDNASKENDWGYDWLPKWDKMYDVLHMAELMYQGKMNGFIVQGFNPLASFPDAAKVTEAFSKLKYMVIIDPIATETSTFWQNHGEAHDVDPAKIQTTVFRLPSTCFAEEDGSIVNSARWLQWHWKGAEPPGEARGDNEIIGELFVAIRDLYRKEGGKLAEPILKVNWNYRDPKAPTPSELAMEMNGKALADLPDPADPSKTLVKKGEQIPGFAVLQDDGRTACACWIFSGCWPQAGNQMARRDNTDTGLGNTPGWSWSWPANRRILYNRASCDPSGKPWDPKRKLISWNGDKWVGGDVPDFKADAAPDSGMMPFIMNPEGVGRLFCADKLVDGPFPEHYEPMESPIGTNPLHPKVVSSPAVRLFDSDKKRLGTHKDFPYVGTTYRLTEHFQFWTKSVLLSAIAQPEQFVEIGEALAREKGIVQGDMVKVSSNRGFVKAKAVVTKRLMALKVNGQTVHQIGIPLHWGWEGVARPGYLTNALPPAVGDCNTQTPEYKAFLVKLEKL

SEQ ID NO: 8431 - protein, 295 aa, Chromobacterium substugae
MPLQSLDIKRRSASPTESPKVRQTLEVAKLIDTSTCIGCKACQVACSEWNDIREEVGHNIGVYDNPTDLSAKAWTVMRFAEEESNGKLEWLIRKDGCMHCADPGCLKACPSPGAIVQYSNGIVDFHQENCIGCGYCIAGCPFDIPRISKEDNKAYKCTLCSDRVAVGLEPACVKTCPTGAIQFGSKEDMKEVAAERVADLQRRGYQHAGLYDPQGVGGTHVMYVLHHADKPEQYSGLPNNPEISPTVQLWKGWLKPLATIGIAAAGLFGFLHYITVGPNRADGDEENETREEDKR

SEQ ID NO: 8432 - protein, 205 aa, Chromobacterium substugae
MKEKLLQRYSAAERINHWIVAICFVLLALSGLALFYPAFFWLTGVFGTPQLARMVHPFVGVLMFVGFFVQFFRYWRRNLINGQDIQWMLAVKDVLRGHETVEVGKYNGGQKAMFWTMTLCVATMLVTGVIAWRQYFSGYFPIPVIRLALLLHAWAATALIASIIVHVYAALWVKGTIRAMVEGVVTHAWAKKHHPGWYKEMTGKK

SEQ ID NO: 8433 - protein, 296 aa, Chromobacterium substugae
MTPTQPILPAEQIRAGDAPLMSLPVLRPPPDIFARRAARLLQLADGHAMADFLRLCAAICQQQQALHDASRLDPRSALEKLLQSLESELPDPVRGSAGLLLAQDAAALSRLAEHLLNGEYPTDGPLFAALPLLGAALQAQATRSIRQRPLPEPQSQQARCPCCGGLPLASLLLRGDSGHAQRYVLCSMCSHAWPVGRVRCLSCGNSRDLHYYSLAAQDHVPAAPDHQQPHQARGAREVEACGECHGALKQISLLLDTSAEAGADDLASLALDLLAGEAGFARIGFNPLFLPGREPA

SEQ ID NO: 8434 - protein, 243 aa, Chromobacterium substugae
MDARMTHRIVFVEDDADLAELISDFLSRHEMEVVVEPRGDAALDTIARQAPDMVLLDIMLPGKDGLSICRELRPKFDGPIIMLTSLDSDMNQILGLELGANDYILKTTPPSVLVARLRAQLRNLRPAQTAAEAQQPAKGSRKAVFGQLSIDPVSRDVVLAGEKIPLSTSDFDLLWLLASHAGETLNRDVLLKEMRGVSYDGLDRSIDVAISRLRKKLGDNPSEPFRIKTVRNRGYLFSLSGWE

SEQ ID NO: 8435 - protein, 440 aa, Chromobacterium substugae
MRNRGYLFSLSGWEARMRRLFIQFYLLLMSCFLVAVIMVGVVYKQAVDDVGERYLADLLRTTLSLIEADLRGVPEDRWSETLANADYGFTFRVKVEKMSNYILDDESRQALDRGEIVMLEDKYLFLQKLQDSNYLLVAGPLRYLFFLHRLKWFDYALLGLLGLSLAIPVFLWMRPHWRDLVALERASGRLANGDLSARVDLPPHSGVQHLAVAFNHMADNIGALINSKKTLTNAVAHELRTPLARLRYRLALLEGDEESKERQAIERDLTAIDKLVEELLFHARLDRPEAPLKLTSFNAIPWARDRIAGQAALAQEIHWIEPVGDTLEIIADEHLITRALDNLLSNARRHAGSIVATHILIDKQHYCIIVDDDGPGIPAEDRERVFDPFVRLDESRGRKTGGHGLGLAIVAGIARAHGGDVKVESSPMGGARFLLRWPTA

SEQ ID NO: 8436 - protein, 318 aa, Chromobacterium substugae
MKKLALLALTAAFSLVSANGFAAEKAAASAPAIHKAKKVEKKKVASAAQKAQAAKADASAPAKKAAKKHAKKHVAKKDASAAQKAQAAKADASAPKAKKAHKHAAKKHAVKKEASAAQKAQAAKADASAPKAKKAHKHAAKKHAVKKEASAAQKAQAAKADASAPVAKKAHKHHAKKHAAKKEASAAQKAQAAKADASAPKAKKAKKHVAKKEASAQKAQAAKADASAPVAKKAHKHHAKKHAAKKEASAAQKAQAAKADASAPAKKAAHKHAKKHVAKKEASAAQKAQAAKKEASAPAKKAAAKKHAGKKAAASAAK

SEQ ID NO: 8437 - protein, 228 aa, Chromobacterium substugae
MRVVRLTRGYTKHAEGSVLVEFGDTKVICTASVEETVPSFLKGKGQGWVTAEYGMLPRSTGSRMRRESAAGKQSGRTQEIQRLIGRSLRAVIDLARLGERQIVIDCDVIQADGGTRTASITGAYVALADAIQGLIRAGKLDASPLRDQVAAISVGVYQGQPVLDLDYPEDSSCETDMNVVMTGSGRFVEVQGTAEGEPFSEEEMLAMLALARKGIGELLALQRQALAG

SEQ ID NO: 8438 - protein, 292 aa, Chromobacterium substugae
MKLSIFQESRIGGRSYNQDRLALAHSRDTVMLVVADGMGGHMRGEVAAQITVDLLSELFYQQAAPTLSHPNRFLVNAISSVHQVILEYAADHRLPDVPSTTVVVAIIQQGQLYWCHVGDSRLYLLDGQGMRLRSRDHSQVQRLIDQGLLSEEGAKTHPDRNKIYNCLGATSDPDIDIGERQEVGPGCSIVLCTDGLWSQVQDGEMEKVFAGRHVNQVLPALINVAERRAGAGGDNLSALAVTLLDDSVELGDRDDVLDTEKTPPQKGGRLILESNLETMHQEILASQVGKGS

SEQ ID NO: 8439 - protein, 323 aa, Chromobacterium substugae
MTQSSKQTALPAGYRLAEYTIVRQLSVGGFSVVYLALDDDDHKFAIKEYLPRNLADRNREGEVTVPHEMDRDAFNLGLKCFFEEGRVLSGIAHPTVVRVSNFFRANQTVYMVMEYADGRSLGRELELAGGRMEERLIRKWFTALLSGLREVHSQRLLHLDIKPANIYLRRNGVPLLLDFGAARQTLSRRDKHFAAMYTPGFAAPEQYEKDQPLGPWTDIYAIGACLYVCMGGATPPNARERLERDGLEPAGKAFRHLYSRELTELCDRCLALAPDLRPATVMEVQKRLQETEYSQPEPPPGDGNKLVGWIRGLTGGRHREGTE

SEQ ID NO: 8440 - protein, 288 aa, Chromobacterium substugae
MILSMTGFAAATREFPGGMLSLEVRAVNHRYLDVQMRLPEELRIIEPQLREQIAARVTRGKLECRVGLNQVDSAAPTLELNQAFLSRLLEVSREVQQQSGENKGLSVGELMRWPGVLKSNELAPEVLQQLCLAALQTALADFNASRGREGEKLKAVLIERIESMEAIVAAIKPKLPQILDNYMAKLSGRLQEALGSVDEDRLKQEFALFAQKIDVDEELSRLTTHLSEVRRILKSGGQSGKRLDFLMQELNREANTLGSKSVSTDTTQASVELKVLIEQMREQIQNIE

SEQ ID NO: 8441 - protein, 138 aa, Chromobacterium substugae
MSVSSIGGGASNWPVQNSGSATWQQNQQNFQQLASALQSGNLGQAQSAYSSLTANLPNGGNGSGSQSNSPFAQLGQALQSGNLQSAQQAFQTLQSHHSGHHHRHGGGGGESSGADASTSTSASSNSGGTVGSLLDTTA

SEQ ID NO: 8442 - protein, 560 aa, Chromobacterium substugae
MFARSTMSSKCLLIIPPNITFEAFVNPSANSKYWTHANGKRYGVLITDVPLGVLTISAWLKEKCDAEVKVIDFNTEIHQTWDDPDATSFHDWFERVLSSVKKSGFEPDLIGFSSLFITGYENLLSLADISKQIFPQAFRICGGNLPTTMYREVFADSPEAFDALCFGEGELPLSELMAAENKQDYCNASAQWVTRESVKAGALYQHNFISNLDEIPDLDYDCIDLEAYHLNPTIKAYTSIGDRTNYITYMGSRGCPFHCTFCAAHTVHGRKMRSFSIERIERELFDLCERYSPNTLVIEDDMFLWDKDWAKSVLKIAQKLNLVCFFPNALALYALDRPMLEELYRTGVRQLTLAVESGSARVLKEVMKKPLKLSITNRVVEDCRDLGIYTDCNIIIGMPGETLRDIDDTREFLRSLDANWYRINVATPLAGSEMYINAVKNGQIKGDIRMAGYKKCVVETKDFTPAQIEAVAYDINLEMNFLRNSDLKYGNYERALETFSNVLLLRNDHALAMYKVIECKNLMGKFDESEALARRLDEMIQASPFWTRYFQEHGLEVASC

SEQ ID NO: 8443 - protein, 89 aa, Chromobacterium substugae
MTKAELIALLSDKSGLNKADVLRVLGAFDEVLLDTLANNGELSIVAGKFKVKESAARTGRNPKTGETIQIAAKRKVAFVASKQLKDRIA

SEQ ID NO: 8444 - protein, 288 aa, Chromobacterium substugae
MHIGYIGLGIMGRPCVINLLKAGHQVSVWARRKESAAEALAAGASWADSPAELAGQVEVLVTNVSDTADVESVLLGEGGAAQGARPGLVCVDMSTIAPNGARRIAARLAEHGVEFLDCPVSGGEVGAINGTLTIMAGGNAQALEKARPALQAMGQTITHIGASGAGQVAKACNQIAVAVGVAAVAEIVKLARACDVDPAPVRAALLGGFAQSRVLDVHGQRMIDDNYAPGFKAKLHAKDMHIVMDTAREQGISLPAAERTMQLIDQLVGQGEGELDSSAIARLIWQQN

SEQ ID NO: 8445 - protein, 111 aa, Chromobacterium substugae
MNPQNDDKRRSAVALSYQDGQRSPRVVAKGYGQMAQRIIECAQEAGVFVHDSPELVSLLMQVDMDKHIPPELYRAVAEILAFVYYLERQAGDGQAEFEDWLAGRKTPVSNP

SEQ ID NO: 8446 - protein, 346 aa, Chromobacterium substugae
MIPSLPNAIAITTQGAQTLNQLRAPVDGARLLEALVQPSRLPSLMIGELLTAKVADQLGNNQLAVLIKNGLFTLSLPPGVNPSGDTLNLKVVSLEPALTFALQEGGKDAPPAQDGSVAVKLSQASRYLTTLLGASDESAAPSKPLQLDAAEHPPAVLAKQLQQDVKQSGLFYESHLKDFSNGLHPIEQLKQEPQAKLTLTLHALALDDGSKTSQSQTRPQLQELGGLVQRQLDGLENRAVQFQGMAWPGQPMQLQIEQEALQNERRGDGQEDIPVWNTSLALELPALGGMAVRVRMVGQSVQVSFSADEGETGQRIQQNAARLQNGMAAAGLTLASLVVNQNEPAE

SEQ ID NO: 8447 - protein, 117 aa, Chromobacterium substugae
MSGAFFPYLMVVLWLTLAVAMVYLFGRLQRLESKRDSLTSLYLDQQQQQISSLQREVARLQSRSEHQAQAEPGLSPYNQAIEMIRQGLTASEVASRCGISRSEAELIVSLYRNSPTS

SEQ ID NO: 8448 - protein, 112 aa, Chromobacterium substugae
MEQQFAMSAEGLADLIDALEPLAAQTLEVARSHDRPRFVELYRSQEAYTQQLLKRLEAGESQQLSGAQRDTLRRVLGLRVQTQQQIASWAEQVKHELRALSQSSKLSRQYKA

SEQ ID NO: 8449 - protein, 140 aa, Chromobacterium substugae
MLKQFNQAYANDALKTAVYGASPVGIVVMLYEGAIKALGAASIAMDAGRFDEKARMISKTVDILEGLRIALDLDQASEAAANLNDLYLYMKLRLAKASLKNDKEIIAEVRGLLETILPAWQQVDKANAAKQHDASAQSGA

SEQ ID NO: 8450 - protein, 432 aa, Chromobacterium substugae
MIERQPLTASQGRADQYNTQLSTVGKLSSSLSALQTAMTSLSSGRFLQVFKASVSDASMAAVSTTSGGNAGTYQISVSNLATNRQLVFDQSGGKNITDPKATIAGAPDQLTFQINGKTQTVKLRDKPDEAVSLQTINDKINAAGIGLNATIVQNGSQYKLVLASSESGNDNKFTITGGGTDSGKTGGSTLAGLSQSDNGAKESQDAQDASLTVNGVAITAGSNKVSNAVPGAEVDLYKAGTFTVSLAPDSAGVGKNLQAFVDAYNQVVGDVKAARSGAMKGNASILDIQTRLQQVLSTPVAGADPVNSVAFLSQAGISLQKDGTLKLDQTAFNDALKKDKQAVTNLFGNPANTGFAQRFNTEINGMLGPTGLIETSRATIKSKVSTETQLQSSLQARLDSKQTQLIQQYTALNKTLAQMQSGSNSLFNLISK

SEQ ID NO: 8451 - protein, 145 aa, Chromobacterium substugae
MRSVIMQIPSVLSPSINTANAPAPRQQLVELAQAPSSDPNQSVLADSAQAVAAAGQSQQQQSSADAQKQQTDPKQLQDSVNQLNTAASLYNSSLQFSVDKDTGATVVKVVDKANNQVIRQIPSEEALRIAKAIGDFKGLLLKDKA

SEQ ID NO: 8452 - protein, 282 aa, Chromobacterium substugae
MAITVNTNIASLQAQLNLNNSQMSLTTSLQRLSSGLRINSAKDDAAGLAISQTLTSAINGNNQAINNANDGISVGQTAEGALGQIANNLQRIREIAVQASNGAVSNTNRSQLQSEVDQLTQEISRIVQTTQFNGTQLLSGSAILTFQVGSSGASSNQVSISSVDMTSAGVLCSYNSSLTATGTINITSQSGASAILSTLDSDIAEISTVRSTWGSVQNRFDAVVANLHNYVQNLTAANSRIVDVDFASETANLTKNQILQQAGASILKQANTLPQSALTLLQ

SEQ ID NO: 8453 - protein, 292 aa, Chromobacterium substugae
MVLWADKGNEMAITVNTNLASLQAQINLNNSSTSLNQSLQRLSSGLRVNSAKDDAAGLAISQTLTSAIRGNNQAMKNANDGISVGQTAEGALGQIANNMQRIREIAVQASNGSVSNTNRSQLQNEVDQLTQEISRIVQTTEFNGTKLLSGGATLTFQVGSSGSSDNQVSVSATDLTSGGTLHSYNTSLSAVKTIDVTTQGGASAVLSSLDADISQISNVRSTFGAVQNRFDAVVANLQNYTANLTAANSRIMDVDFASETANLTKNQILQQAGGSILKQANSLPQAALTLLQ

SEQ ID NO: 8454 - protein, 1285 aa, Chromobacterium substugae
MEPSQIRKPRVGVLTRDLQDAACYKLRLGDPLCLMSPVLEAYHFKNQADHSYEGVYPFKEDRDFVDAMDMFIVQRLFPYPEFRPLLEMIVASGKPIVYEVDDWLLDMSEQHVMYSICEPSFKGIEWLLPQCSLVTVSTEALVEKVKPYNDKVFVFHNHLATERVVEPLPHSGQVTIGFAGTSTHAKDVEMISSALLRIYHEYAGQVKFVFWGDVPPDFVGIKDVRKVPEFVTYNEYLSELAKLKIDIGIAPLVQSEFNDYKSDIKWLEYALVGAAAVVSDVTAYAGLKDSGLAMVADNTEEGWVAGISKLIDDAALRAEQAAAARRHVLENRLLEPRVGDLLAQYAALLPEALKPQPLAQPGRIVTHALAENDVDGLKAYRKWVKRRQIREVHAEQLAERMMMAWKQVPVFNLILLAPSNRLTRLSESFTAMENLLYRHWRLIVVSDAPEPDPVFSSSPNLGWVQLASMDDEQQVSEVINSIIADVPADWVMLLPAGARLQPNALARLGEEIHAHPEYGAIYTDHDVVSPMGKRFRPSFLPDFSPEYLRSMDYTSYAVAFQRETLAKIGGMQPYPRAHCYDALLRIYENWDRGAIGHVDDVLVSLPWVDPKMDSLGNASRRVALESHIGRCGLPASVDEGLVAGTFYYEYQLLASPLVSVIIPSKDKLECLEPCLSSLFGITGYQNFEVLIVDNASQDPETFEFYEKVQARYPGRIRILSYDAPFNFSAQCNLGAREARGEYLLLLNNDTEVVFPHWLERMLATAQQPGVGAVGARLLYPEIGRVQHAGIVLGMPGGMYSVADHVFEDMDYLYPGYLNRSLTMQNYSAVTAACLMVEKQIYEAVGGMDEEVFQVCFNDVDFCLKIQAGGLRNVYTPYAVLYHHHAKSIGRVTTDPRPALKAAVREREEMEAMLARWLPVMGNDPGFNRHLSLRTKRVAIESDRIVAWDAKLPGRKKVLGIPVPGGSGEYRLSQPLQVLQEKGKLDGEIHQPSAGIPTVVELVRQGPDALLLHTGISDYIYETMEAYRRYIPDLRIVFGLDDLVGGVPEKSSLYDHWSRHYPDAKQRLRRVLKLCDAAVVSTQPLADLIQKMVGEVAVVPNRLRRSIWGDLKSERRVGDKPRVGWVGAGQHRGDLELIHEVIRATHKEVDWVFMGMCLPQFRPYVAEVHHAVTFADYAAKVASLNLDLAVAPLEINPFNEAKSNLRLLEYGVLGWPVVCSDIYPYQTNDAPVCRVPNQAEAWIEAIRARAHDMDATAREGDALRDWFNRHYWLEDHYEDWFRILHG

SEQ ID NO: 8455 - protein, 77 aa, Chromobacterium substugae
MGWFHVIFLRFHGGSSPGHELNRVRSRTPRTAIQQERTRSERKKRACRPLSENRAAAKPRAPIGAEPPRPSGRSAPL

SEQ ID NO: 8456 - protein, 584 aa, Chromobacterium substugae
MKKLLFVVPMHISWDSFTKPEFYNVQLAKADGKVYNIPRTDLPLGPLSISAYLKKFLPLDVKLIDFNAEVNALDAVPFDSFEALCRHFFRQIEDFAPDFVGVSSLFSPSFANFMDCGRMAREVWPDSIVVGGGNIPTNSYEQIYRDMGCTFFDGLCFGEGEKPMLNLLQAEDPLAFLASSSAWITRSNVMDEALLVPKHDFIDDLDEIPFFDYDLCDIDKHEINQVVASYHNLDKTRGFHVMTSRGCPFLCTFCASHRTHGRSMRYHSLERVKEDFTRLVKHYGAETVIFQDDHLMADSDRVYKILDIVKSLNLQSVYQNGLTLYALDRPMLQAFWDAGVRHLVLPVESGSEKVLKKQMKKPLKMKISERVARDCRELGIYTNTNILIGMPGETKEDLEEARRNLREIASNWFNIACASPIVGSEIHEISKEKGYIKINSLGSDYRTAVINTEDFSAEFIQEYQYFMNLDLNFVHNYDLRCGNYEWAERGLKNVLRLKSDHAFAHYYLAECYRGLGRLDLAQHHRDCYLQSVQSSFWGRWAWIFGLDGVNPDDWSEENYGLLAEILLPRAAPEGDAPIALAAQA

SEQ ID NO: 8457 - protein, 1155 aa, Chromobacterium substugae
MHLLCHYLNKLGEEAYVFSPETDPKLRTPYLTQDIVDRHKASGRSPIVVYPEVVHGNPLNGKAVARYILNHPGLLGGPKDYDPSDLLVFWHQDYVDYAKYPDPSFIFIPSIDTAIFNNDDNPHDDSRHRVLVYPGRYKHAERDFPALFQNTDVITYEWPQSHEELAALLRQGKVLYTFANSAIISEALLCGCPVVVMETVFSKKPEERAGLALGLALPGVTFEDTPQAIAAAHGKVVDYQQVYHQYQLELLQQLEGFIAASQKMPQGGPNEIVFPSLKPAQASPEQARYDAWIARNELRPWQAEIHAERMVRSWGSQPRFIVLMPLTADRQQEALKSIGSMGQQLYKHWQLIFIADFDWPHAAFQGSDVLGWLRIDDARDPSQLTQAFAAVIGALPCDWITVLPAGAELAVNALLSLGDHASLHPEWQAIYSDCDELGADGKRCRPVFKPDFNLDLQRGADYISPSVWFRREALQETGAFAEAPAADGCDALWRLHDAYGGRVIGHIADMLVHLPAAAAEPADAAAARERALAAHLERQGGAAVIQPGAAVGSFHIRYLAAGQCKVSVIIADAGDGVSLSSSIDAVLAADWEQVCEILAVTPAAAELPAAARRVACASELSLAGRYQLGAEAASGDYLLFLDSRVEVGRSDWLPDLLGLASRQGVGAAAPRLLRADGKTVWRGPLLLGADAGAASVFDGADAAAPGDLGRQLIEHNPGAVPLDCLLMSSALYEEIGGLDASLEDADSAAVDLCLKIRAADKLLVWTPFVSALRQPDAAPLAARLDEEALSRRWYGWLRHDAAYNRHLSLDSRQAFQVENVYSAEWDPDFYERARVLMLPGTSPAGAARLRAPLLRLMDDGKLLATMLPAGQRLPSAGELERLAPDVLVQAARFEPGFLDWLRLSRRSRPDMLSILVLDDLDAGGAVSDRYARTMLRALAREADRIIVPTEALRALAGAFCEDVRLVPEALDEARWEGLISLRGMGKKPRVAWSGTEAEVEDLMLLTGIILATGGEIDWIVFGHCPDALHPYLAEYHPFDLASEDYPRKLASLGIDLAVMPKHADGRREAAGRRRLLEYGALGIPVACSALDDWPGLAQAPVARADNEAAAWSQVLLERARDLERAGREGERLKAWVKENCMLGPHLPSWLEALGR

SEQ ID NO: 8458 - protein, 38 aa, Chromobacterium substugae
MHGAHAIGDPGIAWRAYVVGLVTLIVEFFFDLHIRLLS

SEQ ID NO: 8459 - protein, 53 aa, Chromobacterium substugae
MRLPEPERRLRAMPIRGAAADSETRPRRGGWPWFPCLEFMKASEYADRKKILQ

SEQ ID NO: 8460 - protein, 349 aa, Chromobacterium substugae
MPPRTLEQDLDAILGRKPELWDSLRGASLFISGGTGWFGRWILESIAHANARLDAGIRVLALSRNPEAFTRQAPHLAANPAIRFHVGDVRDFSFPRERFSHFIHAATTSAHETFRGETSLNKFDTLVSGTRRVLDFAAEAQPEHFLFTSSGAAYGPSLAGRPLREDDPFAPDTMDPITALGQAKRAAEFLCAAYAQQHGWHLSVARCFAFVGPFMPLDIHYAIGNFIQCAMRGHPIIITGDGSPSRSYLYMGDLVVWMLALLQREGGARVFNVGSDAAITIAELAREVRDRVCPAAEVRILGQSDASVGNPARNLYLPDIGRARAELGLAPWTPLGDAIRFSVDAFAGA

SEQ ID NO: 8461 - protein, 263 aa, Chromobacterium substugae
MTPAVESAPRFDDNGRCLPHTATQAACHRQTRRYFLPHQPRIDYAAIHQRISRHLGAAEGLDAAAFEQRARAILAKLESDADGRRLLNGAHVPFFLPQAAHDDIGQALDERYLPAVKSVYDAELPQYSFVNHHKPSLSGLLTPAEGARHDRLIEAMRQGPVVGFYFPCLLEYSVPAAIEQLETLPAPFLLAGGYDSCAAFIGSPDLLLRKAGYPPLLWLSGLEAERDGVGYHFEAYGYDLTFNRRVHNDQAAEYWASALVVLG

SEQ ID NO: 8462 - protein, 370 aa, Chromobacterium substugae
MNAPLDTTNLALSQAEQAKRNDLARRKPYVAAKLARIAEMEERGEISPIIRLEKSYLCNFKCTHCSAEYYMDRHLKNVIKVVDTRSKMDYDDIRNLSRQADELGLARFVITGGEPLVMKDFDQVIEALDPEKHYIITDSNGWFLDLERAKHLKAIGVEKVQISLDSFVEKDHDNFRNKPGSYKRVMRAVDACLDAGLNLILSTVLVKGRAKTEEFRRMCEYVTQRGIGLYVSYAKPTGSCTEHPEFVIEKEDADILRQLEKEYNVFSHMTPSYGSHKGCITVKGIITVTSTMEVTPCPYIDFSIGNLRETSLKEVLARGMRNPWLGPHRPDCLIGEDPKFIKIHTEKTAGAKFLPLPWGQGFSDQDSLYD

SEQ ID NO: 8463 - protein, 197 aa, Chromobacterium substugae
MHKHPADRQQAILDAIDTLRQAVGSAREGLPEEIFLFVSSLTPMINVDLLIRDEQGRTLLTWRDDRFCGPGWHIPGGIIRFKESSADRIAAVAAHELGAEVSFDPHPLCRHEMLIPKRDVRGHFISLLHACRLTTPPDSARRFDPAAPRAGDWAWHARCPDDLLPVQQVYRGYIDDDPAMRQSPPIQVLAENAEDHQ

SEQ ID NO: 8464 - protein, 386 aa, Chromobacterium substugae
MAAITHCRICAQRLFDEPLLVQRDMPAAAQGLPAAERLADDRGVELALRQCGGCGLLQLDAEPVPYWRDVIRAAGISPEMRAFRLAQFGAWLAGHGLAGRKVLEVGCGRGEYLSLLAEAGADAYGVEHLPASVEACGQAGLRVERGFVDSPETRLADGPFDGFMILNFLEHIPAAHLTLQGIAANLADGAVGMVEVPNFDMIVEKGLFAEFIPDHLFYFTERTLTGLLEANGFEVLDCRAAWHDYVLSATVRKRAPQRLSALVACETALRASFDEFLGRFAPGRVAIWGAGHQALALISLMGVAGRIRYVLDSAPFKQGRYTPATHLPIVAPERLQDGEVDAVIVLAASYSAEVVRQIQARHGARFAVAFLADNRLQTVDPEAGDA

SEQ ID NO: 8465 - protein, 609 aa, Chromobacterium substugae
MSAKLVRLADYVMDFLAARGVRHVFLLPGGGAMHLNDALALQPDLTAVHCHHEQACGIAAEAYGRLAERTGVAMVTTGPGATNILTPVAGAWIESLPLLVISGQVKRADLLQGSGLRQKGVQEVDVVSMARPVTKHAVTVTDPQAIRQHLEQALHLAHSDRPGPVWLDIPLDVQAARIDPDSLPGWQPEADAAPAAQNYVAAIADLLKQAERPLILAGHGVRISGGADALRRLSEALQVPVAATWNAMDLIPWDSPLCAGRPGVVALRPGNFAVQNCDLLIAIGSRLDNILTAYNPKGFARAARKVVVDVDAAEIAKLEMEIDLPLAMDAKACLEGLLAAADHLPKSRWQPWLDRCAGWKRRYPVQDGAPFPASGQISHYHFVDALSDAAPENTLISTGSSGLAVEVFYTVFRNKPGQRVFLTSGLGSMGYGLPAAIGACLGNGSQPMIALESDGSLQLNLQELATLKALRLPIRLFIMNNNGYASIRNTQRNYFDSRYIGTGPEAGVAIPDLLALAEAYGLPAVRIERVEELAEGLAKVLAHPGPILCDVRLNENETLQPKAAALPQPDGSMLSMPLEDMSPLLPLEQLRAEMLIPLLPASEAAQRGG

SEQ ID NO: 8466 - protein, 495 aa, Chromobacterium substugae
MRKPLFIFEMANNHMGDVEHGIALIRAIRESCQGFDFDFGFKLQYRNLDTFIHPSFKGRDDVKYIKRFEETRLAPEQMLRLVREMKANGFKTICTPFDEESVDLIEAHGIEIIKVASCSFTDWPLLERIARSDKPVVASTAGARREDIDNVVSFMLHRDKDLTIMHCVAEYPTPNENLHLARIRQLRDQYAGVRIGYSTHEDPELMEPVMLAIAQGATVFEKHVGLPTGAYGVNNYSATPEQIRRWIQAAARAFAMLGDGGCDPASTVEQASLRSLRRGVFATRPIKAGESLTEDNVTFAFPPVEGQLTANEWSKYTHYTAAADIAADAPVLSAQLQPQHLRDRVMKTVDAVKALFKTANIVVPGRSDLEISHHYGMERFSEFGLTMVTVINREYCKKLIVMLPEQTHPEQYHLKKEETFIVLYGDITIWLDDEERQAQAGDVITVQRGVRHRFHTRGGVVFEEISSTHYVDDSYYTDERISANKDRKTRLTYWM

SEQ ID NO: 8467 - protein, 437 aa, Chromobacterium substugae
MTDISREAVLALARQHAEARLAQADFLPGQTAVPPSGKVIGADEIVNMVDAALDGWLTTGRFNAAFEARLAEFIGLPHVLTVNSGSSANLVAFTALTSPKLGARAIQPGDEVITVAAGFPTTVNPIIQNGAVPVFVDVQLPTYNIDAELLEAALSPRTKAIMIAHTLGNPFDLEKVAAFARKHGLWLVEDCCDALGSTFNGQKVGTFGDIGTLSFYPAHHITMGEGGAVFTADPLLRQIMESVRDWGRDCYCAPGKDNTCGKRFDWQLGQLPCGYDHKYTYSHMGYNLKISDMQAACGLAQMDRLEGFIAARKRNFAYLSERLQSCAEFLTLPQATPGSEPSWFGFPLTLKPEAQVSRVELLHYLDQHRIGTRLLFAGNLTRQPYMQGRNYRCATPLPVTDRIMNDTFWIGLYPGLSQQMLDFAAGKLETFLGANFD

SEQ ID NO: 8468 - protein, 347 aa, Chromobacterium substugae
MNAAFWSGRRVFLTGHTGFKGGWLSLWLDSLGARVHGYALPPSARPSLFDAARVGDAAASELADIRDSAALSAALARAEPSIVFHLAAQPLVRQSYDDPLGTLSTNVMGTANLLEAARRCPGVEAVVVVTTDKCYENHEWPWAYRESDALGGHDPYSSSKACAELVCAAYRSSYPGGAPIATARAGNVIGGGDWSADRLVPDLLQAFAEGRSLAIRSPDAVRPWQHVLESLAGYLRLAERLAAGQPDAASAWNFGPADDSNRPVSWVADTLAGLWGGGGWHRDGADHPHEAGILRLDSAKARRRLGWTPRWSLEEALSATLDWHRAWRRGADMRAFTIEQIAAYSRV

SEQ ID NO: 8469 - protein, 232 aa, Chromobacterium substugae
MIEVGGKPIIWHILKIYSAHGINDFIICLGYRGYVIKEYFANYFLHNSDVTLDLCNNQMLVHERHAEPWRVTLVDTGEGTQTGGRLRRVRKHLESERDFCFTYGDGVSDVDIGAAIAYHRSQNVDATVTAVHPPGRFGALDIRNERVECFKEKPRGDGGMINGGFFVLNPAVLDLIDGDECVWETEPLETLASRGQLAAYEHNGFWQPMDTLRDKNLLEELWQSGEAPWKKW

SEQ ID NO: 8470 - protein, 242 aa, Chromobacterium substugae
MLAIIGGSGLAQLSVLEVTHRQVVRTPYGDPSCALTFGKLAKQNVVFIARHGYGHSLAPHEINYRANLWALHNQGVKGVIAIGTVGGIRPDMAPGRLVVPHDIIDYSWGRKHTYFEGPERPVVHAEFTSPYDDSLRQRLRAAIQASGISGVHDGVYACTQGPRLESAAEISRLERDGADIVGMTGMPEAALARELDLPYAHLCLVSNWAAGKGSNARVEFDPAVAAKSVQDLMHTLQACFAN

SEQ ID NO: 8471 - protein, 56 aa, Chromobacterium substugae
MNSNHNKSTPKTDPPAAPQLLHSRQLFGAGREILIEHQGEIYRLQLTRNGKLILIK

SEQ ID NO: 8472 - protein, 733 aa, Chromobacterium substugae
MALFRATPLMLSLAAAWPAFADPAAPTLDAVQVTAHRSEKPLAETAPNASVVSGHKLDDRLINDIADAAKYEPGVEVATDPNRRGNAGWTIRGIDGNRILMLIDGERLPEAYAGGGNGNGAISGRDFVELETLRAIDIVKGPTSSLYGSDAIGGVIGYRTKTVDDFVPEDKGVGGSFKGFGASADNSWGGTAGVGVKGERADAMLIYTHRNGHQADNQGGNDSGSAARTTPNPQNWHSDNVLAKLGYKLTEQQRLELTLEHYRRDTDTNLLNTLYPAYVSRGRPVPAQLAQTAADRTQRDRVSLGWEGKQLGPFERLSAKVYQQKLDNADDSFARYGDGSSVASNYGFEQKILGLSLDAEQRFAALAAEHQLLWGVDLSRTDTSRPRMKTQYNANGSTSNVIGGETFPSKTFPDSTSDRVGLFIQDEMKFANGIALSPSLRWDHYKMNTQPDQAYANSGGQAVPSFSDGAFSPKLGLSIPFAGHYTGFAQLSSGFRAPPFDDANMAFVNRAYGYQVIANPNLKSETSRGVELGLKGQWDSFDFGLTAYQNRYRDFIEQQSLGTIGGLLTYQYQNIGRVDIKGAEARAAWRFAPGWQTQASIAYAHGEDLDSHAPLASIAPLSAVLGLRYDQSGFGGEALLRAAARNTRAPAVALPPPSTAQTAGFQAPGYATLDLTAYWKPAKGTTVRAGVFNVFDRKYWKAADVRGLAAGDATLDRYTQPGRNVSASVEYQF

SEQ ID NO: 8473 - protein, 344 aa, Chromobacterium substugae
MSQLWDRYQTLKASQPRLRARDAAAALQVSECELTAADPAATPLRAEWPEILAALAPLGRVMALTRNHACVHETKGDYANVEIDGKVGLAINPVIDLRIFLFHWRHGFALRSETPRGVQRSLQFFDRHGEAVHKVYLTEASDIAAYDDLVARFAAPAAALELEPVAAAGAEQPDEAIDRDAFQNEWQSLSDVHAFHPFLRRWQVSRRQGFRLAPPGQAWRVREDAVEQLLRRAAATATPIMVFAGNRGMIQIHTGTIVNVQVVGDWLNVLDPDFNLHLRTDLIAEAWITRKPGDNGVVTSLELFDEQGESLATFFGERKPGRAERAEWVKLLGELPPLEQEDVA

SEQ ID NO: 8474 - protein, 263 aa, Chromobacterium substugae
MSRKTMLAGALLAMLALPGHAAERLVVVTPDIAEIVVALGAAGDVVGRDRSSKEPQLAHAQVVGFSRALNAETIAGLKPTLVLGSAAAQPPTLWPQLKQLKLRAEEVSAREDGRDFADAIRKVGQLLGRADAAARLAADWQQRMQPRPARAVRYLVSYDGSLVAGKDTAPDTLIRAAGGVNAAAGISGFKPLGRDAWQALRPNVIILGSHTAAVYGGKDLFAKRPEVAATPAGKTGRIYLLPPQQAMLIGLDSPAVVERMVRM

SEQ ID NO: 8475 - protein, 319 aa, Chromobacterium substugae
MSAARRLLWPGLILASVALPLLALSSSAGQLAWPDLADPLVSQLRLPRIAAALGVGAALAASGAALQALFRNPLADPGLIGTSSGAALAVIAVLALGLSGLTLPLAAFGGGLLATWLILLLARLVKGGIAGLLLMGLVVGAFCGALSSLILFLSDDLTLRSASSWLAGNLGSALPGRLGLCLAVSALGIALLCAIGRDLDCLLLGEESARSLGIDTRRTRRLAAIGAALATGGAVALSGVIGFVGMMIPNALALLVGGCRRRLILLSAWAGALFLLAVDTLARNLAWPLDLPVGLMAAFAGPPFFIWIFRRQQGSRSDA

SEQ ID NO: 8476 - protein, 254 aa, Chromobacterium substugae
MPDTYTLKVRELDYRIGGRALLSDIRLDLPAGQVSALLGPNGAGKTTLLRLLAGLAAPSRGAVRLAGQCVCRMDALQRARRIAWVPQQLPADIPLTVAEFVALGRMPHLGAFARPGADDRAAVAAALATVEMEPYAGKRLEQLSGGERQRAAIARALAQQAPVILLDEPTNHLDLRHQHQLQQLLRQLAGQGRTVVQVLHDLTLAADYADRVALLEGGRLVAAGAPSQALTPERLLAVYRWPVRLRHHAPPQAA

SEQ ID NO: 8477 - protein, 180 aa, Chromobacterium substugae
MPNISEARGLINSADVLFSAEEVSTAVDRMAVEITEKLGEEYPLVLSVMGGAVVFTGQLLPRLAFPLDFDYVHVSRYGDKTHGGELVWRQAPKEDVRDRVVLVLDDILDEGHTMAAIRDKVMEMGAKACFSAVFANKLISKEKPMQADFVGLDVPDRYVFGYGMDVRGAWRNLPAIYALK

SEQ ID NO: 8478 - protein, 290 aa, Chromobacterium substugae
MKKITKAVFPVAGLGTRFLPATKASPKEMLPIVDKPLIQYAVEEAIAAGMTELIFITGRNKRSIEDHFDKAYELETELEYKNKHKLLELVQEIIPPSVSCIYIRQTEALGLGHAVLCARPVVGEEPFAVILADDLIEGAPGAMEQMVRLFDETHSSVLGVETVAPQDTSSYGIVKVKTDAHGHQAVEHIVEKPRPEDAPSNLAVVGRYILTPRIFDKLVNTGAGAGGEIQLTDGIAALLKSEPVLALPFKGTRYDCGSKLGYLKATVNYGLKHHEVADEFAAFLDGLKRN

SEQ ID NO: 8479 - protein, 473 aa, Chromobacterium substugae
MMATADFEVGNQCAAHGDWAGAIAAFDRCLSLNPQDWQALANRGNARLQLEDTPGALDDYLAAAALNPTSCNIKSNLAVLLKELGELDISAALLQEVLAAEPGHLDAWVNLGIVRQHQQRYRDAIDCQLRALVLGGPSVARYSNLGNAYSCALLLDEAIAVQQKGLALAPDDATLQFNQSITLLTAGRYAEAWPLYEARWRCVLRPRLTARRWQGDALGARTLLLWTEQGLGDTLQMARFLPQLRRAHPQARLLFACPRSFHRLFAQFEGLTLLEADAAPEHDCQLPLMSLPGLLGVTLENLPTAPYLRLPDGAPPVLPAGKRRRVGVVWESGHWGVGVADLGRQHKSIPPAQFAEICQAPDIDFIALQPGAVPDELRGCVRASRIDDFADTAALLAQVDLVVCVDTAILHLAGAMGKPVWALLRAESAPFFLAEAPVAPWYPSVRLWRQAQPGNWQPLVRELSEALSKQWAF

SEQ ID NO: 8480 - protein, 803 aa, Chromobacterium substugae
MTANQLRAAELRELLNRYGREYYVLDAPTVPDAEYDRLFRELQALEEADPELALSDSPTRRVGGAPLAEFDSVVHAVPMLSLANAFSDMQLADPAERHAELIQFDERVRKGLDAAEVEYATEPKFDGLAISLLYENGVLTRAATRGDGVAGEQVTENVRTIRAIPLKLDGAAPPALLEVRGEVLMLKRDFERLNADQIERGDKTFANPRNAAAGSLRQLDSRITAQRRLSFFAYAIAQVAGADWPDTHAGEMAWLKQLGFPVVEESLRPVVKGVAGLSAYYEAVQARRAGLPFEIDGVVYKVNRRDQQDALGFVSRAPRWAIAHKFPAEEALTVVEAIEEQVGRTGAITPVARLQPVFVGGVTVTNATLHNEDEVRRKDVRVGDTVIVRRAGDVIPEVVSVVLERRPMQPAEGGDLFSAGEAPQYPAYRLPSACPVCGSHVAREEGEAIARCSGGLSCRAQRSQAIQHFAGRRMMDIDGLGERYIDKLVEYDYVKGVADLYRLKLEDLLEMKRRADEDEGVTPETVKAGKVASKWAENLIAAIDASRAPPLARLLFALGIRHVGESTAKTLADWLGGMALIRRCPAALFAALPDIGAVVAESLADFFAEDNNEKALDALLAEVRPADEHAPSPRLRERLDDAALLARLGIPRLTEVRSQQLAAQRSLAWLAASERRALLELDLPAEVVNALADWLDEPGRRESLSRLAGLREAILAELPQAAEAAALPLDGKTLVLTGTLPTLSRDQAKALIEAAGGKVSGSVSKKTHYVVAGEEAGSKLAKAQELGVAVVDEAGLQALLSGN

SEQ ID NO: 8481 - protein, 400 aa, Chromobacterium substugae
MSELQIGVLILGGGVIALVLGFNMFQEWRFRKRTHQAFARPHGDVLLDVPKNNVRDGVKADRMEPVLLDAELEPERAPEEDDEPLFEIPPAEAPVREPPPAPRREPALQEVEVPVMDEEDEAELAMDSADHQALVVAMLDPSLDFIAEVMFHEPHELAAMPRFNVGKRTQLIGRTERGLWKVAEALPGTRYKQINVSMQMVDRSGAVGEQELAAFCQQVSRFAEDHDAAVSFPQRQQKLVAARELDRFCADVDVLIGINIVPQASIEGARLRSFAEAAGLQLEPDGAFHYLADSGNTLYSLVAADQMPFTFHTLLDKSFPALTLLFDVPRVAGGVDVFDRAVHFAKHLAQEFDAQLVDDNRRVLTETGLARIRDQLLHIYGSMDDRGIAPGSVAALRLFA

SEQ ID NO: 8482 - protein, 155 aa, Chromobacterium substugae
MKKSDQASFLPVVRELSRTYQAFEQFASFNIRRLGLTPPQFDVVTTLGNSQGMNCKELSDHTLITKGTLTGVLDRLEDKGIVTRSMQPNDRRSVFVALTPHGQQLFSQAFPAHLDYMHNAFLHFGEQDLSGFCNELGRLRASFSQALEQQENEPA

SEQ ID NO: 8483 - protein, 103 aa, Chromobacterium substugae
MEAKDEGQSDGDHEALYRPAYLENPQPPYPERSLQLGEEGEVLLSVRVGVNGRALKVTLARSSGFRRLDQAAMDAVARWRFAPARRGGAAAESVLTIPVSFRQ

SEQ ID NO: 8484 - protein, 459 aa, Chromobacterium substugae
MTVSIKRWEPENVIFWLSRGRGIARRNLWLSTFSLHLNFNIWMMWSMVVVNLPAVGFLISDQQQFLLVSIPPLVGALMRLIYSWAWSWVGGGLWLGLSTLLLLLPAWGVGAVVQDIAAPFWQLLLVAGLCGVGGGASASHLSNTSFFFPKSEKGLAMGINAGLGNLGVSVAQLLIPLCILYPLFGLHAGEPQVWGRGGDVHYVWLQNAAYVWLPLVLLAALACLLYAHDLPKLRITPRDQLDAMRDAHTWYICLLYMGSYGTFLGFSAAFPLLARSMFPQVDASPYLFVGPMACALARPLGGWMGDRIGGGIATVASNLLMALGTVGVYLSLPSAGSGGSFWLFLGMFQLIFLAAGVGNGSSYQLAPKVFLLLAGREAQRRGESLLQAYARGGRRGASAMNVSSVMAAFGGFVIPKAFGSSLSWFGGFLPAFAMFFLFYLLCMALAWWHYSRLGAAMRC

SEQ ID NO: 8485 - protein, 1162 aa, Chromobacterium substugae
MRLTHIKLAGFKSFVDPTSIAVPGQLVAVIGPNGCGKSNVIDAVRWVLGESSAKQLRGESMQDVIFNGSSTRKPVSRASVELVFDNADGQLTGPWGQYAEVAIKRVLTRQGESSYYINNQQVRRRDITDLFLGTGVGARGYAVIEQGMISRIIEARPEELRAYLEEAAGVSKYKERRRETENRLTDTRANLERIADLQQELERQVERLSEQAEVASQYHDLKGALTHKQNLLALARREEAARNEAAARAELARIETEEAALESAATHLETEQETVRESHFAASDAVHEAQQQLFEANAQLARLEEAQRHREQSRQRLERDLAAARSERQQLADNRQQVEAELDDWLPRLEEAQLRQEEAQMALEDGADELPGAEAAFRVLDQRQSQMVAQQANLTRERDLSRQKIEHWQRGMQQLAGRDAALTRELSDLNLPEHAALEAAQQEVAKARAALDAVRARLVADEAKQADLAAEREKLDQQLAAKRTELARAEAEAAALAALLQREAAGEQLAGWLEQHGLADAPQLWQSLQIDARWQQALEAALGERLSARAAALPAGQPPAALVLVDGKRAAAAGLPARSWPALLAEVKAQAPFDAALGDWLAGVYLADTLDAALARRGELAAGECWLTPEGHRVDAASVRYHAEASGDGLMARKRQLDEASARAEAWRPEIEAMQKKRDSLLSMGNMLAEAVRGQKGSLTRLEAELNAATLEHVKLDQAARQGAARLSAIEAERQRIAEERAHADDGIAEAELMGEEAALTLEELALQLEEVRLDRLNAETGLQLARNKARDAERVLHEIKLALHSAEQKVAELSRRGRELADRDEQLQERLETLAAESETVDEAVPEEALQQALAERESREGGLAAARDRLNQLTERLRELGQRQQEANAALPALRQARSDWLLKHQEARLAMERFAEELAQAEADEAALLADLNEGVKPNALAAEIARLARALEGLGAVNLAALQELEEAKKRGEYLASQSDDLNQAMATLEEAIAKIDGETREMLQATYEAVNAKMREFFPTLFGGGRAELVLTGEDLLDAGVQIIAQPPGKKNSTIHLLSGGEKALTAMSLVFSLFSLNPAPFCLLDEVDAPLDDANTSRFCDLVKQMSERTQFLYISHNRLTMEMAEQLVGVTMQEQGVSRIVAVDIVEALKMRETA

SEQ ID NO: 8486 - protein, 186 aa, Chromobacterium substugae
MEPLSLCNHFLIAMPGMGDPLFAKSLVYLCEHGEHGAMGLIVNKPSGIAMAQLFDQIDLPLDDEDTRTGVVYFGGPVQPDRGFVLHQPSGNWQSSLMVTDDIALTTSKDVLAAVSEGRKPERLLISLGYAGWSEGQLEQEIADNGWLTVPADPAIIFELPCEARYDAAMALLGIDPTLLSSEVGHA

SEQ ID NO: 8487 - protein, 143 aa, Chromobacterium substugae
MPEGCVLAFDFGERRIGVAVGDAMLGIPHPLATIDTAVTDERFAAIGKLIGEWQPAQLVVGLPMHPDGVEHEMSALARRFANRLKGRFGLPVWLVDERYTSVIAEQLLEEAGVKKGRKQKPALDQVAAQAILAGWFEQPGTAV

SEQ ID NO: 8488 - protein, 152 aa, Chromobacterium substugae
MPARLFALLLLAASVAGFCWLWRQAQLANAARDWPIAAGVVERSAVEWRQRRGGDNSDQREYRADVVYRYQAGGQHYRAGNIRIPDAGFGGSQTLAQDTVSRYPAGAAVQVRYNPAKPQQACLETGAHWSLSAGQLLMLLFAAAGVALLLRR

SEQ ID NO: 8489 - protein, 146 aa, Chromobacterium substugae
MSISQTTQISLASAALLNGGTVPSPVVQNGNATQALAAQAAQLSQESSVVTLLGGGDSSGATYDPAGMLNGFATAGVLQGSALSPSSGESAQDSTDQQVLDQTLGVSGAASSGLNGNWATVLQSNPALAGQAVADSTNGNIVDTLA

SEQ ID NO: 8490 - protein, 311 aa, Chromobacterium substugae
MAIQWFPGHMNKARKDITERLKEIDVVIELLDARLPASSANPMLARMAKGKPRLMILNKQDLADPAITQQWLAWYNAKPHTQALGMDAGERAPAQKLVAACRELAPNRGGLEKPLRVLICGIPNVGKSTLINSMSSRKIAKTGNMPGVTKNEQRIILADDFELFDTPGMLWPKIEVEEGGYNLAASGAVGRNAMDEEEVTLELLKYLLVHYAPELSARYKLDDVEGRQDWQVLEMIGRKRGAVLSGGRINMQKAAEIVLTDFRDGQVGRITLERPDEWLAWEKRAKAIAAERAILREEKLKEKESRKQGSR

SEQ ID NO: 8491 - protein, 70 aa, Chromobacterium substugae
MQAEDLLSLTTRVMPFGKHKGTLICELPGNYLNWFAREGFPPGEIGRLLQLMQELDHNGLTYLLDPIRKR

SEQ ID NO: 8492 - protein, 114 aa, Chromobacterium substugae
MELELHDEGERKLNNLTLAVYILQAVSLLVGVTALVGVIINYVKRDDVRGTLYESHFEWQIRTFWLALLGYVVGFATLWLLVGGVVLFAVWVWYIYRVVKGFLYFNDRKPMPQP

SEQ ID NO: 8493 - protein, 193 aa, Chromobacterium substugae
MNEVRDAFSLARSQAATMAESTLYPVALVTDGEWLAYRSGPPAGQLSSWLAACDGGAPLLESMLPEIRLLALRLALRRGLPAQGLPPRLAEPADWLAARILLLEWRQVALGLDELAALDDANRRAAELAAAAGLAWRPALPVLLSGGRGEGGLQGWSPRPAQPGAGRGVAAALDASRRARAGLAGRFEKLLNC

SEQ ID NO: 8494 - protein, 544 aa, Chromobacterium substugae
MQREYMEYDVVIVGGGPSGLSAAIRLKQLAAEQGREVSVCLLEKGSEIGAHILSGAVIETGALSELLPNWKELDAPLNTPALSDRFLYLTETESIQLPTPPQMHNAGNYIVSLGNFCRWLGQQAENLGVEIYPGFAAAEVLYHADGSVKGVATGAVGTGKNGDQEGEPGMELWAKQTLFAEGCRGSLTKTLFERFKLRDGADPQTFGIGIKELWEVKPEHHQPGHITHTVGWPLDTATYGGSFLYHLEDNLVAVGFVVGLDYQNPYLSPFEEFQRFKTHPAIKKTFEGGRRVSYGARALTEGGLQSLPKLTFPGGALIGDTAGFLNVPKIKGTHTAMKSAMLAAEAVFELLGDEARAQGGEAKAYSAKFQQSWAHAELYKVRNIRPSFRWGLWPAMIYSALDTFLFRGRAPWTLRHKHADNESLRQAYEFSPIAYPKPDGKLTFDRLSSVFISNANHSEDQPAHLKLKDASVPVAVNLALYDAPEQRYCPAGVYEIVGQDEGKPRLQINAQNCVHCKTCDIKDPTQNINWVTPEGGGGPNYPNM

SEQ ID NO: 8495 - protein, 407 aa, Chromobacterium substugae
MDLGGQNKESAMAGALAGIKVVDLSRVLAGPWASQLLADLGADVVKIEKPGSGDDTRQWAPPSLPDGKAAYFLCANRGKRSLTVDISQPAGQEIVRKLAAEADVLLENYKVGGLAKYGLDYASLKAVNPRLVYCSITGFGQSGPYAGLAGYDYIVQGMSGLMSITGPADGEPHKVGVAVSDLFTGLYAANAVQAALIARERSGAGQHIDMALFDCSLAMLANVASNWLVGRKVPPRLGNAHANIVPYQVFAASDGHFILACGNDKQFAEVCRLIGQPQWARDARYATNPQRVANRAQLVPLLAMAFRHHSREHWLKELDKAGVPCGPINDVEEAFADPQAEARGMQLALEDNVGQEVPLVGCPIKLSGTPVEYNLAPPALGEHTEQILRTLGYGESDIVALRNSGTV

SEQ ID NO: 8496 - protein, 395 aa, Chromobacterium substugae
MAASSQRAPFVWEDPLLLLDQLSDEERLVQQSAHDYCQQRLLPRVLTANRAERFDREIINEMGELGFLGCTIEGYGCAGLSHVAYGLVAREVERVDSGYRSAMSVQSSLVMHPIWAYGSDAQKDKYLPKLASGEWLGCFGLTEPDSGSDPASMKTRARKVDGGYLLSGSKMWITNSPAADVFVVWAKDDDDEIRGFILEKGMQGLSAPAIHGKFSLRASITGEIVMDDVLVSDEQLLPGVKGLKGPFGCLNKARYGIAWGAMGAAEFCWQAARQYTLEREQFGRPLAANQLIQLKLANMQTEIALGLQAALRVGRLMDEGRAAPEMISLIKRNNCGKALDIARVARDMHGGNGISDEFHVIRHVMNLEAVNTYEGTHDVHALILGRAQTGIQAFA

SEQ ID NO: 8497 - protein, 255 aa, Chromobacterium substugae
MQQTEDRQFVTALARGLEMLAAFRPGEGALSNQELARRTGLPKSTVSRLSYTLTRLGYLQQEGDGGPYRLGLALLALGSAALAGYDLRAAAAPLMREFALANNVSVSLALLDGSDMVYLETCRSQARVSVQLATGSRVPLATTAIGRAYFAGLPAAERQALLPRLAERYGAEWPQLEQRLEQACADYSRHGYSASFGEYEADVMAVGTHLPALLPGQPAMALNASGPAFAFDAAAMRERIAPALLALRQRIAPTV

SEQ ID NO: 8498 - protein, 144 aa, Chromobacterium substugae
MQTVRQLLDGKPVRALVYVSPDSTVFQALQVMAENDIGAVLVMESGDIVGIFSERDYARRIVLQGRTSAGTKVRDIMTSRVVYVTPLQTLDDCMSLMTEKRIRHLPVMEDQTVLGMLSIGDLVRATIDEQAQVINHLVHYIQSA

SEQ ID NO: 8499 - protein, 289 aa, Chromobacterium substugae
MATDAAEKANILAEALPYIRQFAGKTIVIKYGGNAMTDEALKEGFAKDVVLLKLVGMNPVVVHGGGPQINDLLARVGKQGEFIQGMRVTDKETMEVVEMVLGGLVNKEIVSLINKHGGKAVGLTGKDGHFIRARKLFLKADGDEAVDIGQVGEIEAIDPSLVSLLDSRDFIPVVAPIGVGADGEAYNINADLVAGKLAETLQAEKLVLMTNTPGVLDKQGKLLTGLTAQRIDELFADGTISGGMLPKISSALDAAKNGVGAVHIIDGRVKHALLLEILTAAGVGTMIRA

SEQ ID NO: 8500 - protein, 221 aa, Chromobacterium substugae
MTDTGNSRWQRKKDARPSEILDAALTLFVEKGYLATKMEDIARAAGVTKGTPYLYFQNKEDIFKAVVRETIVARVHAMSAQLAQVHGVGSSELLFLALDDWWTHIGSTRAAGLCKLMAAEATNFPELTRFYYDEAILPARQLLGHIIQRGMDSGEFRPVHLDYAIDALTAPMMMTMILSHSFALVPGCCDSIKDNPLEFLKTSLRLTLQGMHQPAPQDARP

SEQ ID NO: 8501 - protein, 324 aa, Chromobacterium substugae
MRYAVAGGHAETGGDSYAGEIRARHETQLAFRVAGKVVAKLVNSGERVKKGQPLARLDPSDYQLDLAGKQAQLAAAESDLAQQQLNLKRYRELLAKQFISQAQVDGQQNGVNAAQAKVNQARAALSASRNQTAYSTLTADADGVVSQMQAEPGLVVAAGQPVAKLSQDGAREVAIQVPENALERLRAAGVFQVSLWKGGAPLQGKLRELAADADPATRTYPARIALSGDSRALQLGMTANVRAPGQAAAGALRLPLTAVLDLQGKHYVWTIDAQSLRVSRKPVSVGAADNDSIAVTDGVRAGDKVVTAGVHLLREGQRVKLLDR

SEQ ID NO: 8502 - protein, 1024 aa, Chromobacterium substugae
MKKLNLSEWALHHQALVRYLMVMLMLAGAWAYTQLGQKEDPEFTFKAMLVQANWPGATTLQMEQQVTDKLEEKLQEMGEIDYVQSYTKPGESLLVVSLRENVPPKNVPQLWYQVRKKLGDIAYTLPAGAQGPFFNDEFGDTFGNIYAFSGDGFSYEELRRYVEASKQELLRVPDVAKVQVLGKQEQRIYVDLSSAKLASLGLDTRVVWQALQQQNGMTPAGTFETASDRIWVRPSGQYGSVEAVAATPVSVGGKSFRLGDIASVKRGYIDPPATSVRFNGQPALALAISMKSGGDVLKLGANLDQAIAGIQGKLPLGVEIHAVSDQPKVVHDAVGEFMRSLVEAVVIVLAVSFFSLGLRTGVVVALSIPLVLAMTFLAMYCFNIDLQRISLGSLIIALGLLVDDAIIAVEMMALKLEQGWNKFQAATYAYSSTAFPMLTGTLITAATFLPVGLAKSMAGEYVFSLFAVVGIALVLSWIVAVVFTPYLGYKLLSSHARHEEVDVYQKPFYLRFRALLGWCLDHRKTVIAATLAAFVVSLFAFKLFVAQQFFPSSNRPELMVDMWLPRGASYHATLEQVEKMEKLARADPGVASVTSYVGSGSPRFYLPLDQQQQHTNYAQLMVMTRDEHVREAVKARLEKIFDNDFPLVRGRVTRLENGPPVGYPVQFRVMGPDHDQVRKIADQVEALVRKHPSTLHVNQNWGEQVKALRIDIDQDKAATLGLSSQQLSQQLQMLISGSAVSDYREGNQSIAIVGRLNPGEQRDVAALGNLMVQTASGRFVPVSQIGHIRYEPEEGIIWRRNRLPTITVSADVVDGVQGADVSTQLSPGMAALEKMLPLGYHIEAGGTLESSGKSQQAIAAVAPLMIVVVLTLLMLQLQSFQRTLMVVLTAPLGMIGVTLTLILFRAPFGFVAMLGVIALSGMIMRNSVILVDQIEHDIREGIDRFEAIIGSTVRRFRPIMLTALAAILAMIPLTRSTFWGPMAVAIMGGLLVATVLTLLFLPALYAQWFRVSRDERQPTLPQQE

SEQ ID NO: 8503 - protein, 444 aa, Chromobacterium substugae
MKNTRLTLLGSLLMLGLAAPSQAFDLVGAWQAARDYNADFAAARAQREAGQEKRVQGRSQLLPQVSLNGSYAYNNPLQPNRIADAFGNVVGNTPYETHGYTLGLQQPLFDAGKYTGYKKGEIGTRLADTTFDAAEQQLILDIAQAYFDVLRAQDTLAATRASKKTYLNLLQQAKTAFEVGTATITDTNEAQAGYDGAVAQEINDANNLELAQHNLQRLTGLEPGAIQTVRDQLPLDPPKPAGLDAWQDLALRNSLRIRSAEQNLQLAEQTVTEKRGNHLPTVTLNAGYADNVSNQYGNYPHTRGSNVGVTVSVPLFAGGGINSQVREAVAQREAARDQLESTRRQVREDVRKAFLGVTNGAALVRAQQQLLLSAKSKVDSTRLGKEVGIRTSIDLLQAEQAYYTAVTSLANAKYSYLTAKLALAQSAGQLAPQVLNEVNQVIVR

SEQ ID NO: 8504 - protein, 421 aa, Chromobacterium substugae
MSQQQLMQRKADATPRGVGVMCGFFAERAKNAEVWDTEGRRYIDFAGGIGVLNTGHLHPKVEAAVAEQLSRFSHTCYQVVPYESYIRLAEKLNGLTPGQHAKKTALFTTGAEAVENAVKVARAFTGRPGIIAFGGAFHGRSLLGMALTGKVAPYKLNFGPFPSDIYHAPYPSALHGVSIAESLTGLERLFKYDIDPARVAAIIYEPVQGEGGFYPAPAEWVKALRALCDRHGILLIADEVQSGFARTGKLLASEHFDAVPDLITMAKSLAGGFTLSALTGRAEVMDAPAPGGLGGTYAGNPLAVAAALAVLDVIESEKLVERAQRLGDALKEKLSGLKTAVPQIAEVRGLGAMIAVEFNQPGSHTPDPDFAKKVQQHALANGLILLTCGVYANVVRFLFPLTIEDEIFAEALGKLEAALKA

SEQ ID NO: 8505 - protein, 486 aa, Chromobacterium substugae
MLTLQDAKLLRQQCYLDGQWLDADNRQAIAVQNPATGETIGQVPKMGAAEAERAVAAAARAFPAWKAKSAKERAAILRRWFDLIIAHQQDLAVILTSEQGKPLAEAKGEIAYGASYIEWYAEEAKRVYGDIVPGPAGDRRVLVTKEPIGVTAAITPWNFPSAMITRKAAPALAAGCTMVVRPASQTPLSALALAELAERAGIPPGVFSVITGGSSEIGAVLTGSDTVKKFSFTGSTEVGRKLIAQCAGTVKKVSMELGGNAPFIVFDDADLDAAVEGALISKYRNAGQTCVCANRLYVQDGVYDAFAEKFAAAVATLKVGNGLEAGVSQGPLIDQNAVAKVEEHIADALAKGGKLIAGGKRHALGHTFFEPTLIADVTSNMKVAREETFGPLAPLFRFQTEEEAIRLANDTEFGLASYFYARDVGRIFRVAEGLEYGMVAVNSGLLSNEAAPFGGVKQSGLGREGSKYGIEDYLEIKYVLLGGLDR

SEQ ID NO: 8506 - protein, 515 aa, Chromobacterium substugae
MSAAAQTTPLTGMRLVLASIALAMATFMNVLDITIANVSIPSIAGDIGVSASQGTWVITSFAVANAIAVPLTGWLTQRYGQVRLFVASVVLFVIASLLCGMASSLESLILFRIMQGAVAGPMIPLSQALLLQAYPKEKSGMALAMWAMTTMIAPVLGPILGGWISDNISWPWIFYINVPTGLFAAWLTWVLLRDYESPRVKKPIDRMGLGLLIIWVGCLQVMLDKGKELDWFGSGEIVALALAALVAFILFVIWEITEEHPIVDLTLFKSRNFAIGSLALSLGYGIFFANLVLLPLWLQQFAGYTATWAGIVSAPVGILALLLSPTIGKNIGRFDARVLASFAFLVFAIVCYLRSRFNMQADVATIMLPQFIQGAAMATFFVPLTALTLSGLPPQRLAAASGLANFARITAGAFGASAASTLWDSRASLHHVQLGESVSSFSAATRISLNQLSDMGYGLSQSYQLLERQISTQAYMLAANDIFWGSAVMFLGLIGVVWLAKPGAPQGKVDTSGAH

SEQ ID NO: 8507 - protein, 393 aa, Chromobacterium substugae
MTTQTATLPASNQPAANLQARRKSLVLMLAAGLAVSAVAYGSYWFASARYLESTDDAYVAGNVVQLTPQTAGTVVAIRADDTNFVKAGSVMVQLDQSDAKLAVDQAKSQLAQVVRQTQTLYTTQASRAADVAGKTAELARAKADLASRQELTGSGAVSAEEIRHAQGTVQTAEAALNSTQEQLASSRALSGAGGIQQHPAVVQAVAKLKEAELALARTAIVAPVSGYVARRSAQVGQRVSVGAPLMAVVPLDQLWVDANFKESQLRHMRIGQPVTLSADLFGKDVVYHGKVVGMGAGTGSAFSLLPAQNATGNWIKVVQRLPVRVALDPAEVKAHPLRVGLSMQAEVEVKDQSGAQLSSAAPARAVAETRVYQEQAAAADDMAKHIIAANLSR

SEQ ID NO: 8508 - protein, 481 aa, Chromobacterium substugae
MNKKLWLTTLCASLLLAGCASDHGLAPQARPLAAETLKLGAASAAAAVAEQAAWPEAAWWGRFQDAQLSDLIQRALSASPTMIQAQARLERAGAFLAGQSAAEGPQLDLNGVASRHRFSAHGAFPAPLAGSSYNSVELGLDFHYEFDFWGRNRERTLSELNRRDAARLEAQAVGLALASSVSQSYVELARLEQQKALAEQRVQLREREVALRESRLKAGLDSDVELKQSGASVSMARADVEALGNQAVLLRHRLAVLAGMDPAAGEALARPTLKMGGELRLPARLESDLLARRPEVAAQKLRLEAASHDIQAAKADFYPNIDLMAGVGGDALNASDLFKGGSQIFNLGPAIHLPLFDAGRLRAGLALRNADYDAEVALYNQLVLDALRDVADQVGNWRSLANRQGQHEAALRQLESADQAAQSRYRKGLSSYLAVIGAEDRLLAQKAADIDLQALRLQTAIRLNHALGGGLDLSLAESKQA

SEQ ID NO: 8509 - protein, 157 aa, Chromobacterium substugae
MEHAATSPLFTPYSAETYRIDTSLGQQIASLHHQLLRQIDQRMEPLELTAAQWKVLMRVLSGEVRSASDLCRQLECDTGSMTRMLDRLEEKGFIHRLRSKDDRRVVLVKPTSICRQLRPELVDAAVEVLNRALVNFHPDDFAALRRLLAQLSANLNP

SEQ ID NO: 8510 - protein, 172 aa, Chromobacterium substugae
MSIRIAAISRLLLLAGLAAWLSIAVFNNITDPGTNQVLLGHMLSMDLLSMDHQLGQGLVWHAWPAKWVPSLLHAVIGFQLCVAAGLWAAALAFARAVVSNELRRFRQARVVAIAALSCFLLLWLWFACGGLWFGYWIKQGAVQVVHMTLILITLSSLLYVQSGLPSEAGKTL

SEQ ID NO: 8511 - protein, 227 aa, Chromobacterium substugae
MDTARFAFFDVDETLIDMKSMFSFRRYYFLRRFGPVLGRLQEWRARRRLQDLLDCGCDRSEVNRAFFREFAGHAPEQLAAAAKAWFAEVSSRDGFYIRPALNALQRHIDHGVEPVFVSGSSVDILQPLAEALGVRHVLANRLEVRNGRYSGELLSPQTIGAGKQAAVLAFLARCGSDAAVCYGYGDHISDLPLLETVGHPSVVARDPELVRAANQRGWPVLKPSVSF

SEQ ID NO: 8512 - protein, 262 aa, Chromobacterium substugae
MTIQLIVADEFATFAQLEGVQTLGTLLAQLRSNQLEELRGSRLVAGQGLNQAQRDQVYALGSSLGLLEELSHWRLWSCEAPAGRALSHKHKAENILISTPRRVDAHHFEADLLLDAHGELLLDHLTGFHVQGMVLTEACRQMFIATTEAHCLDENAPSKRYFVINEMNMSFLEFAFPLPASIRYTVLTSEQPRPGRYNFSANMEVWQNGKPAASMAVKFAVFDDAYLAPRERQLAEKALNAVLEEARQALSLAPAEAKALAA

SEQ ID NO: 8513 - protein, 194 aa, Chromobacterium substugae
MQALLQHVLPASVGEWLTPPAGFDSLAKVQQVRVDGRSAWHLRYEREDGLNTGLGGEHFSLLIAEEGGLLGATHFAQDLISAALPDEREAYRHAVAYLDEHAPDLIDGLSLQWIKPHGEMFLVDDGHGGKSARTLTGMKVKCRNSKDGRYFWVIVGAQGQVLTFERDVVWDFLRAQRQTEKWLHDSWVVERLTA

SEQ ID NO: 8514 - protein, 51 aa, Chromobacterium substugae
MPCLASCASGLGGPAARFLLLKYPGQESPAAFDAATAGRRYPGVIPITALP

SEQ ID NO: 8515 - protein, 176 aa, Chromobacterium substugae
MFELKDLPSFETLSKFAKEYHNPDLEGVQTWLQVAKATSDMMLAFEANLARHGLSQTKFFVLLLLKRNPSGLGLGKLAEGVSVSSPTMTGIIDRMERSDLCRREQDANDRRAWIVRLLPEGETLLAQVLPDHYLWVARLMSDFNTADRLQLCELMARLTQALSHAESAREAAALSN

SEQ ID NO: 8516 - protein, 159 aa, Chromobacterium substugae
MSGNRHAQILPSVLDRLLDDAPDLSHIEAISLFELSQFKQALARDLEALLNTRLMPLDELFEPFPRARDSLLSYGIPDLSGISLLNPDDRETLREQLRRSIELHEPRLSRVRVNLDAPRELERHLRFRVDAVLKVHPHRPPVTFDATLQLSSNVYKVQG

SEQ ID NO: 8517 - protein, 233 aa, Chromobacterium substugae
MNQASIQTAERALSVAAPAAPSLREMLEDGIYLLFLLKEGNAPSSAVEFNRRVDHFLGQFERNARNFGKDGNAISHSKYAFCALMDEIILSSDFALRDEWERMPLQLRLFGEHLAGEGFFNRLEQLRDAPAENIEALEVFYTCLLLGFQGKYLLEGEEKLGYLLHKLGQEIQQIRGGKADFAPNWQLPQRFQAFVRHELPLWLYFALLAVAGAGIFIAFRWMLARQAASVFGL

SEQ ID NO: 8518 - protein, 436 aa, Chromobacterium substugae
MFLRPQHFQQQALFLEQAQSSLLRLTHRHAWGIQKLSLDEAALKGGIIRVDELTALFRDGSLCQAPASAPLPLSRDLASMPQIGIKTTLYACLAQLQPYGGNTRGGEASARPTRFHSDHSEVSDLYTQALAADLSTLQLDIKLMLEEENRDGYDSIPLCQLEKDATGQWTVGKEFLPPLLAIEGSGEMMQMLRRLLDILLVKSQALSGAHRERAKSVMEFGSADISSFWLLHTVNRNFARLRHLSQCQPLHPEELYMALAEFCGELQTFATLYTLSDIPAYRHDQLHLVFPPLDLQIRELLETVVSARYKVIPLHSPRPSFHIGRLESDRLLDNVDFYLSVQSDQPASYILDNVPLKLKIGAPDDVERILNSAMRGVSLAHSAQTPSAIPVRVGNHYFALEPGSEIYSRMLQSRSICIYVPQTLANISIELIAVFR

SEQ ID NO: 8519 - protein, 165 aa, Chromobacterium substugae
MIAALALPLLGGCAGPKNITLSSEATTALNRDKHGKPLSVVVQVYQLKSDQGFKLLTPDLLASGKPIADVLGASVISSKELIFVPGGKQELDMTILEDANYVGVIGYFRQPNPHFWRLLYDAGRVRSKDLKFKVDDCYLQAIKPEAIQLPDQPNTGAVDCSTARN

SEQ ID NO: 8520 - protein, 253 aa, Chromobacterium substugae
MVQAPIEIPQNPAFAAVEESRNDEASSRLSGTVSAARGWVNRRSLTLFLPLLSLMLVGAVVAITLHFGGYHQDPQFTPNEYAHGSQIRQALLEEKLVPPPPLPPSAFVDAVAEKPQLALDKADRDWSRMDPAFVQDVLRVMEKMKARGFPMVLLEGYRSAERQNRLAGGSAKVTQAKGGESKHQYGLAADLAPVRNGKVVISERDPWAMQAYTALGEEAKAQGLGWGGVWSFRDYGHIERTGSLRALLAHKNK

SEQ ID NO: 8521 - protein, 1265 aa, Chromobacterium substugae
MFNKGWLRNAKVASAIGFLILIALIWWLGPWLGLKSLEARLGWIVVVMIVWVLALLVGQVLARRAGGLLEGMLRRQADEAVINASADKRAEVTLLRQRMLGAIDTLKKSNIGNARGSAALYELPWYMIIGHPAAGKSSAILQSGLSFPFSDKSGIQGVGGTRNCDWFFSTEGVLLDTAGRYATESEDRGEWLAFLKLLKQYRAKAPVNGIMVAISLPELAQHNSEGFVLYARQVRERIHEVCNTFGLMVPIYLVFTKLDLLGGFAQFFNEAGEEERSRVWGATLSADQGTGFDASAVVSQQFEQLYRGLVQMGEEQLSQARGDAVKSAHFAFPIEFHGLQEAVVKFVRLLFEEDPYHSRPLLRGFYFTSALQEGVPRIVTAGRVQGQFDLSAGGLDKHQAPASYSYFLRGLFREVLFPDQHLIFQQTKPSGSRWRLAGMIAGVVSLAAVAGLWTWSFVGNQQLIAQVSAERAQAQKLAASGQLYDRLKGLLILQNRLEELQNYRRNGEPWQIGMGLYQGEELERNLRKAYFAGVKDVMLRPVQKNLETTLAALKPGVPQPVAVSEPPKPQPKPEAKPEPKPQPAKPIKQYKPRPKGHALPNINLSALELPQRATTAKLDASAPAIGGETAGKPQNPQQLDVGYNALKTYLMLHEQRRMEEAQLADQLPRYWRPWLESQRGEYPVNEVMGQAEKLVAFYVSQIKEPDLPLIDNDPKVVADARDVLRGSFKRLSAQERVFSEIKARANTRFAPLTVARILDNRDMDIMASSQMVEGAYTREAWNTYVRAAIDEASKGEIRSDDWVLASSSQDNLGKDGDAEKNRAALEALYRAQYIAAWHKFLQGVVVRDITNPAQSASAMTRLSDKQNSPIRLILARAAQETAWDNPSELNRSLETAKRSVLEKTTELFKGADSPADAKSDKQFGVVGAQFAGVAALVKGDNPPINGYLDQLAKLKVKMAAIATTDEPGPQARTALQSTLNGSGSELGDTLSYVDNTLLNGATPDTIEMVRPMLVRPLSQSYSALLGPVAQDINQAWANEVLPQWKQLAGKYPFSDSSSSASVADINRFVKANDGTLDKFVNKYLNGLVQKKGDSLVPRAWGNQGVRFNPEFLTGVSRLMALANSQLQDGENSRFELQPLPTPGLSETVLSIDGQELRYRNGPQPWQPFNWPGSGGGEGARIQVVNYAGASTVVGNQSGRMGLMRLLASAKVQDGGDGSAQLSWNLPKGSGAEAQTVRFNFRMLGGVNPLQLNRLYKLTLPERVTL

SEQ ID NO: 8522 - protein, 339 aa, Chromobacterium substugae
MAFNFKRTQEVPPQFCIFGKLPRRADFVRVNATHPAAMQLDQLLAQSLQRMEFNEDSTRRYLAMPATSFVLQSRDQNWLSLGVIQPSRDEGGRNYPLVAASLVAIDTALPPTAILLLANELFFTGLKDQLASAIDNSVEMLACKQFLEEQLRFGASSVADIDLAQQLLEKHLAVTPASELGRSLSQAGSGDLESVLLAFVFHHRLLRKFRDSLPVQAYFLPLPAVEGENVLAAVTWLALYHAATYDNGDAQEQCLILRRPEGHFLVLLPAGLNEQIASQCWGSQPDAKFVVDINDAKAPWRSHQAYAEAAYVLGRQLNDPGLSLAQLRTVLTSLSRNIA

SEQ ID NO: 8523 - protein, 154 aa, Chromobacterium substugae
MQITYDVEIGDAIETKELPFVLGVLGDYSGHSKEPLPKMKERKFVQIDRDNFDEVLKGMAPRLTMKVDNALKDDGSQLSVELNFDNLADFEPQNVVRQIDPLNQLLEARTRLADLRNKLAGNDKLEELLDEVVRDTEKLRQIGQQAGKQEGGEQ

SEQ ID NO: 8524 - protein, 492 aa, Chromobacterium substugae
MSAELQQQAAPAAAEGGSLLDSIIEQSRIATNDSEKNHTRDLIGELVDQVLKGSVTVSRDLSASIDARIAEIDQLITDQLNNVMHHGDFQKLEASWRGLKYLVMESETSTQLKIKVLNASKKDLVKDFKAAAEFDQSALFKKIYEEEYGTFGGAPYAALVGDYEFTRHPEDFYLMDELSHVAASAHAPLISAAAPGLFGLETFADIGKPRDLAKIFDTVEYAKWKSFRESEDSRYVGLVLPHVLGRLPYGKDNVPVEEFDFEENVDGSNHDKYLWTNAAYAYAARLTDAFAQYGWLAAIRGVEGGGLVEGLPAHTFKTDDGEVALKCPTEVAITDRTEKLLSDLGLISLVHCKNTDYAAFFGGQSVQKAKTYNTDSANANARLSTQLPYIFAVSRIAHYMKSIMRDKIGSFASRQNVQDYLNTWLAQYVLLDDSASQEAKAKYPLREARVDVVEVPGKPGVYRAAAFLRPHFQLDELTISLRLVAELPQPAG

SEQ ID NO: 8525 - protein, 165 aa, Chromobacterium substugae
MAFDAFLKIDGIPGESGDDKHKDWIEIQSFSHKLEQPAQASASTAGGATAERVNHGVYEITHFLDKASPKIYEACCTGKHIKDITIELCRAGGDKVKYMEIKMEQVLISKVEPQGSATDSGFPSEKVSFSYGKIKWTYTQQKRADGAGGGNVSAGWDLTANKVIA

SEQ ID NO: 8526 - protein, 145 aa, Chromobacterium substugae
MKRLLITVAVAVLCSACQTAPTKAQQAEMQAAAAANEAKAEIAKAAAANYAADSTLVPFEKMSGKLTPVGEAQLDLLLPSLKSAKSIIIRGHCYRNDIGNAKAAAQARAAAVRQYLLMADIPSSKITVRFDTERPLHAVRLLVSN

SEQ ID NO: 8527 - protein, 373 aa, Chromobacterium substugae
MRAKLSSEAGKTQLNQGYLAHPRSNGKAQPRGDGFELRTDQHGAIRAAHGLLLSTEAQNGASGKQLAREHAQSQLDAALSLSQALAETATGQLADSMETGPDEISADNAKTGKKSQGHLQHHADALKAWEAGSNTDKDGKTAQDQAGQQPLLVLSGPAGIAALTEQSQTISAGQNLNLVAQRDANHTTGRRWIHNVGQHLSLFVAGVKDKVALKLIAAKGKVQVQAQSDAMELTAEKDVTITSCKDKIIVHAGDEILLTAGGAYIRIKGGNIEVHAPGKVTVKGASHTLDGPASMDWSQPQYKKIVCTEQIDAQLLTEAHPEFIGKKYVYYSADTGKKIASGALDGSGMTDRIHLPGVNNIKALIGSGEWEIL

SEQ ID NO: 8528 - protein, 416 aa, Chromobacterium substugae
MNHRYAFIAIGVLALSAARADAANQAEDASVDLGWNTLQLHASQTLAGLTPGQYSVKNLFDPSPAKAWVFHGEQTFRYSEQISNPATLTLTLAKPSSLFAVALTPGYAKSAATQFQNASPKSVTISLYRPHEDKPFETRRFALSYHAREYSLPQLQRELKTVAFTNQTDDKITGKSDNALNSAERLLLINAGDAEIAKLELKISTIEPGAKFTDVAVSKLRLLDRQASQNSAELRLARFIARDLDNAAKQLAATPRCLVYTEQNAWPQLTNRACTGPAAQLQQGQADQGVDDIILTRKDAASRQYQVPFAVALRDAQTTGSGRNRQLRLSAADMAGSELILGKNANGQLQALSGLALTQAFLANRADGFGKAYLQPQDSPYFFFAYSRPQFTPDKDGYQLSIYGPAGRQEAQWATR

SEQ ID NO: 8529 - protein, 585 aa, Chromobacterium substugae
MGNQVEKYKDFNFGKYSEEQKYDILQRLFEHHAAANGKNNVDGFAFETANGRVNLIGARGFDHGKVVKDSNKVFDDTLFVVYKDASGEKKVAEFEFNTEPYSKQNGQLAGRVLINGLYQYKLGNHKISSYHDHASLAEMQSTHHFAQHHNYRALRIVKGLAFHAQNTGTAKAPEYEFSPDQPGTPSTTYEHNIHYGGEGPSNRTSNWSEGCQTVKGLDNYIRLLKILEQDYSLFGTIHNELIAKPAVDGKRAVVYALLDGHQVADETKIQVKFLDRILQPMKDVWYEIRHGDQTITGKTDHDGDTGALFGHNPKDKIDVKLQGPVGDAKKLPPVQAGESVFHKYLCVVSPKVLCDGLSRPDADHKEPEIDKTQSKTHKHHNKQRKPVSKVEVPKDRNPLEAPISDSEFEDCNALSQEQITTIIRSNNPVLIDQYQADVLVYKAAQNYKLNPKALLATMKQEQGWAKNNNKYNKLMGVGPGGQPTPMGVEASINTSAGTYRRLFDEGKKKLSSFKINYDPKSHEVAAVGSGGASVSEEEAAAMKAGYLYTPRTASEYAKLHYTPWTYFPPQRSRPYDTWVKTFRSF

SEQ ID NO: 8530 - protein, 183 aa, Chromobacterium substugae
MKINFLLSVAALLLAQHASAACDKDDWQQLLRHADAPTVSAYIKSQHCDVDQSLDDVSKTPLVYAIDAGNRGAVQVLLQAGANPNVDGYDGNTPLFYAVSAKNLNIVQDLIAKGADVNAATRTSEITVLMTAVLDSTPAVASYLIAHGASLSDTDKYGHKPIDYVAKLPAKKQAAMRAALKPH

SEQ ID NO: 8531 - protein, 302 aa, Chromobacterium substugae
MKLKRYLQVTKPGIIFGNLISAAGGFLLAAQGAIDWWLLAATVIGLSLVVASGCAINNCIDQDIDAKMARTQKRVLVTGAMSTKAALAHGVVLGLAGFALLWFGTNPLATGCVLFGFVIYVGVYSLYMKRNSVYGTLVGSLSGAVPPVAGYCAVTGRFDMGAAILLVMFSLWQMPHSYAIAIFRFKDYEAAGIPVLPVVKGISAAKQQIVLYILAFAAATVMLVYGGYAGYGYLAVAVATSLWWLKMALSGYKRETDDRAWARQVFFFSIITITSLSVMMAVDGQTPPHSRAVAAANAGHYG

SEQ ID NO: 8532 - protein, 106 aa, Chromobacterium substugae
MSQAHEHNSHGSVKSYAIGFLLSVILTAIPFWMVMGGAFTKQATFFGIFALAVVQIIVHLKYFLHLDFSKEGKLNSISFLFTGMVIVLLVGLSIWIIYTADALMMR

SEQ ID NO: 8533 - protein, 203 aa, Chromobacterium substugae
MTTYVEQAHDAHDDHEHHDSGKQTVLGFWFYLMTDCILFATAFAAYAVLFRNVAEGVSGKEIFELPYVLVETAALLLSSITYGFAMIAGHKGNKSAVLGWLAVTFLFGAAFIGLEINEFHHLIAEGHGPQKSAFLSAFFGLVGLHGLHVTAGLLWMGVMMLEVAKTGLTGRAMTRLNCLSLFWHFLDIVWICVFTVVYLKGAM

SEQ ID NO: 8534 - protein, 681 aa, Chromobacterium substugae
MWLGKLTLDAIPYHEPIIMGALGGAGLMGLMLFALITKFGKWGYLWKEWLTSVDHKKIGVMYIIVAMIMLLRGFADALMMRTQLAVATGGGHGIFPPEHYDQIFTAHGVIMIIFMAMPFMTGLMNIVVPLQIGARDVAFPFLNSLSFWLLVSAVILVNLSLGVGNFARTGWVAYPPLAELGFSPDVGVDYYIWALQLSGLGTTLTAINFLVTVIKMRAPGMKLMEMPIFTWTCTWANVLIATSFPILTGALAMLTLDRYLDFHFFTAEAGGNAMMYLNLFWAWGHPEVYILVLPAFGIFSEVVSTFSGKRLFGHKSMIYASGAISILGFMVWLHHFFTMGSGANVNAFFGIATMIISIPTGVKLFNWLFTIYKGRLRFETPILWTLGFMVTFSIGGMTGVLLAVPGADYVLHNSLFLIAHFHNTIIGGAVFGYLAGFAFWFPKVFGFKLEPKLGKAAFWFWQIGFMFAFMPLYVLGFMGMTRRLNYTTNPEYEPWLYVALFGALLIAAGIGCQLLQIVVSVIKRNELKDETGDPWNGHTLEWSTSSPAPYYNFAKLPQVHDIDAFTDMKEKGVAYAVPKSYEPIHMPRNTSAGVFIGLFSTVFGFAMIWHIWWLAIVGLVGIIGFMLARAYDNDLDYYVPVDEVEAIERARFEKLGIDVDNYTERDQQAKPKKAARPTTTV

SEQ ID NO: 8535 - protein, 298 aa, Chromobacterium substugae
MVLALLSGCQGGILDPKGHIAAEQKSLILTATALMLLVVIPVIVMTLVFAWKYRASNKDAAYEPKWSHSTKIEIVVWLIPCIIIAFLAALTWKSTHELDPYRPLQSEKKAIQVQVVALNWKWLFIYPEQQIASVNELVFPADTPVSFKITSDAAMNSFFIPQLGGQIYAMAGMQTQLHLIANEPGTYKGFSSNYSGAGFSGMKFNAVATKTPAEFDAWVAKVKASGQTLDAPAYLKLLKPSENNPVAHYASTTPYLFEAVVHKYMAARPSLADSDDAIKLAKMTKELCAAITPPVVKE

SEQ ID NO: 8536 - protein, 203 aa, Chromobacterium substugae
MKKWLLMVLLAVSGAANAAIELGKDYTLLSTPQPVANPKKVEVIEFFSYHCIHCYDDDPAFQAWAGKLPADVSFRKEQIVWQKSMEGFARMFATFNATGTFDKLHRPAFDAQIKQRIDLSNPEQFTKWVKLQKGVDSGKLLQTYNSFGINAQVARATKITRDYQIQGTPTVIVNGKYVVTTSTPERMIVVMNELIAKARSEKK

SEQ ID NO: 8537 - protein, 224 aa, Chromobacterium substugae
MMAGIIIGLIVGVAVAVGLAMYLNRSPAPFQAKGERKPEAASQAPTELLAPGTRISDAASATAPAAAQPQPKQATLDSDTVALPPPAAPAPAPHEAKPKAAPAGQQAKSDKNDQRFDFYKILPGQVDAVTSDAKGSRAAEPSASAPAKKVYLQLGAFQNQDDADNLKAKLALLGVEAKIQSVNVPDKGMVHRVRVGPLSRQDEVDRVRAQLKQDGINANVVKAE

SEQ ID NO: 8538 - protein, 482 aa, Chromobacterium substugae
MAVEVHLANGLPAFNIVGLPDTEVKESRDRVRAAILTSGFEFPARKITVNLAPADLPKDSGRFDLPIAIGILLASGQVQNPDISRYEFAGELALSGAVRPVRGALAMACQCHAARRAFVLPAASAAEAAVVAEAQIYGVRSLLEACAFLNGLQTLQPSVPADGGAWPNYPDLQDVKGQSAARGALEIAAAGGHSLLLMGPPGTGKSMLAARLPGLLPRLSEQEALESAALLSLGSQGFLASNWRLRPFRAPHHTASAVALVGGGSDPRPGEISLAHHGVLFLDELPEFDRRVLEVLREPMESGVIHISRAARQASFPARFQLVAAMNPCPCGYHGHPSGRCQCTPEQVGRYRGKISGPLLDRIDLHIEVPALTAAELQSASPGESSEQVRLRVHAARTCQLERQGGLNSALQGAELERHCEASADALAVLGKALQQLGLSARAYHRILRVSRTIADLQGEAKIGRSHVLQAIQLRRVMQGNA

SEQ ID NO: 8539 - protein, 95 aa, Chromobacterium substugae
MLSQKLFEEISAKISETIAASPAKDLEKNVKAMMASTFSRMDLVTREEFDVQQAVLARTREQLAALEARLARVEAAAFPEEAAARVEEQSELGHS

SEQ ID NO: 8540 - protein, 106 aa, Chromobacterium substugae
MIKPFKLDEVREALSAIGVQGVTVSEVKGFGRQKGHTELYRGAEYVVDFLPKVKLEIAIDDALLDQVVEAIEKSARTGKIGDGKIFVYDLEQVIRIRTGETGADAV

SEQ ID NO: 8541 - protein, 436 aa, Chromobacterium substugae
MKKILAAMCGGLAALSLPALADAPAGPAVAAAKVINSGDTAWMLTSTALVLFMTIPGLALFYGGMVRKKNVLATLMQSFAITALVTVLWAVIGYSLAFTVGTPYLGDLSRFMLDGMVYMKDAGKLAVHPLAGTIPESVFMTFQMTFAIITPALITGAFAERMKFSAMLVFMALWSLLVYVPVAHWVWAPGGWMGDKGVLDFAGGTVVHINAGVAGLVTALVLGKRVGFGKEAMPPHNLILTLVGASMLWVGWFGFNAGSAGAADGRAGMAMVTTQVATAMAALAWMFAEWVTKKKPSVLGIASGAVAGLVAITPAAGFVDVKGALIIGLAAGVVCFWGATGLKHALGYDDSLDAFGVHGVGGILGALLTGVFAVKDIGGADGSLATQALGVGVTIVYCGVVTFILLKLVNLAIGLRVAEDEEREGLDVVLHGERVE

SEQ ID NO: 8542 - protein, 200 aa, Chromobacterium substugae
MMTLYSGITCPFSQRCRIVLFEKGMDFEIIDVDIHNKPEDLAVMNPYNEVPVLVERDLILHESNIINEYIDERFPHPQLMPADPVMRARARLFLHRFENELFIYVKTLEAGATGKEATKAREAIRDGLTTIAPIFSKQKFMLGDDFSMIDVAIAPLMWRLEHYNIDLGKSAAPILKYAERIFQRQSFIDSLTPSEKAMRK

SEQ ID NO: 8543 - protein, 256 aa, Chromobacterium substugae
MNNTIRNLIAAAALALALPLAAPALANEGGPALAKADIDIQDTESLQRGAQIFVNYCLSCHSASMLRYNRLEDIGLTEEQIKANLLPEGAKIGDQMNIAMDKKDAKNWFGATPPDLSLIARSRGADYLYSYLRSFYRDPSRPTGWNNLVFDKVGMPHVFWEWQGEQVLKTEKDAEGNEVHKLQLVKAGTLTKLENGKANTVEYDKRMTDLTNFLVFMGEPAQVQRQQIGYVVLMFLGLLLFPLVYLLKKEYWRDVH

SEQ ID NO: 8544 - protein, 447 aa, Chromobacterium substugae
MNKAQKLLNWVDARFPLTALWESQWGKYVAPKNFNFWYFFGSLAMLVLVLQIVTGIFLTMNYKPDGTLNAAGIPVAFASVEYIMRDVAGGWIIRYMHSTGASMFFVVVYLHMFRGLIYGSYKQPRELVWVFGTLIFLCLMAEAFMGYLLPWGQMSFWGAQVIVNLFGSIPVIGPDLSVWIRGDYVVSDATLNRFFALHVIAVPLVLLALVVAHLMALHEVGSNNPDGVEIKQQPKDPNTGLYLDGIYSHPYYSIKDILGVVVFMIVFSAIVFFLPEMGGYFLEHPNFDQADPLKTPPHIAPVWYFTPFYAILRAVPSFAGTQVWGVLAMGAAVVLIAFLPWLDRSPIKSIRYRGPKFKIALALFIAAFIGLGILGAMPPTGLRTALSQIFSVVYFAFFLGMPFYTKNDVGSIPVPERVTDTNAKRQIQFVVLVLLTVFLAALFAMNV

SEQ ID NO: 8545 - protein, 171 aa, Chromobacterium substugae
MAVVGAATPFFLSFFPSERAKAAGAPVEVDIGKIEAGQKINVEWRGKPVWILNRTPEQLKNLPKNDPKLVDPQSEVDQQPKYCQNEHRSIKPEYLVAVGICTHLGCSPTFRPDLAPADLGPEWLGGFYCPCHGSKFDLAARVFKGVPAPKNLEIPPHKYLSDTRLLIGDDK

SEQ ID NO: 8546 - protein, 248 aa, Chromobacterium substugae
MLLSEMQSLLDGWLEPWRYKDYAPNGLQVEGRAEVAKVVTGVTASQALIDAAAARGADAILVHHGYFWKGEDARVCGMKKQRIRTLLQHDISLLAYHLPLDGHLSLGNNAQLGQVLGLEPVGQAGEQGLLWHGDWRGGGAAQAFASHVSAALGRDAQLLGRGDKPVRKVAWCTGGAQGFFADAIALGVDAFITGEASEQNYHMAIECDVAFIAAGHHATERFGIQALGQHLAQFSGINVEFIDVLNPV

SEQ ID NO: 8547 - protein, 547 aa, Chromobacterium substugae
MAAKDVKFGDSARSKMVAGVNILADAVKVTLGPKGRNVVLDRSFGAPTITKDGVSVAKEIELKDKFENMGAQMVKEVASKTSDVAGDGTTTATVLAQAIVQEGMKYVAAGMNPMDLKRGIDKAVVSLVGEIAKIAKPCSTSKEIAQVGSISANSDSDIGEIIANAMDKVGKEGVITVEDGKSLNNELDVVEGMQFDRGYLSPYFINNQDKQIAALDNPFVLLFDKKISNIRDLLPVLEQVAKSGRPLLIIAEDVEGEALATLVVNTIRGILKVVAVKAPGFGDRRKAMLQDIAVLTGGTVIAEELGLTLEKATLDMLGQAKRIEVGKENTIIIDGAGEAAAIQTRVGEIRRQIEEASSDYDREKLQERVAKLAGGVAVIKVGAATEVEMKEKKARVEDALHATRAAVEEGVVAGGGVALLRARATLDSLKTDNAEQEAGVKIVLRAIEAPLRQIVKNAGDEPSVVVNKVLEGKGNFGYNAATGEYGDMLEMGVLDPAKVTRSALQHAASVAGLMLTTDCMIAELPEDKPAAGGMPDMGGMGGMGGMM

SEQ ID NO: 8548 - protein, 95 aa, Chromobacterium substugae
MAIRPLHDRVVIKRLEAEEKTASGIVLPGAAAEKPDMGEVLAVGNGKILENGERRSLDLKVGDKVIFGKYSGQTVKVDGDEVLVMREEDVMGIVE

SEQ ID NO: 8549 - protein, 368 aa, Chromobacterium substugae
MLQILIISTFLSLFMAMFLIHFSHLHERFTSDHDLGGVQKFHAMPVPRVGGVPLAAGLLAGCGVLSWSLSDATALLLLLVSVPAFAAGLMEDMTKQVGPLPRLLATFVSAGLGYFSLQAGLHRLDIPVIDSLLVNFTLFSFVLTVIAVGGVAHAVNIIDGYNGLSGVVAVFIFLAMAYVAFKVQDTMLLGVCFAMIGAIAGFLFWNFPRGLIFAGDGGAYLVGFMIAEVAVLLVTRHPQVSPWFPLLCVIYPVFETLYSIYRKKILRGMSPGLPDGLHLHMLVYKRLVRWMVGSKDAGHLTLRNSLTSPYLWALSSASVAPAMLFWRHTYVLMGFCLLFAVAYVMVYRMIIRFRTPRWLVLRRSAPSR

SEQ ID NO: 8550 - protein, 43 aa, Chromobacterium substugae
MNGDFSDIIFCDFNSMGVDAFRMIFCKWHEIGFGLASSQMPMV

SEQ ID NO: 8551 - protein, 257 aa, Chromobacterium substugae
MKAVILAGGLGTRISEETTARPKPMVEIGGKPILWHIMKIYSHYGINDFIICCGYRGYVIKEYFANYFLHMSDVTIDMSSNHMEVHQRYAEPWRVTLVDTGEHTMTGGRLKRVRKYLQGEDAFCFTYGDGVADIHIGQLIDFHKTYGAAATLTAVYPPARFGVLDIKDNLVSNFQEKPQGDGGMINGGFFVLSPSVIDLIPDDGCVWEREPLETLAQRGQLAAFSHEGFWQPMDTLRDKLHLENLWKSGQAPWKVWE

SEQ ID NO: 8552 - protein, 361 aa, Chromobacterium substugae
MNRDFWKGKRVFLTGHTGFKGSWLTLWLQALGAEVSGYAREPATEPSLFSAAGLAQTMHSSFIGDIRDPDRLRAALDRARPDIVFHLAAQAIVRRSYADPVETYAANVMGTVHLLEAVRATPTVRAVVCVTSDKCYENREWPWGYRENEAMGGYDPYSSSKGCAELVAGAYRNSFFNPADHERHGVALATARAGNVIGGGDWAQDRLIPDFIRAMAAGEALAIRNPNAIRPWQHVLEPLAGYLLLAEKLHQSGPSFSSAWNFGPHEQDARPVEWIAAQLTQLWGQGSRYQVQREAGAAHEAHYLKLDCSKANQELGWRPRWSLREALQRICDWHLQHRAGADMRAVCLQQIRAYQETVIAE

SEQ ID NO: 8553 - protein, 438 aa, Chromobacterium substugae
MEKTQQLRQQIAQLVAEYAEIALAPKPFEPGKTVIPPSGKVIDGAELQHMVEASLDGWLTTGRFNTQFEKQLAEFLGVKHLLTTNSGSSANLLAFTALTSPQLGERAIRKGDEVIGVAAGFPTTVNPIIQFGAVPVLIDVDIPTYNIDAARIESAITDKTKAIMLAHTLGNPYNLRVVRDICNRHGLWLIEDCCDALGSTYDGQLVGTFGDIGTLSFYPAHHITMGEGGAVFTNSDQLKKIVESFRDWGRDCYCAPGCDNTCGKRFNWQLGSLPHGYDHKYTYSHLGYNLKITDMQAACALAQLGKLEQFIAARRSNFGYLSERLKTCEEFLILPKATERANPSWFGFPITIRPGSGIERVDVLKYLDEHKVGTRLLFAGNLTRQPYMHGQNFRVHGELVNTDLIMNNTFWIGVHPGLTRDMLDYAVEKIETIIGVNF

SEQ ID NO: 8554 - protein, 592 aa, Chromobacterium substugae
MEKTRLSVYTAAVSENFSFLKRAATIQEAYLRAIPIAGGGYLLPVCEMHKQDAALIRLLTEWRNRNVQAYPTQFIATEQSTRDWLEQQLLAVNDRMLFLVVSATGATLGHLGFTRCHNSDMMFEIDNMVRGAADAEAGLFSRALAALIEWARKTINVNGFFLRVLDDNPDAIAFYKKNHFTVESNIPLVAVKNGDSLQYREALPTETASKQFVRMAYKAPSQGVGEKMILTAGPSISAKEAAYSFDAALNGWNSDWSKYLTRFEKSFAEYVGVKYALATSSCTGALQIALMALDIGPGDEVIVPDQTWVATANAVRYTGAIPVFADIELDTWNIDARSVESLITSKTKAIVAVHMYGHPARMSAILAVAEKYGLKVVEDAAPAIGAEWQGKRCGSFGSFAAFSFQGAKLMVTGEGGMLVTDDDALYAKAYKVWDQGRNPSRTFWIDEDGVKFKMSNIQAALGLGQLERVDELIEMKRRIFEWYQEGLEGVPHLSLNREVEGARSIYWMSSILLDKDARISRDQLMQQLKSRNVDTRPVFPAISQYPIWPRQQQPQPNAMHVGLQAINLPSGVCLSRDEVAYACKQIRSILLG

SEQ ID NO: 8555 - protein, 270 aa, Chromobacterium substugae
MENSITLARAIRATALQMVHDARASHIGSALSIADILAVLYRNHLRFDPAATRDPLRDRFILSKGHACVALYAALGALGALSPEEIASYGQDFSPLMNHISHKVNGVEFSTGSLGHGLPFAAGKAMAAKLRGQPWKNYVLLGDGEMDEGSNWEALMFAAHHRLDNLVAIIDCNNLQSLDTVRATLNIEPLDQKLAAFGCRVFEADGHDHQALDQALLAIAEVRGQPSVLIARTVKGKGVSFMENSVDWHYRSPDKQQLRQALEELGVQHA

SEQ ID NO: 8556 - protein, 290 aa, Chromobacterium substugae
MRNAFIDELVKLAAVHPDIVLMVGDLGYGVVEPFAERFPDRFINAGIAEQNMMGMAAGMASEGCHVFTYSIANFPTFRCAEQIRNDVDYHNLAVTVVSVGGGLAYGNLGYSHHAVQDYGLMRMMPNMTIAAPGDPMEVRACLRYLASHPGPSYLRLGKAGEPCLHPQVPDVVPGQWLPIRQRDSAAALLTTGAAVSSAIEWLDTPDFAAHSLYTMPLWSMAAKQKQPQQLSDWDLVVTVEDHIHDAGFGSWLMEAAAPAGMSGKIRNRALSTEIFGKVGSQKTLNKLGGL

SEQ ID NO: 8557 - protein, 449 aa, Chromobacterium substugae
MILALKKTLGLDRAILYVLLNRGWTLLAGFVTLYLISATMSKAEQGYYYTFSSILALQIFFELGFSGIIAQFASHEMAKLHWRGGDIVGDSQSRQRLLSLFRLAIKWYGVISLLTVFLLNTAGFYFFSSSARQSGVDWHLPWMLLTLGATLNLFLSPLLALFEGSGLVANVSALRLMQSMVAYSSGWLLLLNDGKLYTAAAISIMTAAVGFYWLGKHYGAFLKSLLQNLPGKDDAGICWRREIWPMQWRIALSWLSGYFISQLFTPLAFRYQGTEAAGQLGMSLSIVTTMSTVASAWLTTKLPSFGMLIAGRQAAQLMALFRKSSLQSIAVLLAQHSLFFILLLAMRHYQFAFASRLLEPIDILWLLLAAQACHIVFLQAAYIRAHKIEPYLKHAILLALLISSSSYYLIQHYSIREMLALYAIICGTVGVGYSSYIYASFNKRKMAGQ

SEQ ID NO: 8558 - protein, 300 aa, Chromobacterium substugae
MLDDLLPAIARHHQLINIFIIDNASTDQTAALCDSYIQAGHALNYVRNESNIGADANAVRAFECVNGIYGWILGDDEYVYGQTVDTIIATLTKQPLALLYLKSEPCTASAIAQKKPRSQALSYYMSNVEFSRKIGIYFTFISAIIFNKQQAMQDDALCANIRYGTFIPQLAWVLPLLKQGKHFASSQACLIAAEPNNTTGYKLFEVFGINLRALVDAFLPDQPRLRKAILSSSMWFLASFFYGNRGNFKQENPKPAFDQAFGELRVYRLIVRPLLTYQNLMSKLCVKTICRFRKNILQQA

SEQ ID NO: 8559 - protein, 345 aa, Chromobacterium substugae
MKILVIKLSALGDILATSPLFRLIKEANPGCEIHHLVMRQCAAASESNPHIDRQIVIDLIPSGNRLKDARILLRLWWRLLTGGYDIAVILHRNALFQLLCKAAGIGKLVGFTAPRLDLLQHGQAFTMQGNRTLQEARLLQRAGLIDKMPDRLEFHLAPGKVDREKLAGLPRDYIAINPGGGNPHAPADNKIWPADNYIRLIQALDLPVVLLGSGGKDQEICASIARACGTRAVNLVNRLNLHEAAQAIRQSRLYIGNDSALLYIAAALNVPLIGLYGPTPADAFLPLGGPLHHLSGKTECSPCYSSLEGARSPMYSCVNNICMQGISTEQVLAKTRQLLTLGKQA

SEQ ID NO: 8560 - protein, 387 aa, Chromobacterium substugae
MKLQTLKFLDKLLSTTIAWLPRRRKPSTQAPRRILLIKLSAMGDAFCLHPVARRLAAAFPAASIDWLTTGRSNPGLFRNLPFLHDTLIVPTQVRALLAWLPRLLFAIRKYDIVMDFDQYYHLSELLSRCGKTSAGFSTALKGKTFSLSIPYDPQLNEKVLFHKLAERVMEHYGVTHAPPRDFYLPELLDAFTPSLPLQQLAAEIKTHQLPVVVLYAGSSANAAFRRLDIDKYLAIIEQTRNRHTFVIAGGPDELALKTHFQLQHPNVYELIGSLNLLEWAWLFRHVADLLLGNDGGLLHVAESQSTPMLAIFGPSLFRKWGSINPESRGIETDLPCRPCLKNYLGIVPTRCQFSTVKCLDAIEVATIIANMESMLEKKQRQHMLISP

SEQ ID NO: 8561 - protein, 157 aa, Chromobacterium substugae
MNKVYGVENIHLGSRVSIGDFCWLEAVERYGGQQFAPRLELRAGTSLSDAVHISAVARIVIGENCLLGSRIYIGDHSHGTGRLDTASLQTPPGQRPLANIAEIDIGANCWICDGAVILAGSRIHPGSIVAANAVVRLQTDEAALIAGNPAKVIHYFR

SEQ ID NO: 8562 - protein, 339 aa, Chromobacterium substugae
MPAYSRPDELGQLIDSVLSADVLPDELLICEDKSPRRAEIRAVIESMRPRFAAGACALTYIENEENLGYDGNIRKIITSSASDYVLILGDDDVLFKEAIPKIRAFVQQHPQANFISRTFSRFAEQPQNIINTTWIRTSDCVIKRDDADPNIIFRLCGFVGGLVINRRWASQLATEEYDGYLYYQFYLACLAYLGDGIGYISAAIVGGRAGNPPLFGSADSEKDTHIPGSYRPKGRAKMWQGLLAIAADIDKAHGSNIYPYIRNELAGRQAYHIFEMMPAQGRAATLDLFHELRRLKLTHKAMPWLLTSYILVFGPYARIGFALSRRLQFAIEQHAGLKL

SEQ ID NO: 8563 - protein, 361 aa, Chromobacterium substugae
MRKIALFYFYFVSLYWYPVTVMQWGSYGAVEESTPIWFKLLRVILVALLLLLLAARPSISKKIAFPLLFALYCIFSAPDIVTITNAITFIVCIAICLKIDIRAVNWRRHIGIASGIGYLTALLEILGIVVSPHSYDGTLRIVATFGGPNNAAIILSGFALYHFMQLRKTRSIADLLHFLACSVLVLLTGSLSALIAFLLCMISLSPRLLLLVPPAAIAANFISDFISFKVEQFANLFSNNSQTIGTFSDRLENIQLIWRSFNASLGNALFGTTLTSESDYLNIISQHGLFGLALFLLAILALGIDIFLALGLLQGIFTPFLFPFPSFAILFLLSKIYQTEKEAKPTLIAKKSEQNSSVQPI

SEQ ID NO: 8564 - protein, 375 aa, Chromobacterium substugae
MNKKIIYFVTVDWFFCSHFLARAVAAKAQGYEVYVLTNIDKHKDKILAAGLNIIDIKTDRKTLNPFSWLQTLLKVYQVYRTVKPDIVHHIALKPILLGSLAARMSSTRNVINAIVGGGYAFISNDISMRMLRPIIRFTLGKLLNPAGSKVVFENTDDLDTFTKSGQVRRDCAVLIRGAGVDPNLFHTNRTKPSKPIVLLTARLLWDKGIGEFVEAARLLRQRNINARFVIVGGQDPGNRASIDQETLSSWHQEGAVELWGFSEDIPNILAQSSIMCLPSYREGLPKSLIEAMAAKLPCVTTDVPGCREAVRHNDNGLLVPPKNIAALAKAIETLLLNHELSHKMGLRGYERLVTEFSSEIVIKDTICLYKELLEL

SEQ ID NO: 8565 - protein, 38 aa, Chromobacterium substugae
MSNVLLYKVKFINSIEAKIFKRFVQNWRFPYRLITVII

SEQ ID NO: 8566 - protein, 410 aa, Chromobacterium substugae
MKLLVKNFSAQGLNTLLGLVFTIAGARLMSLADYGELRYMMTLLPLLMACTLPGFDSIILRKANLREQVPLRNIFYIRLVTGCVGALSVSVALYFFSPALSASLKFLLLITALLLPFFETATGYKNYLIGIGLRNQSLNLVFFSRLTSMLLFLLLGLLIYSHYLSPLWIYPSYLLAIILPTIWTFSLIARKIRHAENFFPIKWHALILPAAVSTIASLTYTYAYSMDKLWIRNLSGAQALAIYSILVMVPQELAKLCDASFPLYYKRLFFDHNTEKRKIHRSRTLFFLLAAIIVLFLYASAFEVFSPWIFGEKYSYPFYLCLLSGMLIFGQAFEYFNSHKIFAHHGSRGQFIYTLLNLALCSIFIPIGIKLGGLSGLLLALLFKQLLLPIFYYSGVSITSKLHFDSRKFF

SEQ ID NO: 8567 - protein, 284 aa, Chromobacterium substugae
MSLLFRSISVFGRFPFVRLIQVIDNPRYLLHIIKKNLIYKRSKIDYTDKYSAFTFMSGQESLEDLIKNKKSLARFSDGEFEQIVGAGEYPPDSDWCQKWSKPLIDDMLKTLSSEDDRLLVAVDPPSTFLGTRDSTHSIRFEYNMWVDMRRLMWTFLCPGRSYGHSHLFIEANSPDFNWAQFKDHLREKHVIVATGNTDKISDLNLGLKTYFVECGTENAYERKSIIKDNISNLIKNNGLDKNNVLVLLSLGPTAGILAREFIDDDICAWDTGHMFKFAAKKFSA

SEQ ID NO: 8568 - protein, 293 aa, Chromobacterium substugae
MSWGKGYDYVLNLSALKHVRSEKDPFTLMRLIKVNILNTISTLKHAKNSGAKKYFCVSTDKAANPVNMMGASKRIMEKFLMRESLDLAISTARFANVAFSDGSLLHGFNQRFTKRQPISAPSDIQRYFVTPQESGELCLMSCLLGQNREIFFPKPSHDLQLTSFSDIASRYLEQLGYTPYPCSSEEEAREKASALIADKKWPCYFFSSDTTGEKSYEEFFTEREILDMARFQNIGIIKNDPAFDEQALNSFLDGIQKLNQNGRWEKIEIVSLFEAILPEFSHLETGKYLDGRM

SEQ ID NO: 8569 - protein, 221 aa, Chromobacterium substugae
MQRFFDIFFSAIALLILSPLLIPIMIALRLTGEGEIFYKQNRIGHGGKSFGLLKFATMLKNSPNIGSGNITLKNDPRVLPMGNFLRKTKINELPQLINILTGDMSVIGPRPLTKDNFDIYPVSVKSALYKIRPGLSGIGSIVFRAEENMLDNREDPRDYYCKFIAPYKGELERWYTEKKNGILYFTLIFLTVWVVLFPNSKIIWKTFPDLPLPPQELKEFI

SEQ ID NO: 8570 - protein, 472 aa, Chromobacterium substugae
MSDVFQFMKLSRNPGDKVEASVRKIEFKEIYQPLHAVDAADQAGRCLSCGNPYCEWECPVHNYIPNWLKLVEEGRLFEAAELSHQTNSLPEICGRVCPQDRLCEGACTLNQGGFGAVSIGSIEKYITDEAFKAGWRPDMSRVVWTDKTVAVIGAGPAGLACADVLARNGVKPVVYDRYEEIGGLLTFGIPEFKLEKDVVRRRREILEGMGVRFVLNTEVGKDISIDKLLKQHDAVFMGMGAYQYMKGGFQGEDSPGVLEALPYLINNVRQNLGTLPKGEAPLSMRGKRVMVLGGGDTAMDCNRTAIRQGAKRVICAYRRDEANMPGSKREVANAREEGVEFLWNRQPIAIEPMIGGTLAVKLAETRLGAPDAKGRRKAEVIPGSEEVVECDHVLIAFGFQASAAPWFSSQGIEVDGSGRTMVSSRVAKGFKYQTANPKIFAGGDMVRGADLVVRAVFEGREAAEGILASFEK

SEQ ID NO: 8571 - protein, 1482 aa, Chromobacterium substugae
MDRQSRLQGTLYKPEFEQDSCGFGLIAQLDDKPSHWLVATAISSLAKLTHRGAVAADGKSGDGCGLLFKKPDGFLREVALEAGIALKSVYAAGLVFHHPERALGERSLARLREQLEAQQLEVAGFRVVPTDVSACGEAALASLPAIVQVFVNCPFGMDELAFQRRLYMGRRLAEKANRQDDPHFYLPTLSPHTISYKGLVTPDHLAVFFPDLADPRFESSLAVFHQRFSTNTWPQWKLAQPFRFLAHNGEINTVQGNRNWARARERIMASPHLDMDAVRPIVQTDGSDSMSLDNMLEGLLMGGIPLFRALRLLVPPAWQNVDSTDKDLRAFYEFNSMHMEPWDGPAGIVLTDGRYAACMLDRNGLRPARWVLTKDNILTIASEVGVWDYRAQDVVKKGRVKPGQLFGADLANGELLLPEEIDAQLKSAKPYRQWIKDSAKYLELSIEDDAGVEPLSKDELARLQKMFNFSREERDQILRVLAEDGQEAVGSMGDDTPMAVLSQKARSPFDYLRQQFAQVTNPPIDPIREAVVMSLNTVFGPERNMFEESAEHAKRLEVRSPVLSHEKFTRVTTRPESYLKATNFDLCYDPGETTLREALCCLTRHVVEAVQEGTVVVVLSDRHATGQRLPIHALFATGAVHHALIDAGLRCKTNIVVETAAVRDAHQMACVLGYGATAVYPYLAYQSIIDLVNSGEVALKANEALQHYRKGINKGLLKVLSKMGISTIASYRGAQLFEAVGIHEDVVAQCLKGTVSRVSGANFEDFEADQKQLARLAFNPMRGIAQGGLLKYVHGEEYHAYNPDVVQLLQKAVQNDDYDAYLQYAETVNTRPVAMLRDLMSLKLAEQALEIDAVEPVEAIVKRFDSAGMSLGALSPEAHEALAIAMNRLGGRSNSGEGGEDAARYGTEKMSKIKQVASGRFGVTPHYLVNAEVLQIKVAQGAKPGEGGQLPGDKVSGLIARLRHAKEGVSLISPPPHHDIYSIEDLAQLIFDLKQVNPTALVSVKLVAEPGVGTVAAGVAKAYADLITISGYDGGTGASPLTSVKYAGSPWELGLSEAQQVLRANGLRGRVRVQTDGGLKTGLDVVKAAILGAESFGFGTGPMVALGCKYLRICHLNNCATGVATQEVKLRSKYFTGLPDMVVNYFLFIARETREWMAKLGVRSMEELIGRMDLLELLEGESDKQHKLDLRPLLSQGTVPDSEPRFCVADSNPSFDKGELAEQILQDALPAIRNRQMLELEYPIENTHRSIGARLSGEIARVHGAAGLPFGCLKVKFTGSAGQSFGVWNAAGLHLELEGDANDYVGKGMAGGRVTIYPPKDAGYKASESIIIGNTCLYGATGGQLFAAGIAGERFGVRNSGALAVIEGAGDHCCEYMTGGTVVVLGETGYNFGAGMTGGFAFVYDPGEKFAYRYNNELIDIHLINGEAMGMYRAFLLEKIAKHVELTGSETGRAMLQNFDDYVDYFWLVKPKAAKLESLLKD

SEQ ID NO: 8572 - protein, 540 aa, Chromobacterium substugae
MNFQKNDSQSGLKADTNWYFSQYFVFCQTKFENKMNHDDASASTLQFVRQLAEQALSRSAGAPLIGGNQVDLLYDSADNFPAWENAIAASQDSVFIEMYIFANDQFGGKIRNILIDKAKQGIQICLLYDWLGSWRAHLSSFFKPLHEAGAEVRAYHPPSLGGGLSLLGRNHRKMIIVDRRLLFVSGLCISDSWRGRPDKGLAPWRDTGLALRGPLLAPALAAFADSWASCGAALDNRWLQPLAVKAEGGAAAARLIATTPSTAKMMRLDLLVASFARRTLWLTDAYFMATSLYLSALKQAARDGVDVRLLVPRSSDIRWIAAVSRTQYRPLLEAGVRVFEWNGPMIHAKTAVADGRWARIGSTNLNLSSWLVNRELDIALEDEGLAGELAERFLRDLEQSTEIVLRQERRRPVPRPVGKPEKRPRGTPKEMALSGASAAARQAIRIGDALGAVVHGSRMVESSEAPAFLSIGLALCLLALAIGYFPWLAAAPLTLLLGIGGLGVVFRAIGLYLAKRRKKQQSAPRAGTDQTQSPPPPDCQ

SEQ ID NO: 8573 - protein, 38 aa, Chromobacterium substugae
MKTAAYPTRGSPRRAAAPLRQAANWSHPEVFCASGHAA

SEQ ID NO: 8574 - protein, 752 aa, Chromobacterium substugae
MRFHFPIVIIDEDFRSENTSGSGIRELAAAMEAEGMSVIGYTSYGDLTSFAQQQSRAAGFILSIDDEEFQTEDSAQESLGNLYGFVAEIRRRNPDIPVYLYGETRTARHIPNDILRELHGFIHMHEDTPEFVARHIIREAKSYLDNLAPPFFRALVDYAHDGSYSWHCPGHSGGVAFLKSPVGQMFHQFFGENMLRADVCNAVDELGQLLDHTGPIAASERNAARIFNADHLFFVTNGTSTSNKIVWHSCVAAGDIVLVDRNCHKSNLHAIIMTGAIPVFLMPTRNHYGIIGPIPKSEFQPDTIKKKILANPFAREMLEKHPNRKPRILTLTQSTYDGILYNVEEIKGLLDGEVDTLHFDEAWLPHACFHDFYRDFHAIGEGRPRCEDSLVFSTQSTHKLLAGISQASQILVQDPQNRQLDTAWFNEAYLMHTSTSPQYSIIASCDVAAAMMEQPGGQSLVEESLVEAMEFRRAMRKVDEEYGRDWWFSVWGPDNLSDDGICDQTDWTLRPNERWHGFAGIEDGFNMLDPIKATVLTPGLDVDGSFEEMGIPAAIVTKYLTEHGVVVEKTGLYSFFIMFTIGITKGRWNTLISLLQQFKDDFDKNQPMWRVMPEFIAKYPQYERVGLQDLCQRIHGLYAKHDVARLTTDIYLSDMEPAMRPADAFAKMAHREIERVPVDQLEGRVTAVLLTPYPPGIPLLIPGERFNKTIVDYLRFAQAFNRELPGFETDVHGLVAVEVQDRKVYCVDCVKQ

SEQ ID NO: 8575 - protein, 307 aa, Chromobacterium substugae
MKPADEDQDIAARLLSLQLDSPLLIALFDERDGLRYANPAFCAALDVAPDERICWVELMRRNYRNGRGTLIQTRDFEAWLASAKSRRAKLPFRAFETDLADGRWIWMTETTQPGGWMLCVGSDITDLRVGERELRQARDLAQRAALTDPLTGLGNRGHILQQLEGMLAQFGHGACQAAAIAILDLDHFKLINDVQGHLAGDAVLRDFAHRLQPLLKPHDSLGRLGGEEFLLLAPGSGLEQAEALLQAILIEVQASRPLAEAPAFTYTCSAGMTLLRGGDDLMAALARADEALYQAKAGGRNTWRVRL

SEQ ID NO: 8576 - protein, 216 aa, Chromobacterium substugae
MEEIERREPALTPQDKAKRALLAAATAGYAGFSCWQRDFYVPGKHGPGVHLHGWASYMLEAALLIAALLLLLPLATRRPLSTLAWGLFLYGLFGGLLLQGLSGNGAYGVKALLLVLALLPGALAVLLGRLPTIEAYRDTRKRVGQQSQSAQTPLPAALGWLAAALLGLLGLILTLAALLLLLGGTFVAAAVLLLIGAATLAWTYFIIQRLRAGARR

SEQ ID NO: 8577 - protein, 244 aa, Chromobacterium substugae
MPEMAMRFKPYAHGCSTPDDVGMMNAFVTDCGASPMPTLSTLLLFSLACLALAATPGPDMLLIASRSAGQGLRAGFATLFGIQLGTYCHALLAALGLAQLFMLVPMAYDAVRIAGAAYLLYLAWTTLKSKSVLRAAGSAEPGRPLARIALQGLTTNLLNPKMALFVLALFPQFVQPQAGPVALQIMLLATVLNAVGFAVNALVIVASSRMGRALSGQGAGRWPQYLLATVFGGLALRLLAAGQR

SEQ ID NO: 8578 - protein, 184 aa, Chromobacterium substugae
MDFPTLRTERLTLREITQRDAPALLAIHGDADAMRWYGTDPISSLEQARAMVETFAGWRSLPAPGVRWGLARREDDALIGSLGLFKWNRGWRSCTLGYELARACQGQGLMGEALRAALAWGFEHMELNRIEAQVHPDNQASLTLLERLDFKVEGRARQAGFWLGRHQDLITHSLLREDSALATA

SEQ ID NO: 8579 - protein, 263 aa, Chromobacterium substugae
MNAELEAEIQQKYTTETILDMRRWTDKLISFRLTRPAGFRFAAGQFARLGLPLANGGQVWRAYSMCSAVYDEHLEFYSIVVEAGQFSPLLAKLAPGGQVMLDKKALGFFQEDRLPAGRDLWLLATGTGIAPYLSILRQPDAWQRFERIILSHCVRDAAELSFQREIAELREHPLWREHGHKLHYLPVVTRDAPADMLDARYPQLLADGRLARRAGVEMSPEHSRFMLCGNPQMVEDTHRQLMKMGYRMTRQNAPGHIVLENGW

SEQ ID NO: 8580 - protein, 134 aa, Chromobacterium substugae
MDVAATSVLIFLRDDSQCWWQRRAWDDDSHPGRLDFAAGGGIEAGETPAAAAARELEEELGIADLPLRPLGRMKLDGEVCELFDAPLPARWRLGPEVAALLPLPLAALTALAADELHPQLADWLGRQEPAAHNC

SEQ ID NO: 8581 - protein, 311 aa, Chromobacterium substugae
MPIAIALHGGAGTLRRSEMDAAAEQAYRAGLARALEAGHAVLRAGGSALDAVCASVCALEDDPLFNAGRGSVYTLDGKQEMEAAVMDGSRQDAGSVTGLGCVQNPVLLARAVMERSPHVTLGFAAAEDFARREGLDMRPPEYFHTDKRWQALLLEKERLASGGKDEDIPEDRKHGTVGAVALDDQGRLAAATSTGGRTAKWPGRIGDTPVIGAGTWADGDCAVSATGHGEYFVRAAAGHEISARIRYLGETLEQACAAVVQDDLPRLGGTGGVVAVDKNGRVALPFNCEGMYRAAIDGQGRATLAIYRGEG

SEQ ID NO: 8582 - protein, 351 aa, Chromobacterium substugae
MSSAFWQKSQLKLPVIQAPMAGGATTPQLVAAVSGAGGLGFLAGAMLSPEQIGEETARIRALTDRPFGVNLFVQAPPAPAVAELEPALKLLAPWHAELGLAPPSVPASFCQPFDRQFDALLALRPAFASFTFDILDAARMQALKQAGIQVIGTATNLAEGLAWAQLGADAVCAQGREAGGHRGTFIGPQEQSLRPMLSLVYELAQNLPVPVLAAGGIMNGKDIAGAMRHGAQACLLGTAFLRCPESGISAPWKQALAAAQSGATRLTRAFSGRMARGLDNRYMEEMAKSQDQLPAYPVTNALTGPLRAAAVQAGRRDLMSLWAGEGVALARELPAAELVAQLLAEWQAAYR

SEQ ID NO: 8583 - protein, 381 aa, Chromobacterium substugae
MKFATRAIHVGYHSADHNRAVMPPLYQTSAFAYEHIGESMPYVYARSGNPTRSALESCLASLEDAKHGLAFSSGMAAIDAVLRACLKPGDEVVAVADLYGGAYRLLTRLLAPAGVKVTFADLREPAELEAAITAQTRLLWLESPTNPLLGMVDIAALSAIAHRHDVKVAVDNTFATPYLQQPLSLGADIVVHSATKYLAGHSDVLLGLVAVSDDKLYHDIRFVQNAAGAVPGPQDCFLTLRGIKTLALRMERHCDNAEKVAAWLCGQERIAQVFYPGLPGHPGHELAKTQMKRFGGIISIRLRDDSREAASRFASRLRLFVLAESLGGVESLINHSYTMSHGSMPADNKAALGIVEGGLRLSIGIEDIDDLLADLEQALRD

SEQ ID NO: 8584 - protein, 42 aa, Chromobacterium substugae
MDGAGREFHKNSSKSSTWANCPTIERKRPAKHAFAMTISSQS

SEQ ID NO: 8585 - protein, 584 aa, Chromobacterium substugae
MKTKRVFDILYHQLATHPRQDCLAAKSGKAWRQLSTTEVRDTVNRVSLGLLELGIGPGDKVAIAADNSIEWVLADLALQQVGAVSVPLYPTITLDDARYILSHAEVKLAFAGSAALQRKLHEALGKLACPIYGLADIDGVPSWREIRDLGRIERMAELEALRDGIRADDVYTIIYTSGTTGRSKGVMLSHRNVVSTVTATAEFTGLPHGSCRALSFLPLSHIFERAGVYYYLYSGTGIYFSSVECLSSAMADVKPHTFSAVPRVLEKVHEKLVAKARDLSGAKRRIYLWAVARAENFNPNRKLSPLEAIKHALADKLVYSKWRAAMGGQLISINVGSAALQPRLARMFWAAGVAVAEGYGMTESSPVISANPFNARGVRIGSVGLPLPGVEVRLADDGEILVRGDNVMVGYYKEAQLSAEALQDGWLHTGDIGVLENGYLRITDRKKEMFKTSNGKYIAPQALENKLKESAFIDQIMVVGDGQKYAAALIVPLYEKLKEWCSEHGIAYTTDSEMRSHPKIVDLIDREVKRFNRYFGSWEHIKKFALVDKPWCVDAGELAPTLKLRRKVIAERCRALIDNLYVHA

SEQ ID NO: 8586 - protein, 220 aa, Chromobacterium substugae
MSDWMTLFESALPVLLKGAGYTLAFALVAMVLGLALGFAVAMVRVAKLPLLSQLAAFYVSAMRGTPLLVQIFVIYYGLPGVGLELEPVPAGVLALTLNVAAYLSESLRGGIAGVAKGQWDAAFSLGLSWWQTMRHIIAPQALRLSVPSLSNSLISLIKDTSLVSVITVTELMLATKEVIAQTFQPLPLYLAAAAIYWLLSAAFERIQRRVEDRLELAHRR

SEQ ID NO: 8587 - protein, 266 aa, Chromobacterium substugae
MGYIDMRKLMTVLLLAGLSCQALAADLLDAVKQRGTLKIALEGTYPPFNFKDAKQQLTGFDVEIASEIARRMKVKPEFTTAEWSGLLAGLQSGKFDIVVNQVGVTEQRKAVFDFSQPYTYSSAQLIVRKNESRAFKGLADLKGKKLGVGQGSNYADMAKAAAGVEVKTYPGAPEYLQDLATGRLDAALNDSLLIPFAIKQAKLPLKAGAPVGEVATMAIPFAKGNPQFKAAIDQALSGMKADGTFKKISVKWFGIDVSKAPAAAKK

SEQ ID NO: 8588 - protein, 310 aa, Chromobacterium substugae
MLKIGQFGSRNWRVLLAGFCLSALSGLAASLAMPNLYTARTLLTIAAPIGAQGGASVLQSDGVLQRMVDKFALVDHYQSASPREAKLELVNSRLKLSPTKEGLLEVSVTDASPELAAQLANGLAEISRQQILDAHITEQGRKQYVLQEKLAAARAQLKQAEAEVAARVPGGEASLDMATVGIISGFAGLEGQLEGGQSSNLGSAILQMRKELEGSNRVIRQLPSGQMLALRNLYFNRALIRELQQQLQVARVVASQDVQVVLPAAPPLEKSAPKRIIIVLLSGMAGLLLVALAVIALQHRGRSFSRRAGA

SEQ ID NO: 8589 - protein, 363 aa, Chromobacterium substugae
MSLKCGIVGLPNVGKSTLFNALTKAGIEAANYPFCTIEPNVGIVEVPDQRLAELAKIINPQKIQPAIVEFVDIAGLVAGASKGEGLGNQFLANIRETDAIVNVVRCFEDDNIVHVAGKVDPIADIETILTELALADLSAVEKAMQREGKKAKSGDKDARALIEVLEKLAPHLDQGKPARSLDLSDEEKTLIKPLCLLTIKPAMYVANVAEDGFSGNPLLERVQALADSEGAPVVALCAAIESEIAELDDADKAEFLETLGLEEPGLDRLIRAGYKLLGLQTYFTAGVKEVRAWTIHVGDTAPQAAGVIHTDFERGFIRAQTIAYADFIALGGEAKAKEAGKMRAEGKDYVVQDGDVMNFLFNV

SEQ ID NO: 8590 - protein, 193 aa, Chromobacterium substugae
MSGIRLIVGLGNPGPEYEKTRHNAGFWLVDELCWQFKGNWRSEGKFHGDVARVDINGQDVWLLKPMTYMNLSGQAVLALAQFYKILPDQILVVHDELDLQPGTARFKQGGGHGGHNGLKDIAARLSSPAFWRLRLGIGHPGDRNEVANFVLKKPRGEEQQALDEAILASLRELPRAIAGKMAEAMKALHTEAK

SEQ ID NO: 8591 - protein, 66 aa, Chromobacterium substugae
MVYGAGKEAVSLVLDHNTMYYALKNEAFHASVLDLVIDGQKEQVKVAAFQMHPYKQQVMHIDFTRV

SEQ ID NO: 8592 - protein, 327 aa, Chromobacterium substugae
MAAYDSLMVFTGTANPELAQNVVKHLDISLGRADVGKFSDGEVAVELLENVRGRDVFILQSTCAPTNDNLMEILTMADALKRASAGRITAAIPYFGYARQDRRPRSARVPISAKLVANMLTSAGIDRVLTVDLHADQIQGFFDIPVDNVYATPVLLKDIRAQRFDDLIVVSPDVGGVVRARAVAKALNTDLAIIDKRRPKANVAEVMNIIGDVSGRTCLIVDDMIDTANTLCKAASALKERGAQRVLAYATHPIFSGQAVDRIKNSDIDMVVVTDTIPLTAAAKACPNIRVASIAGLLAETLRRINNEESVSYLFNEELVATGACLP

SEQ ID NO: 8593 - protein, 284 aa, Chromobacterium substugae
MSFQFQSFPAPAKLNLLLHVVGKRADGYHLLETVFRFIDFGDTLEIAARGDGMIELLTPTDGVPAEQDLTVRAARLLQRESGCALGASIRLDKRIPMGGGLGGGSSDAATVLIALNRLWGLGWPRERLQALSLQLGADVPVFIFGRSALATGVGEVLAPIALQPAWYLVIHPQVHVPTAAIFRNFSQSMLTEVGVDGIMRILETTQQRRNDLQNVVSGMFPAVNEVLSELRKYGSPLMTGSGACVFMEFKSKDEADKVYRVLSEKYQGFVAQGLDVHPLFDSAE

SEQ ID NO: 8594 - protein, 180 aa, Chromobacterium substugae
MMARCLALLLALLLAGCANEALFRPPQSPAAAADQPFNVSGRLSANLDGKGHVANFDWRHEPPRDEVAINSPLGNTVAKVLREPGGVTLLADGKSWQADDVESLTQQVMGWPLPLSNLVWWIRGLPAPGVDSSVDADGNLQQQGWHIRFIRDADVEADHPKRVEMQREGLTVKVVVQSWR

SEQ ID NO: 8595 - protein, 574 aa, Chromobacterium substugae
MLLALLLPACASVKPPLPQPVAAAQDNADGDASAKADEAKLPKQELTPEILYGVLAGEVAARRGGAGSAGLTYLDLARQTRDPRMAQRAAEFCLLSGQLKEAAEALSLWIQLDPDSLPAREQLFITLMRGGKLAESKPLIEDLLQREPARAPAIFVQLARLSARQDGGSAESYKLVADLASRYPDLPEARFAVLAAAADNNDQKAVDREFDRLAQIAPKWDLPVAWQVDRLRRQDIPGAADFLRRELARRPDAGLELQAAYPRLLVGAKRFVEARVAFEALLKTHPDNPDLLYATGLLAYQMRDLKVADQRLQRALAQQYPDQDFVRYTLGQIAEDDHDAARAEGWYRQVGQGQQYLPAQSRLALLEAGEGQLDQALSRLGQLGGTEQERVSLALLQSQLARDAKQPRKAYELLTKALQSHPKSGELLYERSLVSDLLGNAGNAERDLRLVLKDKPNDTQALNALGYTLANRTTRYKEAYGYIEKALKAEPDNPVILDSMGWVQFKLGRLEAARKNLDKAYQAMPDPEVAAHLGEVLWRLGRQDEARALWNKELAAHPGHEVLTETVQRLGVKL

SEQ ID NO: 8596 - protein, 286 aa, Chromobacterium substugae
MSGFHLYTICEPRFPMPELPEVETTRRGVQSHLEGRALRGAIVRNGSLRWPVPPDLSARLAGETVRAVSRRAKYLLLECDSGTLLIHLGMSGSLRILAADTPAQKHDHIDLLLDGQLLRYRDPRRFGAVLWHIGPIETHPLLQALGPEPLSADFDGATLHQAIGKRGSPIKLALMDNHVVVGVGNIYANESLFYAGIAPTRPASSLSREECERLAAEIKAVLARAIEAGGSTLRDFVDSEGKPGYFQQSYMVYNRQEEPCRQCGTPIRQIRQGQRSTYYCPLCQPC

SEQ ID NO: 8597 - protein, 256 aa, Chromobacterium substugae
MRLLSHLAVGVLIVATRYSRLAQAERAVVTRRWAQQALKILGVSIKVQGVNPGFYPPNTLLVANHVSWLDIAALNSCTVSRFVAKREIRSWPLIGWLAYVAGTLFIDRSNRRDASRVNQILADAMSNGGCMAVFPESTTSDGSSLLPFKASLFEAALLSGGTVQPVSLRYQRPDGSLLLEAAYIGQISLFQSIGKVLSVPQIEVEICYGQALRAGDAGLDNRFLLAEQARREVARGLRISLEDAPQAAAPAETSRA

SEQ ID NO: 8598 - protein, 385 aa, Chromobacterium substugae
MTAKFIVGWLLAGALAGQAQAAPVQDFGEPNLSRLAARLSLQADAQQPVRIIQFGDSHTAADYLSGELRARLQARFGDAGIGWLPPLNVPGQRNALGLVRSEGWSLRNSRRDDDPDFPLGGYIGAAQRPGALVSVQARAADNSLWRVRVWLRQASDAASLTVDDGNGPRRIQAAAGAGWQRVEMKLKLPFTLRADSLPAPELGGFELEKLAPGVVLDSVGSNGAELALWRRWGGIWGRQMAARDADLVILAYGTNEAFDAKLDLDEYRATLQGAIGLVRAQLPQAAILLLGAPDSARRKGGAVSQECAGPKRPLMLAAVQQTQRQLARDNHLLYWDWEQAMGGPCSMRLWQQHQLGRPDLVHFTAPGYTRLADDLYLNLMQRLGR

SEQ ID NO: 8599 - protein, 328 aa, Chromobacterium substugae
MLAAYPHRRILVILLSSMLLLFWVEQAAINAYWRQTFHSPSLLEKLEELSPWREGGELGGGLRQQSVALQQQVGMWDRRMVERLNACCLAQTPAPVAAAAKKPPQASAPAAAAKALDPRLALQPGLPVLLAGDSMMQGVALHLLPPLFRQHQVKAIDVSKQSTGLTYPDFFNWPATIERQLTANPKVQLLVMFIGANDTWDMVGGSHYIRFASPEWEQRYRERIRSIYASANKRKIKVLWLGLPNMGRDKLNDGAHYLNRLYREEAAAAGQRFIATREVLGSRDDSFNKFMTLPDQGEVAVRTADGVHFTRQGQLLLARRVLAELRFE

SEQ ID NO: 8600 - protein, 466 aa, Chromobacterium substugae
MSYLSIEFALAFVGFFAAYWGCRRMPSLQNLLLLVASYLFYIKLDWRFAAILACYTLVQHALSRKMLASAHPRRWLQLALALAVFNLALFKYFDFFRESAQAGLHALGISAMLPALDILMPVGISFYTFQSVSYLVSVYRKEMAPARLPQFALFLVFFPTLLAGPICRARDLLEQLRSPALRQAANFDRALGLIVLALLKKLWLAGWLASAWVDPVFAAPDTFHTLEVWAAFYAYALQIYLDFSGYTDLVTALALLLGIQLPRNFDSPYLALNLRDFWRRWHISLSSWIRDYIYIPLGGNRGGFARGQANLLAAMLLSGLWHGASLKYLAWGAMHGLGVVGLNIGDKLWRRDGVSQRWPWLARLITFHYVCLAWVFFRAQSLDEAMDFLRAMAGTGQTLTLNAPGLLLLLALWLAALPRLAPLRERCIVQLAALPWWGKPLLLSACALLVISLAPSGIPAFIYYQF

SEQ ID NO: 8601 - protein, 277 aa, Chromobacterium substugae
MAIYAIGDIQGCFAPFQQLLRQIDFNPGKDTLWLTGDLVNRGPQSLDVLRWVYQHQDQVEMVLGNHDLHLLAVSEGFGKLHRDDTIGDILNAADGKVLLDWLRCQPMMLEGQGYAMVHAGLLPEWSISKSLRLAEEVEFGLSGARHREFLGRLYGNKPVRWSDDLKGADRLRLIVNVMTRMRFLTRDGELDLSYKGELDGAPANLIPWFEAPNRRHGGTPIVCGHWSALGVHLDDDVLAIDSGCLWGGSLSALRLDDRQLFSLPCPAYREILLPAGR

SEQ ID NO: 8602 - protein, 674 aa, Chromobacterium substugae
MSAPLLNPPQRAAIHYLDGPLLVLAGAGSGKTRVITYKIAHLVREGGIPARHIAAITFTNKAAREMLERVSKLMTPAEIRGITVSTFHSLGMHILRQEAPHLGYKTQFSILDAYDAGKIIADILNTTSKDEIRKVQSQISLWKNDLKTADDMMVSADGQWESVCARTYLAYQDTLTAYQAMDFDDLIRLPVQLFRTHPEVLLKWQGKLRYLLLDEYQDTNTCQYQMVKLLAGVRGLFTAVGDDDQSIYAWRGANMENLRLLQQDFPALKVIKLEQNYRSTARILRAANSVISNNPKLFEKQLWSELGLGEPIHVVQCKDEEHEAETVVQRLLAHKFEHRTDFKDYAILYRGNYQARIFEQSLRNQRIPYQMAGGQSFFDKPEIKDLLSYMRLITNPDDDPAFIRAITTPKRGVGAGTLEKLGAWSGQYGKSLFAAAHDAGLRVQIQAAQLAPLEQFCEFINQLQYRATREPAGQLSLELLQAIGYEAWLYDSEDSPKIAETKWKNMLDMVGWLAKKGEADGKNLIELTQTIALITMLEGRDEGEVDAVKMSTLHASKGLEYPHVFLVGCEEGILPHSESVDNGMVEEERRLMYVGITRAQRSLTLSYCVKRRRAGEWQFIEPSRFINEIDGEDLRHFGKPGAEPLVSKSEGKSKLASLTAMLASKDKSGEPPAQ

SEQ ID NO: 8603 - protein, 241 aa, Chromobacterium substugae
MAPGQIIKVLVSIVVFLVVAIWLLAKLATSGFNVDAEVMTKEAVAARLKPVGESRASDAPPGMRTGEQVYKGICISCHGAGLAGSPKFGDAGAWAPHIAKGWETLVDHALHGFNAMPAKGGATDLTDDEVKRAVAYMGNAGGAKFTEPAVGGAAGATAAADPAVVGKKIYDTVCTTCHAAGIAGAPKFGDKAAWAVRLKPGLDEAVKIATKGLNAMPPKGGYTGSDAEFRAAVEYMVNNSK

SEQ ID NO: 8604 - protein, 37 aa, Chromobacterium substugae
MDKPCVVTSQADASEKSSDIPPSALRRGPHRQKNSTR

SEQ ID NO: 8605 - protein, 620 aa, Chromobacterium substugae
MFSWFERRISPYPDTPPAQPPQGFFSFIWFCTQGLRGLILCMTLLTACIGAFEALLFSMLGSVVDWLSKVPPDQLLQRESGHLWLLAAILLGSVLLVALQAMSKYQGLFSNFPMRLRWNFHRHLLGQSLSFYQDEFAGRVSAKVMQTALAVRDTVLIITDILVFVVIYFVTMIAVLGHFDAHLLPPFLGWLAFYVATLWFFVPRLGKAASRQADARSLMTGRITDAYTNIATVKLFSHGQREARFAKGAMQEFLATAYRQMRLVSGFEIVNQLSSMLLIGVTAGSALWLWSQGQVGIGAVAASSAMALRLNGISHWIMWEMSSLFENIGTVQDGISTLSRKVAVVDKPDAVKLQVPRGEIRFDNVDFAYGGARNVISGLNLTIRPGEKIGLVGRSGAGKSTIVNLLLRFYDLDGGRILIDGQDIADVTQDSLRGKVGMVTQDTSLLHRSVRENLLYGRPDADDADMVAAARRAEADDFIQTLTDPKGRVGYDAHVGERGVKLSGGQRQRIAIARVMLKDAPILLLDEATSALDSEVEAAIQSSLYRLMEGKTVVAIAHRLSTIAAMDRLIVLDRGCVVEEGSHQQLLARGGLYARLWSHQSGGFLGEEDDDQDEQVSLMG

SEQ ID NO: 8606 - protein, 69 aa, Chromobacterium substugae
MYRLKLISPDFGIDDSGPLHPTQEQARRAAELMLQVYKGRVRAEVHKVDLKARTSEKLEEVYVKMVPMA

SEQ ID NO: 8607 - protein, 293 aa, Chromobacterium substugae
MQVDAVLGYLDKVSRFDAQQFTPLYIGTERMGCVNAQWKERLLRHEAALFEENYQGMLCRLDGSYRSISHALAQAARRWQQAGWLNGWRNENFTAFRHDGSAYFELERAAFRPLGLTSRAVHVNGLCRLDDGEIRMWVGRRSPHKAVDPNRMDNLVGGGVAAGETLELALEREGWEEAGIAREALLGLRPESLLLAERPVARGLHREWLHAYDLWLPQGQRPACQDGEVAEHLLLPLAEVEQLLVAERFMIDAALVSLDCLCRLGYWQQGNGQVAAALARIRHGQSRDLATPA

SEQ ID NO: 8608 - protein, 564 aa, Chromobacterium substugae
MNSAISLLPDQLSSLFLRLFPDADDAVLALVRELSAANQAGHVCLPLAHRAERKALQRSQLVGRPGDYAPLILDDAGRLYFARHWHDEDILARDLARLAEPLPPPDESALAALLARLFPGGDTGPDRQKLAAALAARQRLMVISGGPGTGKTTTVVRLLALLAALSPRPLVMAMAAPTGKAAARLSESVRGARDRLDVDEAVRRQLPAQAETLHRLLGLRPGAEAPRHHAGNPLPLDVLVVDEASMIDLALMARAVAALPSQARLILLGDRDQLSSVEAGAVLGELCGRIAYREETRQWLRRVCGDSLPDDGAEGGRLTDCVALLTHSHRFGADSGIGELARLVNGGDGRGSLDLLQAGGHPDIGLQPAVAAAALLDKRRGYLQAATAGAEPDAVQRAFSAFMLLAAERRQVADCNRELERQLELAGLKQPGRDWYAGRPVMIAENDYGLGLFNGDIGFALPRAQGLRVVFPAGDGGWREFAPGRLPAHDTVFAMTVHKSQGSEYDEVWLQLPSQPGALLNRALLYTAITRARQRFAAAGSGEVWLRGVELAPQRHSGLADRLR

SEQ ID NO: 8609 - protein, 237 aa, Chromobacterium substugae
MNRLCGLLLLLSCASAPAQTLRAGVANDTTEPLRQAEEGGLLQTYRQALALIAQQSGIRFQLDYYPTQRLEQLFQVGRLDMEAGVNPAWRALSPVAGFYTQPFGEVEFVLCLPLAKGRTPAAELKSGTVGTLPGQQYPLLEPAFQSQRLRRDVSGNEEELLDKLREGRVQAVVLERGRARYWSRQTEGRRCQPGESAGSLPVMLRLHPQYRELLPRLNRAIQTLNGQGKLKPLFAAK

SEQ ID NO: 8610 - protein, 494 aa, Chromobacterium substugae
MFESAEIGHRIDKETFRKMMPSLREALLDVQYDLKEKADFPVLILIHGFDGAGRGETMNLINEWLDPRLIHTVAFDAPNDEARARPWMWRYWRELPAKGRIGMFFGSYYSDTLFDRVFNRSDRDAFDRQIFDILRFERMLTLDGAVVLKFWFHLSRDKQKQRLKQLEQDQATSWRVTKSDWEHYERYDKIRKYGEHMLRLTNTSHAPWIVIDGEDANYRSLTVANTILEAMRNRIGQPMLSTDRVEAPPLLAPIDNKLVLDALELDRKLDKDAYRAKLEQLQGRLNKLTRDARFARHSLVLVFEGNDAAGKGGSIRRITQALDARRYRVVPVAAPTQEERDKPWLWRFWRNVPGKGGITIFDRSWYGRVLVERVEGFAPEADWLRAYYEINDFEHQLSENGAIVLKFWLAISKDEQLQRFKGREETGFKRFKITDEDWRNRDKWDLYRQAVSDMVDRTSTSKVPWTLVEANNKYFARIKILTTICDALEARLSE

SEQ ID NO: 8611 - protein, 1188 aa, Chromobacterium substugae
MTTMEATALDALNCPLGGVNLIEASAGTGKTWTIAALFARLLLEDSDGQPPPTIDRLLVVTYTKAATAELRERLRRRLGEMLAALEDKAGGDDFLRALAARFPAGAARELARQRLAAAIAGFDAAAIYTIHGFCQRVLTDAAFESGQTFQAELMEDDAGRLVEIVDDFWRRRIVSKPLLAQVLVEQRATPEQWLAEIRPYLSKPYLNLQAPDAAGLEAAQRLAQSRWQALAAEPELAEEGLRLFAEHAGYKGNVYSAAILERAAAALRGWLAQPDGLPELDSDSRKTLDKLRPEALAKGMKKDCAPPAHPLFERVDAWLAAWDGYMAQVANSLAGLKLELIAWADEELARRRGVERSRSFDDLLTDLGAALAHPDSGPLLAAQVARSFSAALIDEFQDTDPTQYAIFRRCFVEQARPVFLVGDPKQAIYSFRGADIFAYLAARGDAERHYTLDTNRRSDAPLVSTVNALFGRELPFLIEGIAYQPVAAQPSSGGRLEVEDDRAPFNAQWLAAGDKALSKEAAEEAAAVACANEIARLLSLAVADRASIVKGDARRRLKGGDIAVLVATHKQGDRIRLALRERGVASVALTQESVFASVEAGEMLALLHAWAEPASESRLRLALATELGGLDAAELKARLEDEASWEAELLRNAGDHQRWREHGFMAAWRHYFAREQLAARLLPLPDGERRLTNLGHLAELIQQESESRQGMAPLLAWFAARVADPPRGEEAVLRLESDAALVKIVTVHTSKGLQYPVVFCPFLWHGALERRGASFWSYHRGDAPWLAPDVVANEGVRLAARSEMLAEKLRLLYVALTRAQYRQYLGWGWVKDMQTAALSWLLHAPGAADLAALEQLKLDGPEVEGQLRAFAAGRGGAMAVLADEGWHALAAAEAAERRYAARPFARKLYTPWKIASFTSLTHAAGGHLAEAPDHDREPRPEPASPTEAPARDRFSFPRGAKAGICLHEIFERISFGADPAAIREAVATALARHGFGEEWLDAGCELIVSTLEAELAPGARLREVADGKRLIELEFTLPVTRLDVAALIAALQDPAHGLAEPLRQAAAGLDFAAVQGFLKGFIDLVCEMGGRFYLIDYKSNHLGGEFGDYRGDSLAAAVAREHYYLQYLIYLVALRRYLRARGVDWDSRFGGVRYLFLRGMGAEGGGGIWADAPCAALLDALDGLLGGH

SEQ ID NO: 8612 - protein, 1065 aa, Chromobacterium substugae
MLFLYQSNRLEQLGELFCGMTQAMPLADPFAAETVIVQSRGMGRWITLDLARKAGVAANVDFVLPAAFAWRLMQKVMPDLPRKSAFVPEVLAWRLLALLPTLDGEPFGPVRHYLEGGESAAFELAGKIADIFDQYLVFRPDWIRAWESGALLGLGEDEAWQAALWRRLAESDPGRHRVRMLDEFFSQLKSEHLPARVTLFGIASLAPMYLALVKRLSELTDVCLFTLNPCEAYWGDIVDARRKLRLRQAGDLFASEGHPLLASLGKQGRDFFELIAEDAELDAKPLFAAPKGSSLLARLQRDILELNDPAAAPAPMAADDHSVQLHACHGPMRELEVLKDRLLAMFADDPKLSPADVAVLTPDINRYAPYIDAVFGRRDDAPNIPYSIADRRVEREQPLLSTFAAVLRLADSRFAADAVLALLDSPALLARFDLSEADLPFIQDWVRDAGIRWGRDAGHKAQLGLPADPLYTWRWGLDRLLLGTVLPPALAGDAAGLFAGLLPHGGAQGQLGEALARFANCYDALDALAREWQAPASPRQWAERLHQACERLFLADGDDEAALETLRGVFAELAEDAELAGFDAAVGLPVARDWLLRQLGVASAQGFLSGGVTFCAMVPMRSIPFKALCLIGMNDGAYPRDERPVSFDLVARHPRRGDRSRRFDDRYLFLEAILSARQTLYLSYVGQSARSGETLPPSPLVAELMDSLSAMCGEDLAARLTLRHPLQPFAPQAYDGADARLASFEPAFAAALAAPQAEPRPFLAPLPPEEPASVLNLHDFIRFWKHPPRAWLAERLAIRLSGREDELAAREPFSMEADASRALRQQLVEAMLHRRPQAPLRERAAAAGLLPCGELGQAWLQEEGRASVRLAGRLPRALAEETLPPQPVHLSLGGFTLVGELYGLRPEGRLSFIVGKLNAAQRIELWLTHLILCAARPAGIACHSAVYDDAGSTALADEIDAAGLLAPWLARWRQGQAQPLPFFGRTSWAYAEALAKAPDAREAALAAAWQKWQPGFVLEGGMAQRDEPALALAFRHQQPLDDPLFAQLAETLLLPLAERLGGKER

SEQ ID NO: 8613 - protein, 128 aa, Chromobacterium substugae
MYPYLIVKHAHMGFAFLSILLFAARGGLVLSGRQHLLATKPLRILPHLIDTLLLACAIALVVMGGWPILHSPWLLAKIAGLVAYIALGSIALRYGATPKTRWLAFVAALAVVAYILLVAATKTALPTL

SEQ ID NO: 8614 - protein, 147 aa, Chromobacterium substugae
MISPARPFLPRARGFSLLELLIALALAALIVGFAVPGYQSHMQRSRRGDALEALYQLQQAQLRYRGFHPGYAKSLAELNTPFGNGISRQGYYQLSTGIVDDDASGYFVQAAVRAGGAQAGDGECRQIVLTQRKHTLSLTPLPCWGKR

SEQ ID NO: 8615 - protein, 169 aa, Chromobacterium substugae
MRAAARGITLIELMMVIVLASLLLTLALPALGRWIAGQQLQGALDDVGSQLELARKTATTRQQRVWVEFSQDGPGWMMRVSELRDGKGCEPGRDLSCVGSAQHAGIALSLPGKPLALKLAFSPMRGLPQNPDGTLLSETVLQLGRPACRPARLRLLATGLISSEAGSCS

SEQ ID NO: 8616 - protein, 202 aa, Chromobacterium substugae
MLLKPARGISLLELLVGMTVSLLLLLAISSLLAGLLGNQARERRQARLGAMMDASLSLMAMELRRAGYWNSNGETGVNPYGRIYIEQKGGCLRYGYDTPPGQTGGGPRYFAFRLTSDSAGRGRIQRRASNAAGWSCDADAAGWDDLSKPDIGVIDTLRFRRDGAGQAIALEVAARTPPGGEEETLNIHTSIALRNHPAVENQ

SEQ ID NO: 8617 - protein, 602 aa, Chromobacterium substugae
MTAPRQRGLATLFTVLTLLAIASLALIAASRQLLLAHANAQNQHRYHQALDYAEEGLNQAQAALAAGAPLLDTPRYQLKRTDIAPDLVRLASTGLYDQHRVTVQRMLRLGRAGGDSPVALAIVGDLDLSGAVNLLSDKPVDMTVDGKVRLSGSVNGIGTLQSTGDIFVSGPQTIGALHSNGNIELANGSYGTVKAAGDLTLRGDAAITRLARVNGNARFFSSPGAEPAVRAAEVKGDVEINMGGARFGRLDSEGKVDIRQFGGMEALQALGDLSIQGWGAPLAGVVAGRANFNANNPDIRVNQDPKLRLKLEPVPLLQVGRPRIDAFDFKNEAHYRFEFDRAGRILVTVRKIHGLADGAYRLGLSPDSQLPNYLCRDADSQGRCRSGAPAQLICKGHSPQNDCFAGSRPGHWKLDGQTMAPGVLWFDGDLEVGSGVYHNSFLASGDIATSGQHVSYAVNYAGAVGVCRNSDFPALYPEDDCRQGLFKGRPIGNAALLAGGYSAGRYQGGNITLGASSQIHGNVWAGNMLFSGGSTTIHGYIAAALQGAAAAEPHRWGASTTIDLRGLPETFQPGSQPGDPGSGGKRGVEALPYSWMDSGADS

SEQ ID NO: 8618 - protein, 122 aa, Chromobacterium substugae
MSARRHRGFTLLEMMISLLVLAVGALGLLRLETELLHSQIAANDYNSATNLAQAALEQQHVGSGADCRRADFAPAAASGTLARFQCRSRVASGTVSVDVQWRDSQGDGETLSLSAPQHLAGD

SEQ ID NO: 8619 - protein, 142 aa, Chromobacterium substugae
MRIPELTLPAGAAALLSRLPAAPPAWLLAAGLNQLLRRGILPADMAQLAGKRFRVRLEDAGLQLDFRADGGRFHPSRGEPDLSLAANCCDFARMLLREEDPDTLFFHRKLRIEGDTELGLIVKNLLDSIDWSQTPLAGMMAN

SEQ ID NO: 8620 - protein, 253 aa, Chromobacterium substugae
MKHWPFSTRRVKIELAWVVLFNLLSFLLFVHFELFDKLDDWFHSHPDSALDEVLLVGFTLAISMSVFAARRLREALILLKALRRQAERDDITGLANRRRANQMLQRETERSYRSNRLYSVLLIDLDHFKSINDTHGHQIGDAVLQRFGKVLQKRARQLDTIARWGGEEFIVICPETEQPGALTLAESIRQLLKETDFAPVPQVTASIGVATLSDDDTPDSLVHRADMYLYAAKQAGRNRVVGDAQTASAPLQA

SEQ ID NO: 8621 - protein, 321 aa, Chromobacterium substugae
MDTLKALMVFMTTAENGSFSDAARKLGVSPAAISQSIARLEQELEVRLFNRTTRQLTLTEDGRRFYAQCRGPVNNLDSAINQLKASRDEPAGHLRVSMPNSFGRRFILPIMGEFCERYPKVRVFFGLDDHFSDLIEDGYDVGVRTGMMPDSRMVARNLAQMPLYVVASPEYWDRHGRPSSPEELGGYDCINFQFPTSGRLFKWEFDRKGERIPLEVNGTYTLNDMEAVAELARLGMGVAQLPGHEVVHLIRSGELEPVLTDMVSLERSIYICFPHRDHIAPRTRVFVDFVVEKLADHPDIMADLPGLDLSAKRSALLQTVA

SEQ ID NO: 8622 - protein, 265 aa, Chromobacterium substugae
MVISKPINARPLPAGLTASQQWTLLEWIHMAGHIETENELKAFLDQVLSQAPSERLLLALGRLNNQNQIQRLERVLNVSYPSDWLDQYMKENNAQHDPILRIHLGQGPVMWEERFNRAKGAEEKRFIAEATQNGMGSGITFSAASERNNIGSILSIAGREPGRNAALVAMLNCLTPHLHQAAIRVANLPPASPSNMPLSQREYDIFHWMSRGKTNWEIATILDISERTVKFHVANVIRKLNANNRTHAIVLGMHLAMPPSTVANE

SEQ ID NO: 8623 - protein, 451 aa, Chromobacterium substugae
MTAFTSCNPATGEVSFTRPAWSETTLAHSQAALRRAQQTWARMTVDQRADQLLHFADRLSLQREALAELVTQEVGKRTPECLAEIDKSVQLVRYYAELAPSLLKSQLIPTQASRSGVAFEPLGLVLAVMPWNYPVWQVLRFAIPALMAGNACLVKPAPSVPQCSQLLLDIAREAGLSVLEMAWIEPDLVEEAIRGCDAVAFTGSTHTGRVIAALAGKHLKKTVLELGGSNPFIVLADADIAAAARDAANSRFRDAGQSCNAAKRMIVVPEVAEAFVEAFCAAAAQLRAGDPHDPATTLSPLTRADLREALHAQVLDACAHGAELKLGGQMPHTPGFFYPATVLDHVNPSCRVYHEEVFGPVASILRARDEADALRLANDTPFGLGASIYSADSERAWQLARQIEAGSVFINRHTSSDLRLPFGGVKASGYGRELSEFGLYEFVNVKTYWQK

SEQ ID NO: 8624 - protein, 481 aa, Chromobacterium substugae
MKSLPRNARIRGEPFLPNRFIFGDAVDEQGLEGAEYLVHTESPAFICRLVGNDDTDFPGRERDGLASAVLFDEAENLTVYVCNLRLRLFDFNFYGEIEPSVGELQEICDEAMRTYQKLHKAYAERDAAGPEPREMRTGPTKPLPPAERQQAISQLVDKARQAVGKPMEGMQLAAAVQMALMAGDQAVFTEAQLSLLAEPAARQLLVDSARDAVAFPEVIRQDGTVVSFELWALPFAFSRSQGGVWWHFPRLEQLEVALADALEVPEKSILWISPTLFTVDMLNERACQDMVQLAPIMDAGCDFAPLNPEASRATYEAARKTSEPQLVMAWIPFLVERGALPPDRARRLARKALDASMPLVQQAIAAEMEYGEAELFAPLPWWDALASGMHAWNRKRLGVSAALLATSQGGIDKLEAVAEYQPEIQGYEVALRVKGSEEIAARVPWLLVPDVAPDRDACWKDLSDCLREAGVPLSQNVARLH

SEQ ID NO: 8625 - protein, 273 aa, Chromobacterium substugae
MNAQAWPRAEWRELSAARKRNALGLAVGLPLPDWAGAAPLPGGTLAGRYCRLAPLDAARHGRDLFDALCRSEEAAGWTYLNQGPFACLEDWLAWLRGQPARVDARYYAIVDAGDGQALGLAGFLGIAPADGCIELGGLHFSARLRRSRLATEAIYLMLRHVFELGYRRCEWRCDAQNQASLRAALRLGFTFEALWRQRRVAKGRNRDAACFSIIDQEWPARRAALAAWLREDNFDGGGAQRCTLAQIVAMQERNRAAGFMPAVGGATMGACNR

SEQ ID NO: 8626 - protein, 247 aa, Chromobacterium substugae
MLADARQLMQPAELNALGQSVGLPVPGWDGALHPPRRTLAGACCRVEPLDAAKHAGQLFDALHQMPGGANWTYLGHGPFLVFEDWLAWLGDNVERDDPQFYAIVDSADGVAVGLASYLRIAPADGCIEVGFLNFSPRLQRSRQATEAMYLMMREAFALGYRRYEWKCDAQNEPSIQAALRLGFTFEGLFRQARTNKGRNRDTAWFSILDHEWPARRQALERWLAADNFDEQGRQRQSLADIAAGGGA

SEQ ID NO: 8627 - protein, 130 aa, Chromobacterium substugae
MLSQQAFYAAKLAYEIDAADVAQALASGDPSLVLIDTRSAGAHAEETIPGALSRPHRLMTEESCADLPRDATLVAFCDGIGCNGSTKGALKLSQLGFKVKELQGGLDWWKRDGYATTRDAGCGKEVCDAC

SEQ ID NO: 8628 - protein, 484 aa, Chromobacterium substugae
MNSAWICEYLQPRLRRDGGDHLARQLYRLLRELIRQRKLASGSALPASRALAADLAIGRNTVLAAYDQLAAEGYLESRHGSGTYVGQAFSAAAIPLAQPRTQMRQLSARGQRLAEASRLPTGRLGAFVPGLPELEQFPHRQWRQCLSRRQRQAPLEWLHYQHQGGLPQLRRVLSQYLHLTRSVNCSPEQLVITSGAQNALTLLAQLLAEPGDTAWLEEPGYTGAQAAMQAAALHCQPVPVDPQGMVLDSAAPPPQLIYVTPSHQYPTGAVMSLPRRLELLALAARHDSWIIEDDYDSEFCYTSAPLAALQGLDQDKRVIYVGTFSKVMFPGLKLAYLVLPPELVDPYRRCQARLQGESNYLQQAAVADFIEQGHFARHIRNMRELYLRRQQLLRLALQQHLGDALPLHGGEAGMHLLADLPRGFDEWELQQAAAEQQLWLRPLARHFLEMPDRNGLVLGYAGIADHTIHPAVRQLAALLETRLK

SEQ ID NO: 8629 - protein, 168 aa, Chromobacterium substugae
MKKPRLLVSACLLGQPVRYDGQAKAMARSDWEALRQRFEIVPACPECLGGLPTPRPPAEIRHGDGTAVLQGLASVQTRQGQDVSQAFVNGARRALEIARRQGCQAALLKANSPSCGNLQIYDGSFAAVLSDGQGVAASLLEQHGIRVWNETQMGDLLAWQAGGSLSAP

SEQ ID NO: 8630 - protein, 1520 aa, Chromobacterium substugae
MLESGLRKHRARPEELLLAAALLAACRWSGERALTLRLAQDGRAADAELAATVGQFDVERGLTLALAAGELAPGAAILAAKEGCRAQTQELGDAGRTARLAFRYDGDFDAPAAARAGIARLALPNDDDDAGGPPLRLRGERRDGCLRLTLSCRAAAVPAQGLDVLAARLDEALRELAEHCADPAQAASLSPSDFPGLGLTAAELAGWRQRFPALEQLSPATGMQIGMVFHSQLPGHADAYTNQAYLTLEGELDAGWFREAWRIVIERHPALRAGFVGFEREQPLQLAVAAPALDWREEDLRGQAPDAFERWRQADRQTPFDFGRPPLMRFLLARVGEQSHRFCWTHHHSIIDGWSVTLVWDEVFEAYRALRAGQEPALPPAPSFAEAAFWRHGQPREEGLRYWRETLAGIGPRAALRIEQPGLPPLGGEASKSRRRLSEQATRRLTEMARAGQTTLAATMQAAWALLLAHYSGQSDVVFGVTSAGRTIDLPGVERIVGPLINTVPARFALDPGARLGDWLRTVRDMHLLRDRHASIDLIDIQRQSGLRADQPLFDSVVIVDNYPAADYGAATALRVSERGYAGETHYGLTLSVMPGARLAFDIEFDSSRFHKKDIDAMADKLESVLTRMPQNLAEPLSAAVGAAARAEAASDAAGLSMARRQGDLRLGRDLVPHLVENHAQDTPEQIALICNERSYSYEQLNRAANRLANHLLEQFPQLGADSLVGVRIPRGDKLVIAILALWKAGAAYIPLDPVLPAQRVRDMLETAGAAFVIADSVEAAADNAAALGMRAVSYDAVEQLPGLDERNPDVHISGNDLSYVLYTSGSTGKPKGAMVEHIGMLNNIVNKAIDCKVTESSRVAQNASMSFDVSVWQMFIALARGGATVVYDDRAVNDVAGLLARLAADRVTVLEVVPTYLSVLVEHIEDKHPGGLALSVQYLLVTGETIEASLLKRWFKLFPHTHAVNAYGPTEASDDITHHLMSAGDALENPVPIGRALANFDVYIVDDELRPLPYGEMGEIVVTGVGVGRGYVGMAGATAQAFLDSPFPDKYRGRLYKTGDLGVMRPDGVLLYHGRKDKQVKIRGMRIELEDVELALQALPAVRQAAVLEIRPAGREAFLCAFAVARADGEREAIVAELKEKLPPYMVPSVFRFESELPQLPSGKIDRRALLAGYEETAPRAACVEPTNEVERRLADIWREVIGSQAIGISDDFFDVGGDSFKAIRIAAKYGAPLEVTHLYDYPTIAALAEHLAGLDGDAQKTLTPIAGDPVQAEAMLLCIANSGGGPVSFIEMGRAFSAAGVPLAACAVNLPRNEVDDDAAMVAEVERLAAEVCDELGRMSSLPLMVFAQCNGSALALGVVREWKRRGADLRALCIGGALLRTEPTPKDVRSDEQIVAFLGSIGSTLPAEADERAFFLHDFSYDCHMADSYYNHLVRERAAEAGERIGAPVFCLVGTEDPIVSGYAERYRDWGLLSDEVSLIEYPGIGHYLLRDCPAELAASLADIWRRVGGKEARNGR

SEQ ID NO: 8631 - protein, 260 aa, Chromobacterium substugae
MAAELPKLAFVHIPRTAGTAFGHALDQLYQGRRTAKFYADEEVKVANGKIEAFCRLDGADKQGFDLLRGHFVHGFDPALRGFDYVALLREPVRRLISYYFYALKDKRNYLHSYLLKRRLGLEPFLLSDASIDLDNYQVRAISGAQFASVREPVSQQHCDEAKRKLAEEFAAFGLTERFDESMARFARKFGWNLPAPGKMNAGSYGPELELSAACRERVLEKNRFDVELYQFACRLFEAGGAAAEQAGIPIAQERTEDGYA

SEQ ID NO: 8632 - protein, 289 aa, Chromobacterium substugae
MATLEIRPLSGTIGAEVRGCDVSLTPSPELAGEIRRALLQYKVLLFRGQPALSMARQIAFAQAFGEIETEFPSFAPKLAENPEITLFDSRNGSGRAEMWHTDLTVSETPTAFGVLCVKERPARGGDTMWADSEAAYASLSPGMRAFLEGQRAVHDMYSPEYAARPGGNKRTDLDMSRISRAEHPLVRVHPETGRKCLFVNPFFTSHIVGFSSEESANILNFLYARMERPEFIVRWHWSEGDVAMWDNRCTTHVAVNDYGDAHRLAQRVCVKGDAPFGVGEARRAALETA

SEQ ID NO: 8633 - protein, 295 aa, Chromobacterium substugae
MVFTHFNMGSKMSNQAGVAVVDFNGSIFLESSNVRAQANRLNWRSEVLMGRNPDCFKGKRVLDLASHDGRFMHAALKHGASKVIGVEAREEHVIHARHNLSRAGHAPDSYQVLCGDLVEHLKQIETGSVDTVLCFGVFSHLIEQVEIIREIRRIAPGAFILDTWVAKEQWNLRERLRNHKVNLWVRDTQQGGDRGLSLLARFKRLMASVLPGPGSKVGSMVLLYEDPQAPGATVRPSGLMAWANRSALEMLFEHFGLEHARVDWMAQRVSDWTDLEDYRNGSRESWVVRPGRRAS

SEQ ID NO: 8634 - protein, 332 aa, Chromobacterium substugae
MRKIYLRRVSGVTHGESTRMVRPDDFASDIVAAVDAAAQIEDFGRYLPLCVDWRAERLRYSRWEDASPLSDAPFLYQRQRRQAAMLADIPFERLPELGQAEGMTPTFIFSIGRCGSTLLSRMLAAVGEQAVSEPDALTNIALVDNAEQGRQAAEAGELIVRSCVEALRRACGPSPVIKLRAVCNLAAAAFVRALPNARYVFMFRGREDWVRSYSRAFGDSAAELEALLRQSAQAFQHLRAAGAEPELVWYEDLLADPAAALRRILPHRADLAAFEAPLAEALRADAQQGSILARSTLAARPVADGIVEEFEDLWRQSRPEGLLREAGLARLL

SEQ ID NO: 8635 - protein, 385 aa, Chromobacterium substugae
MSTLPAASPEALAISQALSGRISQAIADAGGWIPFSHYMELALYASGMGYYAAGSSKLGEAGDFITAPELTPLFGQALARQLAELLPQTAGAIYEFGAGTGKLAIDVLAELEALGCLPQKYVILDLSPDLIERQRQNIRAALPHLADRVEWASRLPDAIDGVVIGNELLDAMPCEMVFRDESRRLRQRGVTVRDGALAYEDRDFADARLAELAAQLVPDIPRYETEISLANRAFVATVAGALSRGAILLIDYGHAASEYYHPERSMGTLLGHYRHHTVQDPFYLPGLMDLTCHVDFSAVAQSGLDAGLDLIGYASQAQFLLNCGIVEALQRLDPNDVKAYLPVAKAVQRLLSPQEMGETFKAIGFGKGVDIDWQGFARGDRCYTL

SEQ ID NO: 8636 - protein, 252 aa, Chromobacterium substugae
MLTERQQDERVILVTGAARRVGAGIVRLLHARGLRLVLHYRGSQADAEALAAELNAARPGSAKLVRADLLDTAALPELAARALAAFGRIDGLVNNASSFSPTEVGRIDEAAWHDLMGSNLKAPLFLSQALAPELARRGGAIVGIADIHAERPMARHVVYNLAKAGHAQLIRSLAIELAPAVRVNGVAPGVNLWPEDETSFSAEARARIEETIPLRRAGVPEDIARAVAFLLLDATYVTGQILAVDGGRGIVL

SEQ ID NO: 8637 - protein, 323 aa, Chromobacterium substugae
MSELNAALDDKAKKAAFEGNKLAKRLRHHVGDAINDFNMIEEGDRVMVCLSGGKDSYTLLDILLGLQKSAPIDFSIVAVNLDQKQPGFPEHVLPEYLKSIGVEYRIVEEDTYSIVKRLVPEGKTTCSLCSRLRRGILYRVADELGATKIALGHHRDDILHTLFLNMFYGGKLKSMPPKLVSDDGRHMVIRPLAYCREKDIERYAQLREFPIIPCNLCGSQPNLQRQVVKEMVNDWDKRFPGRVESMFRALQNVVPSHLADTKLYDFASLTTGDAPFAGGDTAFDKEEFRDPAPHEDDAAEAAPKKRTISILDSRKPEGSGCGA

SEQ ID NO: 8638 - protein, 266 aa, Chromobacterium substugae
MARRALHPFRRRVRPAVEAMPEVEISEEGNIRSLHLGSETIQSSMDLDDPPELVLSYSRAMMGFLLWNDDPKHILQIGLGGGSFARFIDEYLPDAVSVAVDINPQVIAVARAFFQLPEEGDFFEIVEADGADYVKIFRGSTDAILVDGFDGLQIVDALTTEDFFEDCKRALSPKGVFVTNWWSGDKRYQAFIERLLNVFEGRVIELPAATHGNVAVIAFRQSPSLTQWEALKKRADELEYRFGLEFGEFVNRIKQTNQQTAGHLLI

SEQ ID NO: 8639 - protein, 435 aa, Chromobacterium substugae
MIKQQLLNRIADKSAVIGIVGLGYVGLPLMLRFAEVGYKVLGFDIDQSKVDALMAGKSYIEHISADSIATALERGFEATTDFSRVPEADTLILCVPTPLNKYREPDLSFVLDTMDSLVPYLREGQLVSLESTTYPGTTDEELLPRMESRGLKVGDNAFLVFSPEREDPGNPNFTTRTIPKVCGGVTEACQEIGVALYSAVIDKVVPVSSTRAAEMTKLLENIHRAVNIGLVNEMKIVADKMGIDIHEVIRAAATKPFGFVPYYPGPGLGGHCIPIDPFYLTWKAREYGVNTRFIELAGEVNSNMPDYVVSKVAAALNQRKKSINGSRVLVLGIAYKKNVDDMRESPSVFLMEKLRDLGAEVAYSDPHVPVFPKMREHKFDLKSVALNAETVAGYDCVLLATDHDKFDYAMLKANAQLLVDSRGKYLEPAGHIVKA

SEQ ID NO: 8640 - protein, 193 aa, Chromobacterium substugae
MWQRFPRLGAWLAAVGGIALLAALALAPLIRYSKTLLVAETPQQRADWIVVLGGESGQRVIGAAELFHQGRAPFVFVSGEGDCRLIVKRLVMAGVPRSRIGYECLSKSTYQNAQFTRHYLAAQQPRRITLVTSWFHSWRALETFRQAWPGVEWGMHAVYPGDDLYHSLALNEAGAVLSEYLKILVYSVRYWTF

SEQ ID NO: 8641 - protein, 350 aa, Chromobacterium substugae
MTPPITDRKIRFALVGCGRIANNHFGSLEKHADRAELVDVCDIDPAALRAAVERTGARGHDNLTAMLAQTNADIVILTTPSGLHPRQSIECSEAGFHVMTEKPMATRWEDGLEMVKAADKAQKHLFVVKQNRRNDTLQLLKRAMTEKRFGRIYMVNVNVFWTRPQEYYDAAGWRGTWEFDGGAFMNQASHYVDLLDWLIGPVESVQAYTATLARNIEVEDTGTVSVKWRSGALGSMNVTMLTYPKNLEGSITILGEKGSVRVGGMAVNEIQHWEFAEPHAMDDEIKNASYATTSVYGFGHPLYYDNVIKTMRGEATPETDGREGLKSLELLIAMYLSARDGRRVSLPLDY

SEQ ID NO: 8642 - protein, 176 aa, Chromobacterium substugae
MAEEKKEPWLNYLALTTVILAVCATLSTFKGGGYSTRSVIAQAQASDQWAYYQAKGIKGNLYEMERDRLQFERDNLPAGDAQRRRYDAAIDQAAKRAERYSAERKAIEKSARQLEDERNQAQRQGKPFGMAVIFLQVAILISSIAGLFKRKRIWLAALPVAGLGLVYFADGFFLFF

SEQ ID NO: 8643 - protein, 188 aa, Chromobacterium substugae
MEYTVHSSAIVDEGAQIGAGTRVWHWVHICGGARIGAGCSFGQNVFVGNDVLIGDNVKVQNNVSIYDAVTLEDDVFCGPSMVFTNVNNPRSHVNRKNEYRRTVVKKGASIGANATIVCGHTVGEYAFIGAGAVVTRDVPAYALMVGAPAKRIGWMCGCGERLPNDIGTHSCASCGIHYEVGGNHCTPV

SEQ ID NO: 8644 - protein, 365 aa, Chromobacterium substugae
MSIQFIDLKAQYQHLKADIDARIHAVLDHGQYIMGPEVKELEEQLAAYTGAKHAIGVCDGTKALLIAMMALDIGPGDEVITTPFTFISTGEMIALLGAKPVFVDIDPISYNLDPNLLEAAITPATRAIMPVSLYGQAADFAAINAIAAKHGIAVIEDGAQSFGASQHGKKSGNLSTIATTSFFPSKPLGCYGDGGACFTNDDALAKKMREIRIHGQDRRYHHPSIGINGRLDTIQAAVLLAKMPSFPDEVAARERIGARYSQLLKDVARVPVVGAGNTHVYAQYTIEVDDRDAVQARLKELGVPTAVHYPIPLHLQPAFAHLDQGEGSFPLAEAAGKRVMSLPMHPFLTEAAQDAIVAAVKQALG

SEQ ID NO: 8645 - protein, 423 aa, Chromobacterium substugae
MLTLASLRMPKSGFIRHIITLVTGAAVAQVVPLLASPLITRLYNPHEVGIQTVYVSWMSTLAVLATARYEMAIVLPADEKRASNLMGLSLLCASALALLIGLVVLLGGHSHIAAHLGAPELESWLLLLPLSVWLAGLMQAWTNWNNRHRRYQANANGRMTQSLGMAGTQVLAGWLGAGAGGLILGQLAGQLGSLLSQAWADFKSRMPWRRELSRQGMREAAAAYIEFPKINAPHALSTAMLDSVTLVVLAMLASTSAVGFYGLMMRVLKLPAALIGQAVAQVAYRELAEARNLGKPLRPILRKMMLTLFGMALFPFLVIQIFGEPLFTLVFGHNWADAGRYAEAMSLYILFHFVASPLGMVPPVINRQRFAFFLSLVQAVLFLGSLWLGFHIWQDAVPTFQLVSVVMAGYFIAYFTWLYKAAR

SEQ ID NO: 8646 - protein, 193 aa, Chromobacterium substugae
MNWNGFFSRIRFRLSAWVRPRMVYGFQRGDGVFLKRTRVSNMTRIEHIDKLMVEDNVYIGHFNLIDSSGGLYIGEGCQITNYVSLLTHSSHVAIRLYGREYLDRDNHAGYLKKPTKLGKYSFVGPHSVLMPGVTLGKGSIVSAYSFVPAGEYPDFAILAGNPARVVGDTRDMDAEWLAQHPDLHPLYEAWADE

SEQ ID NO: 8647 - protein, 363 aa, Chromobacterium substugae
MSEAIRRLLVVGSASVHTWRFLAGIAPHVGEIYLACNGEPPADKCPANLKGELRVDFSLKALGSAGKLKAWIQQIQPDVVHVHQANSVAWHARRALAGSDVPTLLTAWGSDVLLLPRQNRLLRAMVRGNLQAAAAVTSDSLYMAAQIRELAGDCRIALLNYGIDALPPEPAVAAKKKQVLSCRLHKPLYRIDAILKGWAEVERSGRCADWNLVVAASGGETDNLKQLAAALGLKRVEFAGFVDSATLGKLYADSRVFVSVPRSDATSISLLEAMGHGCLPLLSNLPANGEWVIDGLNGAIAEDVSRLGPELLRAMAQAEDDAALQSLAATNRGLVAAKALHQANMAGFADLYRELAADKGRKI

SEQ ID NO: 8648 - protein, 369 aa, Chromobacterium substugae
MKIAHLTSAHPRHDIRIFVKECSSLAAAGHEVTLIVADGQGEEIRGGVRIHDVGPKTGGRLSRMTGTVKRVYQAALKLRPDVVHFHDPELIPAGVRLKQAGIKVVYDVHEDVPRQILAKHWIPGAVRPLVSGGFETLEDWAARRFDAIVTSTPHIRKRFEKLGANALDVCNFPILEELVRDTPWESRRNEVCYIGGISRIRGIEPIVAALPGTATRLNLAGPWSESDLRAKVQAEPGWARVNDLGVLDRKGVAEVLAKSKIGLVTLFPTPNYVDALPIKLFEYMAAGMPVIASDFPVWREIVDDAGCGVLVDPQDAAAISAAINELLGDEARMRALGEAGKQAVLGKYSWAAEAEKLVGLYRQLEGRAQ

SEQ ID NO: 8649 - protein, 143 aa, Chromobacterium substugae
MTWRTAALSLLLALPLGALMAAINWQFKGTPFSAQTVWLHSLVALLAAAPLLAQSVWLRSMLASGRWPQVAAGGQMRFLLLHGAIGRGGPMLAFVLGMEWLGSGRLPLLNGSLFTLAFWMAFGAYFASRDWRRLQRAAMENKQ

SEQ ID NO: 8650 - protein, 409 aa, Chromobacterium substugae
MRILYINHYAGSPRHGMEFRPYYLAREWVQAGHEVNMLAADVSHLRQTHPQVDGKYRDEDIDGIRYTWCKTRPYAGNGLGRVLNIFSFLAKVMGLSGRYLKQWKPDVVIASSTYPLDTIPAAWIAGKTGARLVYEVHDLWPLTPVEVGGMSPKHPFIRLLQWAEDFGYRKADTVVSMLPCARDYMMAHGMVPEKYAVIPNGVDVGEWQGEAQPLSAEHRMRLAELKSHGRFIVGYAGGHGLANALDYLLEAAALMQDAPVTFVLVGDGPDKAALVARAAELKLNNVMFLPAIAKRSVPAFLAECDALYIGWRKLPIYRFGINPNKLFDYMMAGKPVIHSVEAGNDMVKDAGAGLSIGVEDPAVIADAVKRMAVLPLAEREAMGAAGKAYVLANHDYAVLARRFLAAVKL

SEQ ID NO: 8651 - protein, 387 aa, Chromobacterium substugae
MSEQKFLPFALPDIGEEEINEVVDALRSGWVTTGPKTKQFEADFAQFLGDGVEAIAVNSATAGLHLALEAIGIREGDEVIVPSYTFTATAEVVRYLGAHPVCVDVDAATFNIRPDAIRAAITGKTKAIIPVHFAGLACEMDEIIAIAREHGLKIVEDAAHAMPTYYKGKLVGTLDSDVTVFSFYANKTMTTGEGGMVVSKNKDIIARCKVMRLHGISRDAFDRYVSKTPAWFYEVVAPGYKYNMPDTAAAMGIHQLKKIRGFYDKREVMAQRFDRELAGLPLILPARAKDEGSNHAWHLYPVRIKPEAGVSRDDFIAKMAEKGIGCSVHFIPLHRQPVWRDGYQLTREQFPVADAAFEAEVTLPLYTKMTDDDQTRVIAAVREILGA

SEQ ID NO: 8652 - protein, 218 aa, Chromobacterium substugae
MEKEGGELLPPCCQPRRHGSRLLKRLFDIAAAGAGLAVLALPLMAVALWVKLDSPGPVFFRQVRVGRGGALFRIHKFRTMQVDTERHGQLTVGADSRVTGAGRVLRKTKLDELPQLLDVLFGDMSLVGPRPEVPKYVAHYPAEVKDIVLSVRPGITDWASIKMIDENEILGRAADPERAYIDEVLPEKLGYYVRYAETHSLLEDIRIIVATLMKIVSR

SEQ ID NO: 8653 - protein, 155 aa, Chromobacterium substugae
MTITIRAAMPADADALAGIYLDCRRAMPYAPLAHGEAAVRTWFAEALLPAGDVWLAERGGEIAGFAACSAQDGLRWLDQLYVAARHQGAGIGAALLQRVVVERAQACRLHVFQANAGARRFYEAHGFALLSLGDGLDNEERCPDALYQWRPDRKE

SEQ ID NO: 8654 - protein, 626 aa, Chromobacterium substugae
MFEKLLAFSRHNKMAMLALMDALLLPLALWSAVFLRLGGYWDPKLNPHLWIFIVPPLWAIPIFIKLGLYRAVLKYLDDKIIFTVFSGVTLSVLVLQAVIQMAHVWAMPRASVIIFWVFAMAYIGGSRFLLRGLVRRIDATEAPRDPVIIYGAGQAGVQLMLALQAGREYRPMAFVDDNPELRRRTYRGVAVHAPDELPALVKDTQAKCILLAMPSVGRGRQREILESLERLRVPIKRLPGMADLVSGEARVEELKEVEIEDLLGRDPVPPKAELLARNIRDKVVLVTGAGGSIGSELARQIVKNRPARIVLFELSEFALYSIDQELAQIAPRIPRTPILGSVTDYARLTQVMRAFQVETVYHAAAYKHVPMVEHNPVAGIVNNAFGTDTTARAAEDCGVDTFVLISTDKAVRPTNVMGATKRLAELTLQTRHARGSRTRFVMVRFGNVLGSSGSVVPLFRRQIKAGGPITLTHADITRYFMTIPEAAQLVIQAGAMGDGGDVFVLDMGEPVKIIDLARRMVHLSGLEVKDADHPGGDIEIRVTGLRPGEKLYEELLIGDNVLATDHARILRAQEYHLSDAEMASLLQRLADACQRLDAPAAFALMQEAVHEFQAAEATQDWVTLQG

SEQ ID NO: 8655 - protein, 63 aa, Chromobacterium substugae
MRQLEPENANAKPLREDPEKARLARNINRAERADCAKAYANLGLLAAPMLLKDAFDKDNGCKW

SEQ ID NO: 8656 - protein, 48 aa, Chromobacterium substugae
MPDGTPPGHFAARAHSTMSPAAAMSQAMHQTQTTMPSTWQRSAFILQI

SEQ ID NO: 8657 - protein, 302 aa, Chromobacterium substugae
METRWLEDFLVLADTGSFTRSAELRHLTQPAFSRRIRALESWLGADLIDRTTYPTKLTAAGKLLQQQAVPLLAQLNTTRTMLRGLQPLPQGTLEFAVPHTLSFSYFPKWLTAVEDGFGQLSCRLQASNVHDAVLAFVEGGSDFLMCYHHPKQPVELHDARYGGLRLGVERLRPYAIAADGAPVYALPGRQEAPLPFLGYASNAYFRLMSDLLLVSGPQPAHLSLRYETDMAEGLKQMALAGHGLAFLPESSVAAECQAGLLLPAGGDEWSVEMEIQLYCDLRHAKPEQEALWAYLAARHPAV

SEQ ID NO: 8658 - protein, 467 aa, Chromobacterium substugae
MTTRIEHDLLGNRDVPATAYWGVHTLRAIENFPITGQTIGSYGDLIRALACIKQAAAQANRDLGILDSKLAQAIVDACEEIRAGKLHEEFVVDVIQGGAGTSTNMNANEVIANRALELLGHAKGEYQYLHPNEHVNLCQSTNDVYPTALRLAAFWGVLKLVSRMEVLRKAFEDKAGEFKDILKMGRTQLQDAVPMTLGQEFQTYAVMLGEDEQRLKEASALMLEINLGATAIGTGITAHPDYAKLVCLHLSELVGSQLITAPNLIEATQDCGAFVQLSGVLKRVAVKLSKTCNDLRLLSSGPRAGFGEINLPARQAGSSIMPGKVNPVIPEVVSQVAYEVIGNDMTITMAAEAGQLQLNAFEPVIAYSLFRSAGHLANACDTLTEHCVKGITANRERLRQSVESSIGLVTALNPVIGYEAATRVAAEAHANGSSVAEVVLAHGLLTREQLDDILQPDMLTRPRWVTL

SEQ ID NO: 8659 - protein, 119 aa, Chromobacterium substugae
MSPMLWWSCEFPACAWSCLQDGWRCQQRYWRSSLFHGARVWLSPAPLPDKLARLARRGCADGIALWHDSSPAGFAWLEQAGAHALPYEGARRQWQDCLRHSQRVWQRGLLLLGREWSRI

SEQ ID NO: 8660 - protein, 330 aa, Chromobacterium substugae
MMRKAFFVIGLFAAGWAQADWSPTLVSDQYRATINYGGGSLSYSEDAKSMGQLRQTAMDLQTVPYTLQQGLNGRVSQLVAQNGATFLGGVVSGNALATIRPDASGVVYMTLSGLSYQVRNQYSGHKWGVISYTCTNTLTLSNIVITGQYGAANGAIAGDKTGMTATSSSSTDCDSNLSWILPVLGDALISKAEGKIDSTVQSSVQAALAKVKDTLLYKPDQNLLIGLNRLVPPGKVVALPGGGSFPLGQYIQNNIAYLLANSQLSIQLGSPIALKTVAGTSEPMTTSFSSDLATISLSSPAMAFSIKLAETAEVNWLWRCPAGAPRCQIP

SEQ ID NO: 8661 - protein, 79 aa, Chromobacterium substugae
MATQFLLSEQQLQHLAPQVQAYLADQLGLEIGSFDARFLLDFLADKMGRDIYNKALQDAQTALAERMETLQAAIWELER

SEQ ID NO: 8662 - protein, 199 aa, Chromobacterium substugae
MLYLRLMMKGFLLAVLLVVLGFAYIAWTIVDYGDGDEQNGADAALVLGAAAWGNKPSPVFRERINHAVKLYQGGKVRWIVFTGGTPQPGYPSEADVGREFAARQGVPMTAMLVETESRTTWQNLSNARDLGRQFGIRSYLLVSDPLHMRRAVLMAADLGLRAYPAPTQSSRFRTLSSWSRFLARETWLYVGYRAFRQLS

SEQ ID NO: 8663 - protein, 119 aa, Chromobacterium substugae
MAFPRNPNSVQRLKRLNNRQRKKMRVGEFRELGFHLVAQLREGVDTDALLDGWLTRFDEAGISFGGHFDGKSRLEGVAFPVSGSQITDAVRGELVAWLQARAEVQSLEASELIDLWHAA

SEQ ID NO: 8664 - protein, 601 aa, Chromobacterium substugae
MTGRIFRLYSWQCCDHFTNPRFNLHLINKMLNNKQNILVLSVMAALLSACGGGGGDSSSSTTSGNQVATTLNPPQKAAVTGDLSCQAGVCALPASANADAVGKVYQLQNNTGQDMQITVNGPLTARWDAVMTQVDSDPLGYGGSSGAARGNNAAAEAVLEQKMQQFYAHAASYGAVASRAQARMRLEKRVQIAARSYALNDSRSWYDSIGSRALNATMKASQALPNGGTVYVWAQNDAAAVTQQQAAFLAERFANSVFPIEAAVISEPWGPVHSTWQGITLDAGTKDVHLVLAQLNQPANAFQGLLGYAYPLNAILKSAASDPTCGSDCSEFANSNEALVTFLNVDTLVAADDGQSWSPSGKGPALTLSTLGHEYQHLLYSYNKLFRRMVGSPRTTTWENELAAQTMGYLVAADTYGGGRGDSATSHPDLRSGGDFSQFLKQPACDLKRWSAMSGDSFGTTCYPKALATGMLMLHQYGAGVMKPWVTGANVGERALDDGLAAVGGGDYGSLMQQLYTSLALADFSTWPAGYGFPAKQLGLPASRYFPAGKTIALPQININPSEVQLSADSAQEAYRLTLAPVAGQVSITVPANSRLSLVKR

SEQ ID NO: 8665 - protein, 100 aa, Chromobacterium substugae
MAGVLAACGLLASLGMAKVPWEHGKLVSVGNAPFNQLAIQRSDGALLTILPSDETGALDKRQLAPFAARAGDKVRFRALRSAQSKLSGEMVVLSQMELER

SEQ ID NO: 8666 - protein, 49 aa, Chromobacterium substugae
MYSRMRQAPVQAEDSHLAETRRRRPHPGGAPMKKPGIVADAGLVRQKRG

SEQ ID NO: 8667 - protein, 188 aa, Chromobacterium substugae
MRLYTQDAFRPMPWANGGGQTCELFRLPHPRRQDAFAARLSIADVARGGPFSHFPGVDRLLGLLEGEGMELRLDDGRLLRLAQAGQVAAFPGEAGVDCRLLGGPLRDCNLMLARDWGRGELERLQLPAGGVLRAPAADLTLLYLQQGEWHCDGSALPPGCLLAAEDEAMELRASGGGVAWLARVSRLD

SEQ ID NO: 8668 - protein, 491 aa, Chromobacterium substugae
MKYADLREFIAQLEQKQLLKRIASPVSPHLEMTEIGDRVLKAGGPALLFEQPRSPDRGYDFPVLANLFGTPERVAMGMGASEVMQLREIGKTLAYLKEPEPPKGLKDAWDKLPLLKQVLSMAPKEVKKAPCQDIVWEGDAVDLGKLPIQHCWPGDVAPLITWGLTVTRGPNKKRQNLGIYRQQVIGKNRVIMRWLAHRGGALDYREFRQQNPDQPYPVAVVLGCDPATILGAVTPVPDTLSEYQFAGLLRGSRTELVKCIGSYLQVPARAEIVLEGHIHPNDMAMEGPYGDHTGYYNEQDSFPVLTIDRITMRENAIYHSTYTGKPPDEPAILGVALNEVFVPILQKQFPEIVDFYLPPEGCSYRMAIISIKKQYPGHAKRVMMGCWSFLRQFMYTKFIVVVDDDVDTRDWKEVIWAITTRMDPVRDTTLIDNTPIDYLDFASPISGLGGKMGLDATNKLPGETNREWGTPIVMDAATRQRVDAIWSELGL

SEQ ID NO: 8669 - protein, 196 aa, Chromobacterium substugae
MKKLALAAAIGMISASAFAAQGDILARFRVIDVDPSASWSNGAAGTHVDAKSSAAPELDFTYMITNNIGAELILGTSRHKITNNGVDIGKVSVLPPTVTVQYHFAPEATFRPYVGAGLNYTRFYNDGLANGAITVKKNSFGPALQAGADIAINKSWFVNFDVKKLWVQTDVSAGNVKLGTLHVDPWVFGVGVGTKF

SEQ ID NO: 8670 - protein, 361 aa, Chromobacterium substugae
MALLEIKNVVKRFGDYTAVNDVSLSVQAGEFFTLLGPSGCGKTTLLRMLAGFEQPDAGQILLDGQDMSQVAPEKRPVHTVFQSYALFPHMTVRENIAFPLKMAKWDKAKIEAQVDKLLADVRLTPFGSRYPHEMSGGQRQRVAIARALVDRPRLLLLDEPLSALDAKLREEMQIELINLQKEVGITFVYVTHDQGEALALSHRIAVMSHGQVEQLDAPEQLYSYPKNRFVADFLGQCNVLESTVKSLDGGAMTVDIKGCGEVKCLAVDGVKPGQQGWLALRPEKVRLDKSLAAQPDEAHLKGRVHDCLYLGDVTLYVVEVADGVRIEAMQANNIPGVAKFFDDGDIVEIAWRFDAGSFLTE

SEQ ID NO: 8671 - protein, 297 aa, Chromobacterium substugae
MAIRDRFGKWALSWPPLLYLVLFFLIPSLIMLVAAFRQPGDYGGLAPLFTIEDGQRVWQLTLDNFHRLVEEPLYLELFVKSAGYAAITTAVCLVMAYPLAWLIARSGKKYRDLMLLLVILPFWSNFLIRIYAWMIILGPQSAFTKALNLVLTSLGFEPVRLLFTSFAVIVGLVYVHLPFMVLPLYANLEKHDMALLDAAQDLGANAWQRFWRVTWPQSLPGVFAGSALVFIPALGMFAIPDILGGTESIMIGNLIKQQILDTRDWPFGSVLSIMLTGGVLLIAALGAVVARRGKGRG

SEQ ID NO: 8672 - protein, 264 aa, Chromobacterium substugae
MAKKQSKWLWASAIVTYLFLYLPLVIVVLYSFNDSRLNAEWVGFTLKWYDKLFHNQKMLTAAGNSLLIGVIASFFATILGTLAGVALHRYKLRLLPFLVLTPIAIPELLMGVSLVIFFVIVNQLIGILELGFITILLSHIAFCIGFVAIVVRARMQGMDDSLVEAARDLGATPFQAFRLITLPVIKPGIIAGALMAFTLSIDDFVITFFTAGAGASMLPLEIYSMIKIAVTPEVNAVSSLLMLLTLALIVIASRVSPSALRANG

SEQ ID NO: 8673 - protein, 354 aa, Chromobacterium substugae
MKKILAMLALAASTQAFAADELHLYNWNNYLSEAAAKNFEAYCKCKLVQDYYGDNEEMLAKLAAGAKGYDMVVPTGFAVDALIKQGKAQPLDKTQLPNFKNLNPGYLNSFFDKGNKYSAPYAFTTTLIGYNETKLKQLGLGDKVNTWALIFDPALLAKIKGKVTVLDSQRELVSAALMYLGKPANSTNPADWKAARDVILKAKPYWAAFNNQSYIKELTVGNIYVAFGYSNDMFQAQQDAKKAKRNFALNFSLQKEGNTLSLDNFVVLKDAPRKDLAYKFINFMLDGKNAAGLTNELGNGNPNAAAGKFVKTELTKIPAIFPSATDLPRLQQLHDLNAKDRRELNKVWSEIKLK

SEQ ID NO: 8674 - protein, 103 aa, Chromobacterium substugae
MSSQKIRIRLKAFDYNLIDRSAQEIVETAKRTGAVVKGPVPLPTKIERFNVLRSPHVNKTSRDQLEIRTHLRLMDIVDPTDKTVDALMKLDLPAGVDVEIKLQ

SEQ ID NO: 8675 - protein, 228 aa, Chromobacterium substugae
MPVNRNRRLKKEINMSLGLVGRKVGMTRIFAEDGATIPVTVLDMSANRVTQIKTAETDGYNAVQVTFGSKKANRVNKAAAGHFAKAGVEAGEVLVEFALSADAVSSFKLGDAVAVETLSVGQLVDVTGTSKGKGFSGVIKRHNFSSNRASHGNSRSHNTPGSIGQAQDPGRVFPGKRMAGQYGNVKSTVQCLEIVRIDAERQLILVKGAVPGAKNGDVVVRPSVKAGA

SEQ ID NO: 8676 - protein, 206 aa, Chromobacterium substugae
MELNVINTQGKAVGSLQVSDSLFGRDYNEALVHQVVTAFLANARSGNRAQLTRAEVKHSTKKPFRQKGTGNARAGMTSTPNRRGGGRAFPNKPDENFTQKVNRKMFRAGMAAILSQLVRDERLIIVDELNVASPKTKEFVGTVQPMGLEQALFITGELNENLYLSSRNLPNVLVIEAQQADPYSLLRFKKTVITRDAVKQLEEQWA

SEQ ID NO: 8677 - protein, 102 aa, Chromobacterium substugae
MNQERLLQVILAPIVSEKSTMIAEKHQQMAFRVATNATKPEIKAAVEMLFNVKVEGVSTVNVKGKVKRFGRSTGRRSDWKKAYVSLVEGQEIDLTATPAAAE

SEQ ID NO: 8678 - protein, 408 aa, Chromobacterium substugae
MSRQANTFQICRYSHRFTLLLLRLLIGSMAFESASQREFTQFVADHVFRNIDGNVSATVVYSDGQANEVRQDGRTTGPGLDRTLVAGCPYRIYLFQEMQVNERAFFLRTCHCQLPFVGIATAYDHVVGTLVATGTEALGRSAPRANRYAAFASAAFTTTVRVIDRVHRRTANGRADAAPTSSTCFTQLAQGVLFITHFTNGRTAIDVHQADFARAQTQLSVYAFASQQHCGSTSGANHLGTLARLQFHAVDSSTHRDVADRQGVAGLDRGFRAGQQHGANLHAARRDDVATFAIGVAQEGDVGSAVRIVFDAFHFCRDAILVATEVDQTVVLLVTATTMTRGDVAIVVTAAGRVFLLNQGCVRSTFVQVRVYYLDNGTATRGSRFYLNDRHALSPYSAAAGVAVRSIS

SEQ ID NO: 8679 - protein, 90 aa, Chromobacterium substugae
MADLVRGQSVAQALNILAFSPKKGAVIIKKVLESAIANAEHNEGADIDTLRVTSIFVDKGASLKRFTARAKGRGNRIEKQTCHISLTVGN

SEQ ID NO: 8680 - protein, 233 aa, Chromobacterium substugae
MGQKIHPTGFRLAVNKNWSSKWFASSQNFPEMLKQDIEVREFLKKRLGHASVGRVTIERPAKSARITIHSARPGVVIGKKGEDIEVLKQELQKRLGVPVHVNIEEVRKPELDAQIIADGIASQLEKRVMFRRAMKRAMQNAMRLGAEGIKIMSSGRLNGIDIARSEWYREGRVPLHTLRADVDYATSEAKTTYGIIGIKVWVYKGELKPGQVVAAPAAPEKKMRKGARNAAAN

SEQ ID NO: 8681 - protein, 45 aa, Chromobacterium substugae
MAEIQPGKMLYEMDGVSEELAREAFRLAAAKLPIATVFVTKQVGQ

SEQ ID NO: 8682 - protein, 62 aa, Chromobacterium substugae
MKASELKAKTVDELKVELLSLLKAQFALRMQHATQQLAKTSELKKVRRDIARVRTVLKEKAV

SEQ ID NO: 8683 - protein, 87 aa, Chromobacterium substugae
MSETKVVRTLTGVVVSDKMDKTVTVLVERKVKHPIYGKIIRRSKKFHAHDENNEFKAGDLVVISESRPLSKTKSWVVTGLVEKSRQV

SEQ ID NO: 8684 - protein, 220 aa, Chromobacterium substugae
MFLGDVNAFNNQLLIQNTQDGAALTLVFAGDYYDFITFTNFAHVTSLQHFRSQRNDLHEAFGTQFTRNGPEDTSADRLKLVVEQNSSVAVKLDQRAIRTAHAFGSANHDRIVDVAFFDATTRSGILDAHLDNVTYASIATLGATQHLDAHNVTRTSVVSDLKHGLHLDHLMITFLIQLYPSLSPAGFSHKSKTKQTKRHRQPVACQTASFGPRKGGTLAK

SEQ ID NO: 8685 - protein, 44 aa, Chromobacterium substugae
MPVDASNVAIFNPASQKADRVGFKVLEDGRKVRVFKSSGEVIGA

SEQ ID NO: 8686 - protein, 179 aa, Chromobacterium substugae
MARLYDFYKDSVVPELMKQFGYKSIMQVPRIEKITVNMGVGEAVADKKVMEFAVGDMEKIAGQKPVVTTARKSIAGFKIRDNYPVGCKVTLRRERMYEFLDRLVTIALPRVRDFRGVSAKSFDGRGNYNMGVKEQIIFPEIEYDKIDALRGMNITVTTTAKTDEEARALLAAFKFPFKG

SEQ ID NO: 8687 - protein, 101 aa, Chromobacterium substugae
MARLALINREEKRVKLAEKFSAKREALIATINNQSLSEEERFAARLQLQQLPRNASPVRQRRRCAITGRPRGVFRKFGLGRNKLREIAMKGEIPGVVKASW

SEQ ID NO: 8688 - protein, 131 aa, Chromobacterium substugae
MSMHDPISDMLTRIRNGQRASKVAVSMPSSKLKVALAQVLKEEGYIEDFAVAGEAKKPVLDIQLKYYAGRPVIERIDRVSRPGLRVYKGSTEIPKVMNGLGVAILSTSKGIMTDRKARSTGIGGELLCVVA

SEQ ID NO: 8689 - protein, 152 aa, Chromobacterium substugae
MKGALGTLSTALCEEVEIKLDNGQLTFAAKNDSKFARAMSGTLRALLNNMVNGVSKGFEKKLQLVGVGYRAQAQGDTLNLSLGFSHPVAHKMPEGIKVETPTQTEILVKGANKQLVGQIAAEIRAYRAPEPYKGKGVRYADEVVVLKETKKK

SEQ ID NO: 8690 - protein, 95 aa, Chromobacterium substugae
MVRLTVYRTNSHIYAQIVDETGSKVLASASSLEADVRAELSNGGNVAAAAVIGKRIAEKAKAAGIEKVAFDRSGFKYHGRMKALADAAREHGLVF

SEQ ID NO: 8691 - protein, 172 aa, Chromobacterium substugae
MAKHEMEDRGDGLVEKMISVNRVTKVVKGGRIMAFSALTVVGDGDGGIGMGKGRSKEVPVAVQKAMEQARHTMVKIPLKNGTLQHTVVGKHGATTVFIQPAKEGTGVKAGGPMRAIFDAMGVHNVSAKIHGSTNPYNVVRATLNGLSNINTPAQIAAKRGLSVEDILGVGHE

SEQ ID NO: 8692 - protein, 61 aa, Chromobacterium substugae
MSNAKTVKVTLVKSLIGRLESHKACARGLGLKKIRQTVEVLDTPENRGMINKISYLLKFEG

SEQ ID NO: 8693 - protein, 143 aa, Chromobacterium substugae
MLLNTVQPGVGAKHAKRRVGRGIGSGLGKTCGRGHKGQKSRAGGFHKVGFEGGQMPLQRRLPKRGFKSLTARFVCEVRLSELNLLPVDEIDLLALKQAGLVSAQAQVAKVVLSGKVERAVKLRGISVTAGARAAIEAAGGSIE

SEQ ID NO: 8694 - protein, 380 aa, Chromobacterium substugae
MFNMFSGGALSRFTVFALGITPYISASIILQLAAEALPSLKQLKKEGDAGRRKITQYTRYATVLLATFQSFGIAAMLYRQPNLVMTAQWEFYLTSVVSLVTGTMFLMWLGEQITERGIGNGISLIICAGIASGVPGAIGKTLTQTSLGAMNALVAIALFVGVILVTYVVVFAERGQRKVLVNYAKRQVGNRVMQGQSTHLPLKLNMAGVIPPIFASSIILFPATILGWFGQGEHMSWLKGVADKLHPGQPIYVLLYAAAIVFFCYFYTALVFSPKETADNLKKSGAFIPGIRPGEQTSRYIEKIILRLTLIGAIYITLVCLLPEFLILKWHVPFYFGGTSLLIMVVVTMDFMAQVQSYVLSHQYESLLKKANFKGNALTR

SEQ ID NO: 8695 - protein, 351 aa, Chromobacterium substugae
MLTRRGIQFALGIQCTTRALQEKVGAFTTSELALRANITCHVLTLSELDTTFFGRTATVVRYRRHVGDAGDLEAQRVECANSGFTTRARAFNTNFQVLHTVFLGNFTSVLCSYLSGKGCTLARALKTSAARGSPRQCIALTVGDSDDGVVERSVNVHDTFANRLAHFFTYTDSCVCFSHSLCSLRLLLAGDRLTRSLAGTSVSASALTAARQATTMAHAAVAAHVHQTFDAHGDFAAQVTFNGELGNLITQSFHFSFSQILHLGGGIHAGCSTDVLSASLTDAEDCLQADNGMRMIGDVYPCNTGHTLSLSLKTLKSLRLYHANPGLTNVSLVFACDAGPCRSRVLRDCDE

SEQ ID NO: 8696 - protein, 127 aa, Chromobacterium substugae
MRRKGSTGENLLKLLESRLDNVVYRMGFGSTRAEARQLVSHKAIVVNGQVVNIPSYQVKAGDVVSVREKAKKQARIAEGLALAEQGGFPSWVSVDSKKMEGVFKSAPERSELSSDINEQLVVEFYSK

SEQ ID NO: 8697 - protein, 327 aa, Chromobacterium substugae
MQNSASEFLKPRLIDVQPVSATHARVSMEPFERGYAHTLGNSLRRILLSSMPGYAPTEVTIAGVLHEYSALDGVREDVVDILLNLKGVVLKLHGRDSVVLTLKKDGEGAVLASDIELPHDVEVINPEHVICHLSSGGKIDMEIKIEKGRGYQPVSVRSSHDDNRSIGTIQLDASFSPVRRVSFAVESARVEQRTDLDRLVLDIETNGVIEPEQAVRNAARILMDQLSIFADLQGTAVEEVVEKAPPIDPILLRPVDDLELTVRSANCLKAENIYYIGDLIQRTETELLKTPNLGRKSLNEIKEVLASKGLTLGMKLENWPPAGLEKP

SEQ ID NO: 8698 - protein, 112 aa, Chromobacterium substugae
MLRNMANSLLKHEVIVTTLPKAKELRRVAEPLITLGKKPSLANRRLAFDRTRDRDIVVKLFDVLGPRFSARNGGYVRILKYGFRKGDNAPMALVELVDRAEDAVAVVDDSAE

SEQ ID NO: 8699 - protein, 304 aa, Chromobacterium substugae
MNLQALIEDIRQQTLPFYDHGQVADYIPALASVPPHQFGMAISTLDGRHYACGDAEQPFSIQSISKAFMLALTLQADGEALWQHVGKEPSGNPFNSLVQLEYEHGIPRNPFINAGALVVTDRAIRHFGDAHRQLLDWLREESGAPGLAANERIAASEREHGDRNAALAHFMKSYGNLRHPVEQVLEQYFHNCSIEMSCRQLARAGLFLANHGVSPVTTRQYLSRSQAKQVNAVMLTCGTYDAAGEFAYRVGLPVKSGVGGGLLAVIPGKMSIAVWSPQLDSRGNSVLGLEALDRFTTRTGLSIF

SEQ ID NO: 8700 - protein, 265 aa, Chromobacterium substugae
MQLTSMFVHPLKSTRGIAFERAFAGKLGLLHDREWILTTPDGDQITARSHPQLVRVGVELMPGGILLHYEGKAPIFAMATAYTRPHRAQVWKDEFQAWHGDQRLDAWFADILGQECRLLWLGAQSGRAFKGGAEKMSFADGYPFLLVNQASLDDLNRQLQRPVTLRHFRPNLVIDGDYPWMEDEWQVIRIGEVEFDVMKPCTRCVLTTVDPDTGSKDADGEPLRTLVRTRRLEEGVCFGMNLRARNEGMLEIGAPLEVLQERYSF

SEQ ID NO: 8701 - protein, 63 aa, Chromobacterium substugae
MNEHAGQLHCYLHIAFQRDATTARPWSVAEWAPSCPTKRFLSAGHSKRCAVCKGAIAYIRPAI

SEQ ID NO: 8702 - protein, 625 aa, Chromobacterium substugae
MRSLRVKLIAFIALLLVVLGVVITILVYGQMRNEIIHGVENELDGTSKGYASLVSGWYKSKVGVVIAANPLVGETDPRQTLARLSQAGGFDMTYIGTAQHVMLRSDMKPQPQGYDPVARPWYQQAAASGNPGVSDPYVDFDTKKLVVTFVSPVKDGSGLKAVVGGDIFIDDLVKTVLSVKLRGNGYAFLTDKSGKVIAHPDNSLTLKPLTEKVPELTADRLTQLANSNEMGRISVGGEEKLVEVQPVDGTNWLLGVVTDESVVSSPLHTLLMTIVGLGALCVLILIPVASVMLSKMLAGLGRLRSAMLEISQGEGDLTRRIEVTGQDEIAETATAFNRFIGQLQKMFIAVKEEAEKVTGGVESVTQTVDKVAHDSRQIADVSSSNAATLEQITVSISHIADAAREADGLVTHTGDVSSESASGMQRISSEMNSTVEAVKGLSGMLSSLDQRSQQISGITNVIKDIADQTNLLALNAAIEAARAGEMGRGFAVVADEVRKLAERTGQATVEISGMVSTIREETSQAVSNMQRTVNSVDGGVELTMGAVERIEQIQKAMEEVMAKMNEITLSTSEQHKATTLIAQSTEQINGRIVDSDDALQTVRDTLSELSHSASSMRQLFSSFRV

SEQ ID NO: 8703 - protein, 545 aa, Chromobacterium substugae
MSLKTRLFGLMALVVLVVCALGVATVFSQRQAMMQDRQDKVRNLVESAVTLVSTYERLAQSGKISEADAKRTVSQVLSSMHYDQREYFFAYDADWNYVAHGAKPELIGKNLAGVKDPNGVELKDLFARAIASPGGGGFGEYVWNKPGFDKPQPKMSYVTTTPGWHWVVGTGIYLDDVNAAFRDQLLTLGVVLAVALLLLLGLGGLVLRNVLGQLGADPLETVAVVKRIASGQLAEPVSLKRGDQTSLMAAVSGMQEELRRLVRDIVADANQLSRMSGEVTSEAAVVGKGSEQQSEAATAMAASIEQLTVSVNHIADRSQDARDLASESGSRSKSGSAVIAEAVSEMRRINEAVDQTSGIITSLADKTDTISSIMQVIRDIADQTNLLALNAAIEAARAGEMGRGFAVVADEVRKLSERTAQATQEIATMIQDVQQGAQNSRSSMEEAVARVKAGLGLAEQAGDEIARIQDSANGVIAVVGDISFALQEQSVASQTIAQHVEQIAHSASSNAVATQAAARAIQNMDQLASNLRQLVARFSVGERSA

SEQ ID NO: 8704 - protein, 496 aa, Chromobacterium substugae
MRILILLLAAALAGALTVFSFAPYRLFWLMPLCLAALLELIQREPRRAFWIGYVWGLAAYTSNFHWLYASLHDVAGLPALIAAPLVLLLPAYLALYPGLAAWVACRVDPRPWVRYLVAFPAAWELGEWLRSWVMTGFPWAAAGYSQITESPLSGYAPIGGIHLVSYLVALSAGALMMLARSGMRLRLGIVIATSLLWLSGFWLRDVEWTAPQGKPISVALAQGNIAQELKWTPENLEQSLLTYYRQVAMTRADLMILPETALPLFLDDLPSGYLSMMRGEASRAGMALASGIPRRTNDGRGYLNAVVALSDPKMPYYAKDHLVPFGEFIPLPGLIGWIYQYMNMPLSGFSRGGANQPPLLLAGQKVAFNVCYEDSFGEELSGPAAQAGMLANVSNLAWFGKSEAMSQHLQLSQARSLETGRYMLRATNNGMTAIIRPDGEISAIAAPFTAQVLTGFAQSRQGLTPYMRVGNLPVALGCGLLLLAALALGWRRRGQH

SEQ ID NO: 8705 - protein, 283 aa, Chromobacterium substugae
MEDPSKPRPSWLERLSTMLLREPEDREELIELLHNAFERNLLDAEALGMIEGVLEVSELTVRDVMIPRSQMHVLNIDDPISRFLPTVIDSGHSRFPVIGESKDDVQGILLAKELLRYFHAPATFNLKNVLRPAVFVPESKPLNVLLRDFRATHNHMAVVVDEYGGVCGLVTIEDVIEQIVGDIEDEYDIEDDEDDIVPVRGNERYRVKALTEIEDFNHYFGTDYADDDVDTVGGLVISLTGHLPKRGEKIEAAGLRFTVLRADSRRLDSLLVERIQLSAGQAE

SEQ ID NO: 8706 - protein, 167 aa, Chromobacterium substugae
MKQAKRHPLLARLRARLELTLDVRSDAALPPPALIRRACQAALQRGVEKAQISIVIVDAAEGRQLNNDYRGKDYATNVLSFALNEGEPVAGLPLFGDLVLCAPVVEKEAAEQNKDLMAHYAHLLVHGMLHLQGFDHEEDDEAEAMEALETVIVKQLGYPDPYHEEQF

SEQ ID NO: 8707 - protein, 319 aa, Chromobacterium substugae
MSTTEPLSFNPVDNERLARLAGPLDENLKQIETGLDVVVQRRGETFRVQGEQAKLAVEALTRLYLLAAQQDVSIDDVQLSLVELRQRQTSGEQEESPVLATRRGDLKGRTPNQARYIKAILQHDVTFGIGPAGTGKTYLAVACAVDAMERDAVKRIVLVRPAVEAGEKLGFLPGDLAQKVDPYLRPLYDALYDLMGFDRVTRLFEKNLIEIAPLAYMRGRTLNHAFIILDEAQNTTPEQMKMFLTRIGFGSRAVITGDVTQIDLARHQKSGLVEVERILGQVRGIHFHHFNSQDVVRHPLVQKIVDAYDTYQSKQDETS

SEQ ID NO: 8708 - protein, 223 aa, Chromobacterium substugae
MKPQGIRAILLDLDDTLFDDAYASAQAFAAFIGPHASRFSQPPDALQARWRGCIDRHWRRFELGELSLAQQRHERLRDFLGAPDMSEAEAALLFQPYMDAYRRHRRLTPGAADFLDATRHLVRIVVSNGGAEQQRAKLEHLGIAHHFRHLLTCDAVGAAKPDARIFRRALELAGQEARACLMVGDDLERDIEPARRLGMAVRHVAPGSHAAIFATLSQQLRNA

SEQ ID NO: 8709 - protein, 95 aa, Chromobacterium substugae
MYVVSLSYTAPLSDIDALLPAHVAWLNQAYADGLFLASGRKVPRSGGVILARGERAALEARLADDPFAKAGVARYDIIEFVPSMTAAGLEGLKEA

SEQ ID NO: 8710 - protein, 444 aa, Chromobacterium substugae
MKKVYIKTFGCQMNEYDSDKMADVLGSTEDMVKTDTPEDADIILFNTCSVREKAQEKVFSDLGRVRPLKEAKPGLIIGVGGCVASQEGDAIVKRAPYVDVVFGPQTLHRLPEMIRAKRDSGRAQVDISFPEIEKFDHIPPAKVDGAAAMVSIMEGCSKYCSFCVVPYTRGEEVSRPFEDVLTEIAGLAAQGVKEITLLGQNVNAYRGLMADGEIADFALLLEYVHEVPGVERIRFTTSHPREFSQRIIDCYAKLPKLVSHLHLPVQSGADRVLMAMKRGYTSLEYKSIIRKLRAIRPDLCLSSDFIVGFPGETEADFEQTLKLVTDLAFDFSYVFIYSPRPGTPAANLADDTPHAEKVRRLEALNAVIEARGFEINKAMVGSVQRVLVENVSRKDDAMLAARTANNRVVNFAGHPRLLGQMIDVRITEARPHSLAGEALVHESV

SEQ ID NO: 8711 - protein, 125 aa, Chromobacterium substugae
MKKPIAALCLCLALPAAAGRLLPDSLVMGKLGDQNAAGIAFVRADQTFLQRLGGLIAVPPPRFALAPGLRIFDGGNRFLLSGQLNDLRGKTVGVTFDPQGSINRIWVLGDDEIEALKQRQARTTP

SEQ ID NO: 8712 - protein, 400 aa, Chromobacterium substugae
MPHDTPLITTIVGGLVFAFAFGMLALRLRLPPLVGYLCAGILVGPFTPGFQADTALAPELAELGVILLMFGVGQHFSIKDLMAVKAIAVPGALAQIAVATLLGMGLSHFLGWPLGEGLVFGLALSVASTVVLLRALEEHGWLETEDGKIAVGWLVVEDLVMVLTLVLLPAVAGALGGAQAAPSLEQLGWTLMLTVGKVAAFVALMLVVGRRFIPWMLERVVHTGSRELFRLGVLATALGVAYGATQLFQISFALGAFFAGMVMAESPFSHRAAEESLPLREAFAVLFFVSVGMLLNPQVLLNDAPTLLATVLIIVLGKSLAAYGIVRLFRRGRATSLRIAASLSQIGEFSFILAGLGMSLGLLSPRGQALILAGSIVSILLNPMMFALAERFRPAALAAE

SEQ ID NO: 8713 - protein, 49 aa, Chromobacterium substugae
MPAPASPTPPRGLAPPAFHLMALRLAPPPRTPHREQIKARGLASRHDES

SEQ ID NO: 8714 - protein, 233 aa, Chromobacterium substugae
MDDTSVRLSKRMVELGLCSRREADACIEQGLVKVDGKVVNTLGARVRPEQEITLAGKPQALAALPVTMLLHRPAGEDAPPAQLLGQDSRSPQDASEQVWLARHRQHLSAFGAVDEQCHGLLVLTQDKKLPRHLAECEMEFLLQVEQAPAADELKARVAAIRLDGKPLRQCKISRQSDHQLRCAVYAPRAGFFAEISRQLGVRLQSARCIRIGRLALAGLQPGQWRYLQPFERF

SEQ ID NO: 8715 - protein, 173 aa, Chromobacterium substugae
MAAENEGPEVTFTSLGQTALADGSVCVAGGETEDFVDSKSVVLVKKNGAVRQRIALPLPDPNYSDGRAMACLQKGAALYVVEELDTSSIMTDKRTLLFVDRIEHGRLQKRVMLPVRYSSQNFGVARVGEGPAAFMWDGAGQLVVRGKVYRDAMGGKPGKAFSVKLQADLTVAK

SEQ ID NO: 8716 - protein, 778 aa, Chromobacterium substugae
MAEKKHYSQQDKINFIVSLYPAAREASRKSGMSWELILAQAAQETGWGEKVLPGSNNVFNIKTGSSWKGDSKVYHVWEKQNGKKVWVDDAFRVYPSVADSLADRMQMLQNSSRYAKAGLMDPGVKGNMEKEAHALKKGGYATAENYAESMIELFHGRTMRHALAEARKRHPEFDAAGQAKPAVASQAPHSSAAQASPPPVKAVSASVAHDKPAQPVAAHAAQQQAQQPKQSQPSAAAASAPSAERVQTLLPEAQQHLVQEAKNAVQALQQRDARLQKLDAAQLDNLSGQLAVDAARQGMAKINGAVVNAADPGKISLVGQDAGNKLQQVSAEFGAAPAAPSPNQPASTVAAQPQSGASPAQPTPAKPVEQAAAAKPQIEQAKPAAPQAAHVSHPPAQGAHGPAKATAPAGPAQSAHAQHMPAQAAHAQAKAAAHAGQDKSQHPQPVAGNDRGSRMVNAALEHFGDGTFEYGRADMAGQLANKKKPNGNRIDGSRLEADTDHDGKKGVDCSSLVWRTLQLGNTKVTDDFKSAANFTTHTLFNGGHGGQHPHANITDYAKRNFNVIDNKKDLQPGDILMFKMAGGGQHVAVYKGKNEKGEQMFYGSQTSTGPAEVNLSSNPYWSKQAFLGALRPKDDFYKPDAAPQAAQHAGLSDGKQSLLEQTRQHVGSLQQRDGRLKDLASHQVDNLSAALAVEGWKKGIEKVGAVMVNAVDPGKISMLYKSAANKVEHAAVELRDAIKQSAQHSLSLLAAAPEHGQPAAKAQAHQPPARAKQPAMGM

SEQ ID NO: 8717 - protein, 198 aa, Chromobacterium substugae
MNHAGLNMQAYGLAGQQALPKYEGSLKPVNNANDFDSIPAPIPHSRLNHRQTNPLPENRTLLQKLLTENDALSPEKQKFATQTAQAVEALQRREPKLAALQPGQIDNLSASLAHSGWKNGMAKADGAVLNAADPGTATLIGRDGGQKIQHASVEVDSAIRQPAATALAALAATPDKAAPAPAQAVRTASRSAGGMSLG

SEQ ID NO: 8718 - protein, 288 aa, Chromobacterium substugae
MGRSRAGDYARRFTRVFDHIDQHLQQPLNIERLSQVAHFSRFHFQRQFAAYCGASVARYIQLQRLRRASYQLVFQPLLRITDIALDAGFENPESFSRAFKHAFGQTPSAFRRAPDWAHWQTRFPVPVRERMEDMDVKIMVVDTVRVAALEHRGAPERVNDSASRFIEWRKESGLSPLTSSQTYGIAYDNPDTTAAADFRFDICGSVAGPVPANRQGVVAKEIPGGRCAVLRHVGSHQRLGESVYCLYRQWLPSSGESLRDFPVYFLYLNLVGATPEHLLQTDIYLPLS

SEQ ID NO: 8719 - protein, 567 aa, Chromobacterium substugae
MQALRIVLLSSAFNGLTQRAWLELRESGHEPSVVLFNDADDVCRQIEAAAPQLVICPFLKDRVPARLWRDAPFPVVIIHPGIVGDRGASALDWAISLQQKRWGVTALQAVEEMDAGPVWSSREFDLPAGLRKSELYNGLVSDAAIYCLRDVVEKFVGGYQPQAVDYADPAVRGRLQPNMKQADRAFDWREPAEAIKRRIDAGDGQPGVLADLAGGRYYLYDAHLDHRRGSPGQILAVHDDAVLVATGDASLWLGALRRAPEAGEETFKLPARHLLADLLDEVPRLEWSIATHPHCEESYQPIRYRRVGKVGELTFEFYNGALSTEQCRRLQRALQWAKRQDCEVLLLRSGRGSFCNGIHLNVIQAAQDPGAEAWRNIQAIDDVCLEILTAPQLVVAGVAGNAGAGGAMLALAADVVLARQGVVFNPHYQTMGLYGSEYWTYTLSRAVGAETAVKLCNDCLPLGARQAWRLGMVQDIGPRDEQEFGRWLLQAAKQALLTPAWQAWRERKETLDLAQLERCRQAELGEMRLDMLRNRRQFIEKCGNFVHKRRACGTPQRLVAPWARQGG

SEQ ID NO: 8720 - protein, 550 aa, Chromobacterium substugae
MGWQTHEVSNQFDELTDYKLLDSDPALGEALSRAGAEWAVPWLRGYGETLGRAETFELAEEANLFPPRLRAFDRRGRRVDQVDFHPAWHRLLQMYRGQGLVSLPFAEERGGRWAATLAGSYLHGQVEAGTLCPATMTQAAIPLLRREPALWEVLRDKLFSHVHDGRDLPLAQKACAWIGMGMTEKQGGSDVRANTTRAEPLGHGGRGGEYRLRGHKWFFSAPTSDAHLVVAQLADSGPSCFYVPRWLPDGSRNAVAIQRLKDKVGNRSNASSEVELQDAWGVLLGEPGRGIPTIIEMATYTRLNCVIGSAALLRQAATQALAYTRRRMAFGKVLAEQAAMRAVLADLALESEAALALAMRLAQAFERDGEPAERAWKRIVTPAAKFWVCKRAVEWSGEAMEIFGGNGYVDAGPMARLFREAPVNSIWEGSGNVMCLDVARAVRREPEAWERLLADLAAMAAGEAGLTDAIGDLRAQAQAGPEQLEARGRRFAQLLALTAQACLLRAQSPAFIADAFIASRLRDAAWGRVAGALDAGGMDVESILRRSLPV

SEQ ID NO: 8721 - protein, 343 aa, Chromobacterium substugae
MHNSAPNFSVITGDFIHGALAQAKTEVIDIIRQAYLLHHQRKTVNPDSYFLRFADRPEARIIALPAAIRDADSALEVSGIKWIASYPGNVDANLQRASAVVLLNDYRTGYPFACLEASQISSARTAASAVLAAQQLWPHGRRAGSLAIIGGGVIAGSILSFFDAAGWHFDDVRAYDINDAHLAAFTRNMGASLRYPIRAASRDEALQADIVVLATTAGTPWIPAGHAFAPSQLILNVSLRDLAPETIVGANNVLDDVEHCMKANTSPHLAEQRYGHRGFIDGTLAQVMQGEIRLDPAKPTIFSPFGLGVLDLCLAMFLYRKSETEGASHPVPGFFADTQRWNG

SEQ ID NO: 8722 - protein, 329 aa, Chromobacterium substugae
MRYDSIEQAVSDDIFLRLEQFSPSGDVHLKIEGFNPGGSIKIKTAMALIRDAEERGQLAARKKIIESSSGNLGLALSQIAAARGYDFVCVVDKNTSAQNIGMMRALGTTVVVIEQRDEHNGYLGNRLAYIRQAIARDPERIWLNQYQNPANPAVHADMTARAILNEFGSVDYLFVGAGTTGTLMGCAAFFRGHSPQTRLIAVDSVGSVTFGTPGQARYLPGLGSSVQPHFFDAAAVDRLIQIPEAETIAACRDVALRYGYLGGASTGTVLAAVRRLHAELPADAVVVAISPDLGNGYLDTVYDDDWCDQRFGPAWRQASQPLNENLTYA

SEQ ID NO: 8723 - protein, 143 aa, Chromobacterium substugae
MNPRPIETAAARPKLALLPPDRLKPTEEFLPERLGEVAARVLADGGWKTPILVERRTLVVMDGHHRREFALRHGLMLVPCLLLDYADVALEARRDDLLVTPEEVIARGLEGRPYPPKSTRHTPVPALDCSCWFALDELLPPRA

SEQ ID NO: 8724 - protein, 205 aa, Chromobacterium substugae
MGNRISPDYATPHSPQPLTGAPAVLWLTGISGAGKTTIASHLKQLCLASGHAAAMLDGDELRGRLNADLGFSESDRAENVRRIAEVAALMADAGLLVIVSCISPLASFRLAARDIVGAQRFVEVYIDTPIDVAEARDPKGLYRLARAGKITGFTGLHAAYEPPREPAIRIDTTVTGVEAAAERLLGHYQAMARAAATRAEAGVCG

SEQ ID NO: 8725 - protein, 427 aa, Chromobacterium substugae
MALAALRAWWADLSGPFAYRTFTVVWLTSLAANVGYTVQGVGASWAMASMAPTPTMVALVQTAASVPIALFALLSGVAADAWDRRAVMLASQALVFAVAAALTGFSAAGYLAPAMILACTFLNGCGAALFQPTWQSSVAEQVPRSQLSAAIALDSFSLNFARAAGPAFGGLIVARFTPGAAFLISALAGAVMIAALLSWKRPPPRRHPREKLLAALAGGVAYCWRARRMRDALFRSALFGFLGSPVWALLPLFAKQQFGGAAGTYGMLLAAFGVGATAGALGGAALRARHAKETVVRGGAFAFGLGIIAAAVSPALPGTLLGLSVAGASWVASVSTFNLSIQTGAPDRLAGRALSLFHSCIIGGMSLGSFAWGCVAEPLGVGAALLMSGLLMSASCLLGWLLPLAEADEPDAVLAVSGAGGMDGHCK

SEQ ID NO: 8726 - protein, 483 aa, Chromobacterium substugae
MNKSEAMKTIAIIGAGFCGATLAARLLRQPPATPLRVVLINRSGPMARGVAYGSRTATQVLNVPVGRMDALSERGDGFYRYVRQRIADAAPGSFVARSLYGDYLEQLLRDAERDAPAGASLRTVVGGVAALRPRADGEGARLTLDDGSALDADRVVLCVGNYAPLDPPIAAAQRRFYASRRYIRDPWAPGALARVAPEQPVLVIGSGLTMLDILLELRERGHRAPIHAISRRGLAPQAHRALDNPPHYDESLLHAMLSEPTARNYLSLVRGAAARHARGGGDWRDIVGGLRARTPELWQALPLPERRRFLQRLRPFWEVHRHRCAPQLGERLRAELASGSLRLLAGRAIAYRETGDGVEATLQPRGGGEALRLQVGAVINCTGPRGDVRRLDEPLLDSLQADGLLVPDALGLGFELDERYALRDSAGVASRWLHYVGPFLKGRYWEATAVPELRVHVARLAEALSLDCGDETRLRQPAQPASA

SEQ ID NO: 8727 - protein, 471 aa, Chromobacterium substugae
MLAREEAPPADAAWTPLRAGADGVPRACDMTADDWLLAYDVDAQLADGGAPAAAGLESALREIWQSVLGVEGLSATDNFFAAGGDSIASVQLAAQARAKGIALSAQDLLRHQTIAALAASASQASPERQPSQGRLALRPAQLAALDGGAVSRRLLQVPEEMDERFLQAWLRALHAGHDALRLRFARQGGEWRAEFRADADALAREARDGRAASSMPPQPQADAGPVLMAALEKGRDGARLWLSARQAAVDAASWRTILADLRAAFDEWRRRGAISARGAAGFGRYQEWCEKREGEPRQAAWLAAGGEWVLAPVAELDAARSAAMLESGLRKHRARPEELLLAAALLAACRWSGERALTLRLAQDGRAADAELAATVGQFDVERGLTLALAAGELAPGAAILAAKEGCRAQTQELGDAGRTARLAFRYDGDFDAPAAARAGIARLALPNDDDDAGGPPVRLRGRQGLKIARY

SEQ ID NO: 8728 - protein, 396 aa, Chromobacterium substugae
MAKEKFARTKPHVNVGTIGHVDHGKTTLTAAITTILSKKFGGEAKDYSQIDSAPEEKARGITINTAHVEYETESRHYAHVDCPGHADYVKNMITGAAQMDGAILVCSAADGPMPQTREHILLSRQVGVPYIIVYLNKADLVDDAELLELVEMEVRDLLSSYDFPGDDTPIVTGSARLALEGDQSEMGEPSIFRLADALDSYIPTPERAVDKPFLLPIEDVFSISGRGTVVTGRVERGIVKVGEELEIVGLKETAKTTCTGVEMFRKLLDQGQAGDNVGVLLRGTKREEVERGQVLVKPGSIKPHTEFSGSVYVLSKEEGGRHTPFFANYRPQFYFRTTDVTGAVTLAEGVEMVMPGDNVEITVKLIAPIAMEEGLRFAIREGGRTVGAGVVSKIIN

SEQ ID NO: 8729 - skipped

SEQ ID NO: 8730 - protein, 118 aa, Chromobacterium substugae
MEMQDKIKLALAGLVVAAGVVGFYLIPEGQDLLRALAFIVSILVAAGVVWASAPGKGLVVYANESIVEARKVVWPTRKEATQVTLMVFVFVAVLALFMWLVDSSLSWLFYDVILGRGR

SEQ ID NO: 8731 - protein, 160 aa, Chromobacterium substugae
MQKALRERIERSDIADQFGQILVPVEEVVDIKNGRRSITERKFFPGYVLVEMEMTDDTWHLVKSTPKVTGFVGGTGNRPAPISKREVEAIMQQMQEGVEKPKPKVLFEVGEKVRVIDGPFNDFNGSVDEVNYERNKLRVSVQIFGRDTPVELEFSQVEKL

SEQ ID NO: 8732 - protein, 108 aa, Chromobacterium substugae
MEFCKAFNAQTQGVEPGLPIPVVITAYADKSFTFIMKTPPATILLKKAAGIKSGSAKAHVDKVGKVTRAQLEEIAKTKQPDLTAGDLDAAVRTIAGSARSMGLEVEGV

SEQ ID NO: 8733 - protein, 231 aa, Chromobacterium substugae
MAKISKRLQALKATVDRNKLYAVEEAIALVKTAATAKFDESIDVSVNLGVDPRKSDQVVRGSVVLPRGTGKSVRVAVFAQGANAEAAKAAGAEVVGFEDLAEQVKAGNLDFDVVIASPDAMRVVGQLGQILGPRGLMPNPKVGTVTPNVAEAVKNAKAGQVQYRTDKAGIIHATIGRASFEAEALRENLSALVDALVKAKPAASKGVYLKKIAVSSTMGVGARVDTATVNA

SEQ ID NO: 8734 - protein, 128 aa, Chromobacterium substugae
MTKLRAQARANGVFLRVLKNTLVRRAVEGTPFADLADQMVGPLVYAISADPVAAAKVLHQFAKADDKIIVKAGSYEGKVLSAAQVAELASIPSREELLSKLLYVMQAPVAGFARALAALSDKKQAEAA

SEQ ID NO: 8735 - protein, 123 aa, Chromobacterium substugae
MAITKEDILEAVAGLTVMELNDLVKAFEEKFGVSAAAVAVAGPAGAGAAAAEEKTEFDVVLTAAGDNKVGVIKVVRAITGLGLKEAKDLVDGAPKNVKEGVSKAEADDVAKQLIEAGAKAEVK

SEQ ID NO: 8736 - protein, 1391 aa, Chromobacterium substugae
MSYSFTEKKRIRKSFAKRASVLDVPFLLATQIDSYTEFLQLGKPLDERKDVGLQAAFKSIFPIVSHNGYAKLDFAHYILGEPPFDVQECQLRGITFAAPLRARIRLTIFDKESSKPVVKEVRENEVYMGEIPLMTTNGSFIINGTERVIVSQLHRSPGVFFEHDRGKTHSSGKLLFSARVIPYRGSWLDFEFDPKDLLYFRIDRRRKMPVTILLKALGYSNEEILSEFYSFDTFYLTRNGVFMRVVPDRLKGEVAKFDIVAADGKLIVAKDKRITAKHIRDIQTAELDRIEVPADALLGKMLAHNVVNQNTGEVISRANEEVTEEVLAKLALADIDQVDVLFTNDLDQGAYISQTLRSDDIQDQLQARVAIYRMMRPGEPPTEDAVEALFQRLFFSEETYDLSRVGRMKFSSRTYQYKFDDKTPEWFKSLIGDKFASRRDVMEGTLSTEDIVSVIAILTELRNGRGEVDDIDHLGNRRVRSVGELAENQFRAGLVRVERAVKERLNQAESDNLMPHDLINAKPVSAAIKEFFGSSQLSQFMDQTNPLSEITHKRRVSALGPGGLTRERAGFEVRDVHPTHYGRVCPIETPEGPNIGLINSLSVFARTNEFGFLETPYRKVVDSKVTNEIDYLSAIEEGRYVIAQANAELSEDGALIDELVTCREKGETILATPDRVQYMDVATGQVVSVAASLIPFLEHDDANRALMGANMQRQAVPCLRPEKAFVGTGIERSVAVDSGTTVVARRGGVVDYVDAGRVVVRVNDEEATAGEVGVDIYNLTKFTRSNQNTNINQRPIVKVGDHIARGDVVADGASTDLGELALGQNMTIAFMPWNGYNYEDSILISEKLVAEDRYTSIHIEELSVVARDTKLGPEEITRDIPNLSERMAGRLDESGIVYIGAEVEAGDVLVGKVTPKGETQLTPEEKLLRAIFGEKASDVKDTSLRVPTGTVGTVIDVQVFTREGIERDKRAQSIIDSELKRYRLDLNDQLRIFDNDAFSRIERLIVGKVANGGPKRLAKGTVIDQEYLAGLPTKHDWFDIRMSDEDIAKQLELIKESLAQKREEFDLKFEDKKRKLTQGDELPPGVQKMVKVYLAVKRRLQAGDKMAGRHGNKGVVSRILPIEDMPYMGDGRPVDIVLNPLGVPSRMNIGQILEVHLGWAAKGIGERVDRMIKEQQTAAEIRGYLERLYNETGRSEDLASLSDDEVLQLAQNLRKGMTFATPVFDGAKEAEIKHMLDLAYPDGDELTDKMGFNESKTQMTLHDGRSGEAFDRKVTVGVMHYLKLHHLVDDKMHARSTGPYSLVTQQPLGGKAQFGGQRFGEMEVWALEAYGAAYTLQEMLTVKSDDVTGRTKVYENIVKGEHKIDAGMPESFNVLVKEIRSLGLDIDLERY

SEQ ID NO: 8737 - protein, 1398 aa, Chromobacterium substugae
MKALLDLFKQVTQEEEFDAIKIGIASPDKIRSWSYGEVKKPETINYRTFKPERDGLFCARIFGPVKDYECLCGKYKRLKHRGVICEKCGVEVTLSKVRRERMGHIELASPTAHIWFLKSLPSRLGMVLDMTLRDIERVLYFEAFVVTDPGMTPMQYRQLLTEEDFLDKEDQYGEEFVAMMGAEAVKELLKKLDLDSEIETLRRELEATNSDTKIKKIAKRLKVLEAFQRSGMKPEWMILDVLPVLPPELRPLVPLDGGRFATSDLNNLYRRVINRNNRLKRLLELRAPDIIVRNEKRMLQESVDSLLDNGRRGKAMTGANKRPLKSLADMIKGKGGRFRQNLLGKRVDYSGRSVITVGPTLRLHQCGLPKKMALELFKPFIFHKLEVMGLASTIKAAKKLVEQEVPEVWDILEDVIREHPVLLNRAPTLHRLGIQAFEPVLIEGKAIQLHPLVCAAFNADFDGDQMAVHVPLSLEAQMEARTLMLATNNVLSPANGEPIIVPSQDIVLGLYYMTRDKVNGKGEGMVFADTKEVHRAYETRQVELATRITVRLKEWEKDEQGEFQPVIKRYDTTVGRAILSDILPKGLPFEHINKALKKKEISKLINVSFRRCGIRDTVIFADQLMYTGFAYSTRGGISICVDDMQIPKKKTELLGEANKEVKEIEEQYRQGLVTQGERYNKVVDIWGRTGDKIAKAMMDELSKQRVLDRDGKEVDQESFNSIYMMADSGARGSAAQIKQLAGMRGLMAKPDGSIIETPITANFREGLTVLQYFISTHGARKGLADTALKTANSGYLTRRLVDVTQDLVVIEDDCGTTNGFTMKAVLQGGDVIEALRDRILGRVTAVDVVDPSTGETVIEAGTLLDEQMVDSIDSLGIDEVKVRTAITCDTRYGLCAKCYGRDLARGKRVNAGEAVGVIAAQSIGEPGTQLTMRTFHIGGAASRNAAASQVEGKSNGTVRFSSQMRYVANTKGELIVITRSGEVVIHDDMGRERERHKVPYGATLMVTDGLQIKAGTVLATWDPHTRPIITEYAGRVKFENVEEGNTVAKQTDEVTGLSTLVVIDPKRRAGAQSKMLRPLVKLLDDNGNEVKLAGSDASVSITFQVGAIITVRDGQDVGKGEVLARIPQESSKTRDITGGLPRVAELFEARSPKDAGMLAEVTGTVSFGKDTKGKQRLIITDLEGSGYENLIPKDKHVLVHDGQVVNRGESIVDGPVDPHDILRLQGIEALARYIVQEVQEVYRLQGVKINDKHIEVIIRQMLRRVVISDSGDTEFIQGEQVERAEVLEMNDKMVAEGKEPAQYENVLLGITKASLSTDSFISAASFQETTRVLTEAAIMGKKDDLRGLKENVIVGRLIPAGTGLAYHRTRRRQQLGLDAAESQLFDSGMLNTALENDE

SEQ ID NO: 8738 - protein, 91 aa, Chromobacterium substugae
MCTRVYTTTPKKPNSALRKVCKVRLTNGFEVISYIGGEGHNLQEHSVVLIRGGRVKDLPGVRYHTVRGSLDTAGVKDRKQARSKYGAKRPK

SEQ ID NO: 8739 - protein, 156 aa, Chromobacterium substugae
MPRRREVPKREILPDPKFGSQDLSKFMNVVMIDGKKSVAERIIYGALEQIEKKSGKNALEVFNAALSNAKPVVEVKSRRVGGANYQVPVEVRPSRRMALAMRWLRDAARKRGEKSMDLRLAGELLDAAEGRGGAMKKRDEVHRMAEANKAFSHFRF

SEQ ID NO: 8740 - protein, 49 aa, Chromobacterium substugae
MHFTDLVVHTGVKQNTLGSSSLTGVNVSGDTDITVALKGGFPCHDLHLE

SEQ ID NO: 8741 - protein, 657 aa, Chromobacterium substugae
MHDGAATMDWMEQEQERGITITSAATTTYWKGMAMQYPAHHFNIIDTPGHVDFTIEVERSMRVLDGAVMVYCAVGGVQPQSETVWRQANKYKVPRIAFVNKMDRQGANFFRAVEQVKTRLRGNPVPIVVPIGAEDSFTGVVDLLKMKAIIWDEASQGMKFEYGDIPADLVSVAEEWREKMVEAAAEVSEEMMDKYLGGETLTEEEIVAGLRERTLKCEIQPMLCGSAFKNKGVQRMLDAVIELLPSPLDVPPVPGENEDGTPTTREASDDASFSALAFKLMNDPYVGQLTFFRVYSGVVKSGDTVLNSVKGKKERIGRIVQMHANDRKEIEEVHAGDIAAAIGLKEVTTGETLCAIDAPLILERMEFPEPVIHVAVEPKTKADQEKMGVALNRLAKEDPSFRVRTDEESGQTIISGMGELHLEILVDRMKREFGVEANVGAPQVAYRETITKTVTDVDGKHVKQSGGKGQYGHAVITLEPSGEGQGYKFVDEIKGGVIPREFIPSVDKGIQNTLSNGILAGFPVVDVTVRLTFGSYHDVDSSQIAFELAGSLAFKEAMRRAGPCILEPMMAVEVETPEEYMGDVMGDLNRRRGMVQGMDDDGLGGKIIKAEVPLAEMFGYSTDLRSATQGRATYSMEFKHYSQAPKHVADAVMAAKK

SEQ ID NO: 8742 - protein, 390 aa, Chromobacterium substugae
MAKEKFARTKPHVNVGTIGHVDHGKTTLTAAITTILSKKFGGEAKDYSQIDSAPEEKARGITINTAHVEYETESRHYAHVDCPGHADYVKNMITGAAQMDGAILVCSAADGPMPQTREHILLSRQVGVPYIIVYLNKADLVDDAELLELVEMEVRDLLSEVVGRQQIAHFHFNQFQQLGVVNQVSLVQVNDDVRYANLTGQQDVAQRDANHTTGRRWIHNVGQHLSLFVAGVKDKVALKLIAAKGKVQVQAQSDAMELTADQDLSITSVKQKIHLNGKQEILLTSGGAYVRIKDGKIELHAPGTVSFKGGSHDWSGGTSLGQTYNAMPQAKFDDRFQLVDQHTGQPLVNHKYEIHREFGGVERGYTDSEGFTHMIKNPDAAESIEIKIFK

SEQ ID NO: 8743 - protein, 121 aa, Chromobacterium substugae
MSNVSPFVPPAAPRPAPLPATAAALVELRQVIAKLQSPHDPTCPTTLRLSMERLAQLDRDIEQALSASSHTLARVSEGMQSLLNLLLLADATPLPSRQLFSLISPLHRQLLQARYQLEGRV

SEQ ID NO: 8744 - protein, 128 aa, Chromobacterium substugae
MTHHTELAPHTSAQARAANRRPQPAKPTAALAGLKQALAQLQAMLADPDLASLNQPLARLNELCGDIEGAVVAAICHLADGQQSQHAVRDLLTCLGDDLRLPSSRLRELLLPLDARMDKALTLLAQVR

SEQ ID NO: 8745 - protein, 106 aa, Chromobacterium substugae
MSQPSLLAMHRLHDAFAALQDQLARKPQACARVPAAQLAHLCRDIEDAVVETICHLAHSQLGLQALLDLLACLGDDVRLPSSRLLQLLQPLDKRVEASLSRLTGVL

SEQ ID NO: 8746 - protein, 308 aa, Chromobacterium substugae
MSRLSQSQKVAQLLRSHPGQRFTARQIASTIVHQYPEDYADKRSNPRFANDKAFLSQVVAEIGAQKDAIIGADSRIRWQDKPRPRVYWYETTDAVVETVIEEDEDDSPAAEQADLSEYQLYPLLMQYLQTELSLYGLRVDEKRSRNQRGSGGNHWLHPDLVAMQPVAKDWHELVRSCVLHGGGQSVRLWAFEVKKELTRGNVRKSFFQAVSNSSWANEGYLVCTGIVGKDTEDELRMLSALHGIGVIVLDSSNPSESEIVVPARARQDVDWQSVHRLVEENEDMREFVELVSTYYQTGRLRPQDWNKC

SEQ ID NO: 8747 - protein, 539 aa, Chromobacterium substugae
MTEQNQKQLGNTLWSIADQLRGAMDADDFRDYMLSFLFLRYLSDNYETAAKKELGRDYPKDDEYGCQVPLARWYDANESDIPAFEKQMRRKVHYVIRPEHLWNSIANLARTQSKYLLSRLQDGFKYIETESFESTFQGLFSEIDLSSPKLGKTYEDRNAKLCTIIQKIAEGLAEFSTDIDALGDAYEYLIGQFAAGSGKKAGEFYTPQQISDILSAIVTLDSQEPKTGTKKRLESVMDFACGSGSLLLNVRKKVAKAGGTIGKIFGQEKNITTYNLARMNMLLHGVKDTEFEIFHGDTLLNEWDMMREQNPAKRPSFDAIVANPPFSYRWEPTDALADDVRFKSHGLAPKSAADFAFLLHGFHYLKDEGVMAIILPHGVLFRGGAEERIRTKLLKDGHIDTIIGLPANLFYSTGIPVCILVLKKCKKPDDVLFINAAEHFVKGKRQNQLSDEHIAKIIDTYQQRPEKPIERYARRVEMAEIEKNDFNLNISRYISTAVAEEEIKLDELNQTLGDIEQEIAKAKAKHNTFLKELGLPLLP

SEQ ID NO: 8748 - protein, 336 aa, Chromobacterium substugae
MTDLILYTTEDGRSQIKLRAQEQTVWLTQLEMAELFDASKQNISLHLKNIFEDRELDAAATVKESLTVQIEGSRKVQRPVTLYNLDAILAVGYRVRSPRGVQFRRWASTVLKEYLTKGFVMDDERLKNPDGRPDYFDEMLARIRDIRASEKRFYQKVRDLFALSSDYDKTDKATQVFFATVQNLLIYAVTQKTAAELITARANVADPNFGLLAWKGNKVRKADIVVAKNYLTEDEIDTLNRLVVIFLETAELRAKSKQETRMAFWKQNVDQIITFNGFPLLTHAGTISHEQMEARTGELYLQFDQNRKRQEAIAADQQDEIDLKALENTLKRRAKP

SEQ ID NO: 8749 - protein, 395 aa, Chromobacterium substugae
MSGKPTINSYANLQTLAKKLRSDLTGIDLILLYAYNRTGKTRLSMEFKDDGKRKTKKNPDGIADTLYFNAYTEDLFTWDNDLDGDKVRQLQLNANSTFFNGLKDLALDATIAGYLDRYADFDFDIDYETWKVSFRKGEDENIKISRGEQNIFIWCLFMAICERMLDGHVSYQSNKYLYIDDPISSLDDNNAIAVACDLAKLLRRAASRKDESGALAPIKVVFSSHHALFFNVMCNELGRTKEGETKVSHRRYFLHRPNGDGKYTLRATEDTPFFHHVASLAELQLAAAPGTGKLYTFHFNALRSIMEKTASFFGHADISFCLKALNTEDVALYNRALNLLSHGKYAIHEPTEMGEDNKDLFRRIFRDFTTQFQFDLPEILATTPAVAAPVPEPAP

SEQ ID NO: 8750 - protein, 442 aa, Chromobacterium substugae
MSSKNKTTAMTGEKKPTLVPKLRFPEFQSAGDWTTVKLGAIATICTEKVGKNICVPMSITSGVGLVSQEEKFGRVIAGDSYRNYLLLKPYDFAYNKSATKEYPEGFLTLYSGTELAAVPNSIFTCFRINGESPDALFLNYQFSDNIHGRWLRKFIQVGARAHGSLSINDSDLMALPVPIPTGTTPLAEQQKIAECLSSLDELITAQARKVDALNTHKKGLMQQLFPREGETLPSFRFPEFQKEGNWKVLPLAVLTDKIMVGIASAATHAYRETGVPMLRNLNIKESGIDDSSLLYIDPTYEATHKNKRLRAGDVITVRTGYPGLSAVVTKPFENAQCFTSLITRPKADILDSNYLCLYINSPIGKKFMLGAEAGGAQKNVNAGALETLEVYLPQLEEQRKIATSFSSLDALIAAETQKLEALKTHKKGLMQQLFPSSEEVEA

SEQ ID NO: 8751 - protein, 1017 aa, Chromobacterium substugae
MNTHERQIEHDFIAKLNELKYTIRSDINDRAALENNFREKFEALNRVRLTDAEFKRLHDEIVTSDVFTAAKTLRSINAFTRDDGTPLNYMLVNIKDWCKNHFEVIHQLRINTDNSHQRYDVILLINGVPCVQIELKTLGVNPRRAMEQIVEYKNDPGNGYSKTLLCFMQLFIVSNRDRSYYFANNNSRHFAFNADERFLPIYEFADEDNRKITQLDEFAEHFLKKCDLGRTISRYMVLLAGEQKLMVMRPYQVYAVQHIIKCIDEDNGNGFIWHTTGSGKTLTSFKASTLLKENEHIHKCVFVVDRKDLDRQTREEFNRFQEGCVEENTNTAALVRRLLSEDYADKVIVTTIQKLGLALDENSKRNKQRSKSGQATYKEQLEALQDKRIVFIFDECHRSQFGDNHKAIKAFFPKAQMFGFTGTPIFGGEDGNATRIKIDGEVASYQTTEELFHKQLHAYTITHAIEDGNVLRFHVDYFKPEGKKPPKPGEAIAKKAVIEAILAKHDAATAGRRFNAILATASINDAIEYHALFKTMQAEKQAADPDFKPLNIACVFSPPAEGNSDVKQIQEDLPQEQADNEEDPEGKKAALKTILADYNTRYGTNHRLSEFDLYYQDVQKRIKDQQWPNSDYPATQKIDITIVVDMLLTGFDSKFLNTLYVDKNLKHHGLIQAFSRTNRVLTSIQTDDKKPNGTKPFGNILDFRQQKDAVDAAIALFSGEKSEEKAREIWLVDKAPLVIQRLETAVQKLDDFMKSQGLACTPSEVANLKGDAARAAFVTHFKEVQRLKTQLDQYTDLSEDNKATIEQVLPNDNLRGFKGQYLETAKRLKDQQNKASGKDDSTEDPLDQLDFEFVLFASAVIDYDYIMGLLANYSAKEPGKAKMSREELIGVISADAKFINERDDIAAYIATLQAGEGLSLAAIEEGYTRFKAEKNATQLAAIAAKHGLDTAALQNFVDSILDRMIFDGEQLSDLMAPLDLGWKARTQAELALMEDLHPLLTQRAAGRDISGLSAYEQ

SEQ ID NO: 8752 - protein, 796 aa, Chromobacterium substugae
MSEQEYGADSIKVLKGLDAVRKRPGMYIGDTQDGTGLHHMVFEVLDNAIDEALAGHADTIKVTINPDNSVSVEDNGRGIPTDIHPEEGRSAAEVIMTILHAGGKFDSNSYKISGGLHGVGVSVVNALSDWLKLKIWRDGKVHEMEFRRGDAVAPLTVTGHTSHRGTEVTFFASVETFGHIEFHFDILAKRIRELSFLNQGVGIQLIDKRSGKEENFAFSGGVAGFVEYMNRNKNVLHPKTFYGIGEKDGMTVEVAMQWNDSYQENVQCFTNNIPQRDGGTHMTALRQVMTRTLNQFIEESEVAKKAKVDTTGDDMREGLTCVLSVKLPDPKFSSQTKDKLVSSEIGPVVNEVISEALKTYLLENPNDAKIICGKIVEAARAREAARKAREITRRKGIMDGLGLPGKLADCQEKDPSLCELYLVEGDSAGGSAKQGRDRKFQAILPLKGKILNVERARFDKMLQSQEVATLITAMGCGIGKDEYNPDKLRYHRIIIMTDADVDGAHIRTLLLTFFYRQMAELVERGHIYIAQPPLYKAKHGKQERYLKDDYELNQYLLQLALEKAELIPAEGEAPLAGDTLAEIARQFLLTRAVIERESRVIDPLVLEAMLKSGPLSLQSQAEAAACVAALQALLPAETIDLQLLRDEKNDGHLVKIIRKLHGNVLVTVLDQNFLDSGDYAELKKTGDLLNNLLRDGAQVKRGETVRPVAEFGEALDWLLAEVKKGMNIQRYKGLGEMNPEQLWETTMDPTVRRLLKVRIEDVMGADDVFTTLMGDEVEPRRQFIEGNALIARNIDV

SEQ ID NO: 8753 - protein, 369 aa, Chromobacterium substugae
MLILQAERDALLKPLLAVTGIVERRHTLPILSNVLIEKKGGQVGFLATDLEIQITTASADELPGEDFRLTTSAKKLQDILRAIPGNATVTLEQLDGGRLTLKAGKSRFNLQTLPAEDFPLLSVGNASDSSFTLSQRELKRLISQVQYAMAVQDIRYYLNGLLMQTDGNQVRLVATDGHRLAFASADVAATLPKAEVILPRKTIIELYKLLQDSDDEIKIEVLANQVRFSFGATVIISKVVDGKFPDYNRVIPLDNEKIFLIERLEFLHALQRAAILANEKFRGVRLVLAPGKMSILCTNSEQEEAEEELEIAFQGGTLEIGFNINYLLDVLTNLPTDTLQLAFGDSNRSALFTIPDVSNFKYIVMPMRI

SEQ ID NO: 8754 - protein, 466 aa, Chromobacterium substugae
MTELDQFWPACLARLEAELSSQQFNTWIKPLTAEAGDEGVALLAPNRFIMQFIKDRFLGRIEELAVELIGECPVELRLGAPSAKPLQPAASSLPKAKEPAKAAASAPAAPSPAKQAAVKAIGGSHESTRLNPSFTFDTLVTGKGNQLARAAAMQIAENPGDQAYNPLFVYGGVGLGKTHLIQAIGNHVFQKNPQAKIRYIHAERYVADIMRAYQHKAFDEFKRYYHSLDLLLIDDIQFFAGKNRTQEEFFYAFNALIEGGKQVIMTCDSYPKQIEGMEERLISRFSWGLTVEIQPPELEMRVAILMKKAEADSIKLEHNVAFFIAQNVRSNVRELEGALKRVVAYARFTNQNITLELVKEALKDILAAGNRQVTVDAIQKTVAEYYKIKLSDMHSKKRSRDIARPRQVAMALAKELTQLSLPNIGDAFGGRDHTTVLHACKTINEMRANDADIAHDYDTLLAMLRN

SEQ ID NO: 8755 - protein, 74 aa, Chromobacterium substugae
MIQFGHYIHASESEKPAAGARLATAGEAACDLYRARRRRRRVFGMEAAGRLRWFGRGGLWALGAFICCAAGRQR

SEQ ID NO: 8756 - protein, 44 aa, Chromobacterium substugae
MKRTYQPSNTRRKRTHGFLVRMKTRGGRAVIAARRSKGRKKLAV

SEQ ID NO: 8757 - protein, 121 aa, Chromobacterium substugae
MSAYRFRRAHRLLKTDDFSSVFSLRQQRSNAFFQVYVRPNGLDHPRVGLVVGKKVAKRAVRRNYIKRCVREWFRLHRQELGGVDYVVRAKLAFTREQRGEAVTALSALFAKLARCHASSSS

SEQ ID NO: 8758 - protein, 69 aa, Chromobacterium substugae
MSRILILLIRFYQLAISPWLPPRCRYQPTCSSYAIEAVRKHGALKGGWLAARRIGRCHPWGGSGYDPVP

SEQ ID NO: 8759 - protein, 530 aa, Chromobacterium substugae
MGILFGWNEYFMPKHSQQQAAQTQAAAGASNAQQPADVNKLTRGQRIHVKTDLVEAEIDTVGGDLRSLQLLKHAAAEEHGKPFQLFEDDAKRTYVAQTGLVAASNPALPTHKTVFTAAQSSYQLTGDKLEVKLTAPDANGVKVSKVYTFSKGSYEIGVRYDIVNGGSAPVAPTAYYRLLRDSQAPEGEGRMAHTYTGPAVYTSEHKFQKVSFDDLAKGKGDYAKTTTDGWVAMVQHYFMSAWILKPLDAASVCKDDKSCRFELKQSNGLNSAAALVDYATIAPGKSLSVSVPLYAGPEEYSIISKLADGMEYAKDFGIFYIFSSPLFWLLVKLHALVNNWGWAIILLTLTIKAVFYPLTAASYRSMAKMKALAPRLERMKEQYGDDRMKFQQAVMEMYKTEKVNPLGGCLPMLIQIPVFIGLYWALLASVELRGAPWVLWYTDLARPDPYFVLPVLMTATMFLQTFLNPPPADPMQAKMMKIMPLAFSALFFFFPAGLVLYYVVNNVLSMSQQWYINRNINKQNKAALQS

SEQ ID NO: 8760 - protein, 110 aa, Chromobacterium substugae
MAWPRFICLLLAGGGSCLHRSGPLPQRERAPAHAFWRRHRDAFTASIIPQFQRFEAAFAANGSWQAEVRPLDYEREGAGGPASKKPGLGPGSVSSPDSALTIAARPCSAC

SEQ ID NO: 8761 - protein, 473 aa, Chromobacterium substugae
MQAASTASQQQADKSRPSHQGMSMNLSYTPATICAVATAPGRGGVGVIRVSGKDLLPFAQAISGGKSPKPRYATYTDFFDAHGQAIDNGLLLYFPGPNSFTGEDVLELQGHGGPVVMKMLLARCVELGARLAEPGEFTKRAFLNDKLDLAQAESVADLIDASSETAARSALKSLKGAFSKEIHVLVDELITLRMLVEATLDFPEEEIDFLKQADALGKLMRLRDRLVQVQATAKQGAILREGMHVVLVGQPNVGKSSLMNALAGDDIAIVTDIAGTTRDTVREEIVIDGVPVHIIDTAGLRDTDDVVEKIGIERTWQAVERADLALLLVDSREGLTAEVQAILERLPPALPRVQVFNKVDLSGEAAGLSVENGHPLVRLSARTHQGVDVLKAKLLEMIGYSGADEGVFLARQRHLDAIARAAEHLELAHADWEQVEIFAEELRMAQNALSEITGEFSADDLLGVIFSRFCIGK

SEQ ID NO: 8762 - protein, 164 aa, Chromobacterium substugae
MLRRWLGVLFGILMASGAALAAEDPVILTVSGQIGKWTNNKSRTYEFRESDLQALSQHAITTRTSWTPEAVFSGPLMRDILRRVEARGGQVKFVALNDYAYTVSRDELEKYNVILARSFNHKPMAIKERGPLWLMYPLPDMPAEERGPLLDAKLIWQVYRITVY

SEQ ID NO: 8763 - protein, 584 aa, Chromobacterium substugae
MNMADGESSASKQPSWLLWGLSPIFWLVVLLVSISMYIAVDRYAAIKKFDGRSEDLYWSVAQLQIALERSRAELVRLKAGEISPEQADIRLEIAKSRYQDYVTPSTLHGMLNAVPGFRETADMLGNFFRDGNIGHLSRDSAQRHIDQIDDIRPRLAEFAVQSRMSEVSFRDERNKDLERKRLVFSLWFALWGGIVIVIWVLLSSYRRARRDVASRQALLEKERAAHKATVSAELDRTTFLATISHEIRSPLQTMQVCVELMELDVQPGNRIHANLMRLKASMSHLLSQVRDIMDISAINNMQLRLHPEDVSLAGILTEVVDAYRVQLEGKGLRLHFAMANLPETATLDGNRLRQVVGNLLANAIRYTDHGEVSVTARVDGVRGFHHLEIRVRDTGVGIPADYQSRIFQPFFQGKQRRPGSSGLGLAIVKELVSLLGGEIELNSEEGRGSEFIVRLPVRIQPEEGGHERSVLLVDDDQNIREPFADCLSLDGYAVVMASSVAEACQQVQQRPFDAILLDMQLGNESGYSVLEFIRKSRNNQQASIIAMTAYPEEYADPRSACFAERLEKPFDFNRLRAVLKRQMS

SEQ ID NO: 8764 - protein, 379 aa, Chromobacterium substugae
MRLDPDICYRALASRDARFDGRFFIGVRTTGIYCRPICPARTAKRENVDFYPTAAAAQEAGLRPCLRCRPEAAPDSGAWRGVSNSGHSHTVARALAWIERGMLDEASLAELCDKLGVGERQLRRLFAEHVGAPPLAVAQTRRVLLAKQLIHETRMPLTDIAFAAGFGSVRRFNEVFQALYRRPPGALRRDAGAAPAAPGEITLLLRYRPPYHWPAMLLHLAAHAIPGVETVQDDGYARTIAWNGARGELAVRPGAGHALSVTIRFPQLAALPAILARVRAMFDLAADPAMIERHLSQDPRLAGLIAARPGLRLPGRWDAPDAAADSAQAEPDAYPAVRQRLLEDLGLSAAERERLHRRAEAWQPWRAYAIQHLWTERHA

SEQ ID NO: 8765 - protein, 278 aa, Chromobacterium substugae
MAADIQQFHHFRQLNRQGRLLLPNAWDCASARLFAAAGLPAIATTSGGIAYARGCHDAQHLGREAMLREIAAIAQSVDLPLSADIEAGYGLAPEDVALTVQGALAAGAVGVNLEDNGHGLLAQPLFDIAAQSARLAAARRAAEQAGLPLWINARVDVWLLGLGGDEEARLAQTVARGNAYLAAGADMVFVPGLADAALAARLAAALNGPLNLMALPGVAGAEAWFAAGASRVSLGVGPMLASMGLVREMAREAAQGVWPSMAAHFYGFAEAEALFAAG

SEQ ID NO: 8766 - protein, 257 aa, Chromobacterium substugae
MSWLRRRAALILASLALAGLLLALPRSAALFRLAFPELERPLYLQDDFAALTLSHLGIVALSSALALLLGGGAGLWTSRPAGREFRPLLESLLSLAQSLPPVAVLAATVPLLGFGALPALAALTLYSLLPIAHATLAGLASVPPDMREVAAGIGMSRRQILLRVELPLAAPVILAGVRTAVVINVGTAALASTVGAKTLGLPIIVGLSGFNTAYVIQGALPVALLAIVVDQLFQWLDDAVAPQRQPAANKASASAKP

SEQ ID NO: 8767 - protein, 310 aa, Chromobacterium substugae
MIEIAGVNKSFNGSRVVADLDLTVAEGELAVLVGTSGSGKSTTLKMLNRLIEPDSGSIRVAGRDIRSQPPEILRRHIGYAIQSVGLFPHWTVAQNVAAVPQLLKWPPARIRARVEELLDALRLPAREFGPRYPHQLSGGQQQRVGVARALAADPDVLLMDEPFGALDPVTRANLQQELARIQRLFGKTVILVTHDIDEALLLGQRIVVMDQGRIVQQGGARDILLRPATDFVRQFFNPADVGVRLLGLVRVGERMRPGERADGAAIRADSTLREALSAFVAQGAAALPVEDGQGARIGALRFDDLLGPRA

SEQ ID NO: 8768 - protein, 381 aa, Chromobacterium substugae
MRLRNRVGLLLALLLAAGFCCPLLSYAPNRLLSGQGLYLASLPGAEAALLLAAALPLALAPWLRRSAGSQLLLALCACLLGNGLLWVAGREALRLAAGEDALARVAFGAGFWLLQLAAGLQLAEALRGLSPSPARRALMVCAACLPALAMLLGGALDQLALLREYRNYQDSFHLALLRHLQLVCFSVLPAALLGGALGLAAFRRPRVEAWLFPALNALQTVPSIALFALLIAPLAWLGRLWPQSGIAGVGLAPALTALTLYSLLPMAHGTLAALRQVPTAARDSARGIGMSPWQLLARVELPLALPVFLSGLRVTTVQAVGLAAVAALIGAGGFGAILFQGLSASAPDQTLLGVLPIALLAAACDAAFKIVISRMDHAAHD

SEQ ID NO: 8769 - protein, 309 aa, Chromobacterium substugae
MPRPVFRLAPLAALAAGLLLSAAAAGAADAIRVGSKIDTEGALLGNLIQQVLEAHGVKTANRLSLGNTKVVRAAIAAGEIDIYPEYTGNGAFFFADEKNPAWKSAAAGYQRVKQLDYDKNRIVWLAPAPANNTWTIAVRRDLAAANHLASLADLQRWLAKGGRFKLAASAEFIERPDALPAFQQAYGFKLRQDQLLTLAGGDTSATIKAAAEQTSGVNAAMAYGTDGPLAALGLTTLSDPKGVQPVYAPAAIIRADALARQPQIAVWLKPVFQSLDEATLQKLNASIALEGRDARKVAADYLKRKGFIR

SEQ ID NO: 8770 - protein, 80 aa, Chromobacterium substugae
MLRCAGGALYTGVSTDVARRYRQHQAGKGARYTRLNPPSAIALVIEYPDRSTALKAEYAFKQLSAAAKRDFLARHGDAAG

SEQ ID NO: 8771 - protein, 526 aa, Chromobacterium substugae
MDLSWLSDPAAWLGLLTLIILEIVLGIDNLIFVAILAEKLPPEQRDRARITGLSLALLMRLVLLASISWLVTLTTPLFSIWGQGFAGRDLIMLGGGVFLLFKATTELHERLEGVDEVKASGQRAYAAFATVVAQILVLDAVFSIDSVVTAIGMSEHLPVMMLAVIIAMILMIAASKPLTAFVNAHPTVVMLCLGFLLMIGFSLVADGFGFHIPKGYLYAAIGFSVLIESFNQVAQANRVRYLNRNQSFRERTANAVLSLMGTRLSEAKPEAKPEVGPQPVEETAFGHNERAMIHSVLTLAERPIRVIATPRADIHRLDLSQPEAARRKALRDSPYSRLVVIRDGSIDEPLGIVARKDLLAQLLDGGQLDIDAALRQPLVLPETVTVLKALESFRQHAADMAFVVNEFGSLEGIVTQKDLMEAIAGEFPEEHERHELPAIVANADGSYDVEGSLELMTLEQYLTLGDFEDEDFHTVAGLLMDCLERIPREGDEVTVGEWKLRVTAQKGNRTERVLISPIADGFDAAI

SEQ ID NO: 8772 - protein, 381 aa, Chromobacterium substugae
MELATSSFARTPLWKRLSLWDGAYALLILLAAGYSFRLYHQDMDVYEQGILAGSALGLIALGWFWQSWRWFFPLAGGAALLGIADYQHDLARGQTAFWLKFALASQSAIMWMCTLFFLATAVYWLGVARRSDLLLRMGRGLTWAAAAMGLAGLFVRWYESYLIAPDVGHIPVSNLYEVMVLFCLITALMHLYYEARFAARQAGALVLPVICATVGFILWYSLDRQAHEIQPLIPALQSWWMKIHVPANFVGYGSFALAAMLGVGELLVLKGWLKDRLPSAEVLDEMMYKAISVGFLFFTIATILGAMWAADAWGGYWSWDPKETWALIVWLNYAAWLHIRLVKGWRGAPLAWWSVGGLLVTTFAFLGVNMFLSGLHSYGGL

SEQ ID NO: 8773 - protein, 672 aa, Chromobacterium substugae
MTNHRRNTTRRALYELFSSMRFAIGLLTILAIASIIGTVLKQNEPYPNYAFEFGQFWFQAFEQLGLFDVYHSAWFLTILVFLVLSLTLCVLRNGPGFIKQMRSYRDKAGESSLAAMSHSQALEAEAADPQTLAAYLQAQGYRLRQREQADGSLLIAAKKGAAGKLGYFFAHIALIVICVGGLMDGNVPLKLGILAGRLVPETRNIPQAQIPEHSRLPVTNLSFRGNVNIAEGKSADVGFIDSGNGYLVQDLPFVVTLKKFHVDYYSSGMPKLFASDIVVTDKASGKSTAATVKVNHPLIVDGVAIYQSSFGDGGSPLLFRKWNLEQPQAAPEPLRAVSLASQPLQAGGKDYTLELGELRVFNIENVGKPGAADPTLLQRMHDAREVKQSKELKNFGPSISFKLRDKQGQAVEYMHYMSPIQQDGASYLMAGVRRTPAEPFQYLRLPLDDDMGLERFMRLYAALRDPTLYDAIAERATRQAMQGGKPDEKLARDFKDGIKVMLQRFADGGFAGLEQFLEKQVPADKRQAVAQTYIRILQTAVVDVMAVADEKAGAKPLAADAAHYRFLLDGLVASSGLRDYGAPVFLQLDSFDQVQSSGLQLTRSPGKTLVYLGSILLVLGIVLMFYVRELRLWVRIHGRQLRVAMTSNRHNRDLDRDFQRHLDAIKQLTRGS

SEQ ID NO: 8774 - protein, 200 aa, Chromobacterium substugae
MLLAMATLTLAGSALAAAPAAKGDPAKGKQIVDTVCAACHGADGNSVAAANPSLAGQNPQYLYSQLKAFKSGERKNPTMFGMSAGLSDDDMRNLAAYFSQQKPKEREAADKQQMPLGAKIYRVGNASTHVPACMSCHGPAGKGLPDQFPRLGSQHAGYVAKQLADFKAGTDRKNTIMADIASRMTDAEMKAVSEYISGLR

SEQ ID NO: 8775 - protein, 206 aa, Chromobacterium substugae
MSIFQNARFYTTVNHMKDLPATRAEVAFVGRSNAGKSSAINTLANRTRLAYVSKTPGRTQHINFFELGDECFLVDLPGYGYAEVPEAVRAHWVELLGRYLQTRQSLIGLLLIMDARHPLKELDRRMLEFFRVAGRPVHILLSKADKMSRQEQSKVLALVKRELADYPSVSVQMFSSLKKTGVEEVEQVVKGWFDALEPQLPPAEEL

SEQ ID NO: 8776 - protein, 275 aa, Chromobacterium substugae
MACSTVKTASATNQSASPTNKKTVAKNGAYFQNDGPADHIPVNLNLVPDAVPQDEPLIKSANLPYSALGMSFRPDVREKPYHATGRASWYGKQFHGRKTSSGERYDMFAMTAAHPTLPIPSYARVTNLTNGKSVVVRVNDRGPFHRSRLMDLSYAAAYKLGFIQQGSAKIAVDRVWPAADNTYSASAQPATQPASRELRAGDNPKYLQLGTFSTLANAEALLQKTLGELDDHYDSKLGIVNQQGVYKVRLGPFPSDDAVRNAAENLHVETVITSL

SEQ ID NO: 8777 - protein, 236 aa, Chromobacterium substugae
MLSNLLNALIDNCSFINQKCALCGAADSQQALCPPCRQMLPRLPAAHCPRCSEPTPDSALCGHCQRHPPAFDALHVPYLFGYPLNGLVHAFKYGKRLQLAGTLTGLLTDFAACQACKYDLVIPVPLANERLAERGFNQSSELAKAFAVTINSRFSDDLCWRKCNTLPQASLGRAARLRNVRHAFGVKRRCDGLSIAIIDDVATSGATLSSLAKALKKQGAERVDAWVLARAFSPKT

SEQ ID NO: 8778 - protein, 327 aa, Chromobacterium substugae
MHSVTMEFKRPAAPHPEKANWSVDEVEVLLGLPFMELVFRAAEIHRQFFDPTRVQLSTLVSIKTGGCPEDCGYCPQSVHHDTPVANQPMMTVDEVVAAARQAKANGAGRFCMGAAWRGPKDADLQKTLEMVSQVKALGLETCATFGLLRDGQAEQLKQAGLDYYNHNLDTAPDKYADIIQTREYEDRLDTLGKVRSAGLSVCCGGIVGMNETRRDRAGLIAQLANLDPQPESVPVNNLVKVVGTPLEGAETLDWTEFVRTIAVARVTMPRSYVRLSAGRREMDEATQALCFLAGANSIFYGDKLLTTGNPDVLADQALMQKLDLQAL

SEQ ID NO: 8779 - protein, 384 aa, Chromobacterium substugae
MRLQDLSAALLDLDASHRRRQRACLESPQGAEIVVDGEEYLSFASNDYLGLADHPSLVRALQQGADRWGAGSGASHLLTGHSQAHQQAEEALARFVGREAALLFGSGYAANLAVITSLVGRGDAVFADKLNHASLNDGCLLSRADFHRFRHNDLNQLEQLLAASGARTKLIAVDAVYSMDGDEAPLPELLALAERYDAWLYVDDAHGFGVLGQGRGALAEHDLSSERLVYMATLGKAAGLAGAFVAGGRLLIEWLVNRARTYIFSTAQPPALAAAVGVSLRLIEEAGDRRERLRLLAARCRARLDGTRYSGGASRTPIQPFIIGGDAHAMRLAQGLREQGYWVPAIRPPTVPENGARLRISLSAQHEVSQLDALLDCMLQLAES

SEQ ID NO: 8780 - protein, 947 aa, Chromobacterium substugae
MKSTAEYLETPEQAAGRALALLWQAGSLAAIAAWGQADGKWRRLASLGAADALPAAEALDGDRLPGPDGGALALRAAGKTLGWLAWRGREPAGMADVAALLTGHLQCAALRDEQAAARLANETMLEINLLAGESGAPERMLPRLHRLMMRLMDASNFHIALYDADNATLRYPFYADRRDPAPPGPDAVFAAGADSGSLAAWLIRGGKPMVMSQQRLLEVCGQEGLTPPAALPACWMGAPLADAGGEWIGAVVLQQYDDQAPLSSAEQLLFMFAARHVGFALDRVLHRGQLERQVWLRTSELEGANARLRAEVSNRRRAEQFQDVLFRIAELSNTSLSLEAFLSGLHRLLAEMVPARNCMVALYDMVNDRIGFPYCADEYSPPLQPRKPGKGFIEQVLHSGRPLLVDPHSPLQAQMEDVGGMRPQSWLGVPLYCGHELLGVLAVQSYQSDVSYSYRDQEVLEFVANNIGAALARVRALESLQQAYAELEQRVRERTSELDAVNAQLEFDSLHDPLTKLPNRTYFAKALRRAWDAYADGGDRFAVVFIDLDRFKLVNDTLGHLAGDHLLFEAGARIRSCLRHYDFLARLGGDEFAVLMFGMDAADECEVIARRIVSEFERAVILAGREVFSTASVGVVLADREHYHKADDLLRDADHAMYCTKQQGRQGYTLFSHQLRIDQADQLALEAELRRALEEEGQLIPYYQPFIEARTGKLAGFETLVRWRHPQRGLISPAVFLPMAEESGLINRLDRYMINAACAQLQAWRGEGRVGEDIGLHINLSSANFHDPDLVGWIGERIVHYQLPPAMLHLEITESALIDQPETASSVMQALHGLGVKLALDDFGTGYSALSYLHRYRFDVLKIDQSFVFDLDRKEESAAIVRAILALARALDLDVVAEGVETAAQLAMLQEMHCSKLQGFYFAAPAPAWHIDWERLARFEQEIRCAA

SEQ ID NO: 8781 - protein, 205 aa, Chromobacterium substugae
MRREWSTRFNRWRYDLYAPLYDKLAQGFAAGRRRSLGLLNPQPGEQVLLVAAGTGLDLDFLVRCRHLTAIDIAPAMLEQLRERARKLGMEVRAELMDAQRLDFPDASFDAAVLHLALAVVPDPQACLREVERVLKPGGRAVVFDKFLADGARAPLWRRAGNLLARLLASDVNRRLGDIVAVTKLQPIHDEEAGLGGFFRIVLLRK

SEQ ID NO: 8782 - protein, 254 aa, Chromobacterium substugae
MNLFVETLGQGPDVVMLHGWGLHGGVFARVAEHLAGRFCVHLVDLPGHGASPALAGFDADAVADLVASHFPLPVQVVGWSLGGLIAQHWAARHPERVKSLALVSTSPRFVRDETWPHAQERKSIEAVAQSLDGAFEQTLERFLALQMMGAPAARDTLKSLRGELFSHGRPQGLLPALQLLLEADARSLAGRIRCPAALFCGARDAITPIGAGRWLAEALPDAVLYEFPQASHAPFLSHEQDFVRALAQHLEAQA

SEQ ID NO: 8783 - protein, 302 aa, Chromobacterium substugae
MSEAFYTDKARVRASFEKAAASYDSAAVLQREVSDRMAERLEYIKHQPAVILDAGAGTGYGAAQLRGRYPQARVLELDLAHAMLLASRERGRAGDGLLKKLFKPSLPWQVVADIERLPLADDSVDMIWSNLTIQWINVPDKMFAELRRVLKPDGLLMFSTLGPDTLHELRGAFAGVDAATHVNQFIDMHDIGDALMRAGFAEPVMDMEKIVLTYDDAKGAMRDLKAIGAHNATAGRGRGLMGKAAWRKVEEAYEKHRRDGKLPASYEVVYGHAWKGSGKKVAKMTDDGRQVIEFVKKAPRAD

SEQ ID NO: 8784 - protein, 182 aa, Chromobacterium substugae
MRVDIRNACREDAASLAALSIQVWLSTYAFDGIRQALADYVLTEFTPEKMAALIADPARQLLVMEKDGHLLGYAQLKLDAACEGCDAPSLEAERVYLVESHTGHGLGRRLMDAARQWALAQPGQPRLWLRVWHGNARAIAFYRRVGMALHGETHFELEGARHLNYVMLDPAPIGAAMAAVDV

SEQ ID NO: 8785 - protein, 299 aa, Chromobacterium substugae
MISKSILRPALLAGIASLLSACMTATPPESAAVAKPLPKPRIALALGGGAVKGFAHIGVIKVLEGAGITPDIIVGTSAGSVVGSLYASGLTGMQLQQRAIALDQADLTDWTLSTKGVLKGEKLQNWINAQVGNRPLEKLGKPFAAVATELDSGRRVVFRTGNTGQAVRASASIPNVFLPVKIGGKSYVDGGLVSPVPVSAAREMGAQFVIAVDITGRPKPGRATGFLSMLDQSLSIMNGPALTQELKQADVVIHPNVLNIGSAEFEARNQAILEGEKAAQQMLPQIRQLLQQKSLALAK

SEQ ID NO: 8786 - protein, 216 aa, Chromobacterium substugae
MIKLHGIPLSPYYNKVKIALLEKGVNFQEVVTTPSQEDELLEKSPMGKIPFVEINGHPLAESTVILEWLEDAYPTASLLPPTPNSRALARELTAMLELYVMLPASPLIRHMLKGTRPEPEKCEEIRQALARGIGAVAKLAQCRPWLAGEDFSFADLSAAGILPVVARLSQTFLGEDMTLRLSGCGEYLQRLGCRHSVARVWADRDASLAALMARRD

SEQ ID NO: 8787 - protein, 295 aa, Chromobacterium substugae
MKFPVELILLALVPVFLLFVAGELWLLRRGGRIGLYDLRDSLCCAALGLLHQGADKLAWLLVLPLYGWIYQHHRLFQFSDSWLSFFLLFLGQDFLYYWFHRVSHRVRWLWAAHSVHHSSTRMNFTTAFRQSLMYPLAGMWAFWLPLAWVGFPPEQVVAVVLLNLAFQFFVHTQGVPKLGWLEYVFNTPSIHRSHHAKNPRYIDHNYAGVLVVWDRLFGTYAEELDSEPCDYGTVKPVNSFNPLWVSVAEWRDMLAEAWRADNWRDRWLALFGPPEAAEEAASRQRARLQAQRQAA

SEQ ID NO: 8788 - protein, 254 aa, Chromobacterium substugae
MQCLSSKWRFVRHIREITMKQPILIASILGGGIALGAIGVAGIQALKPAAPATPATVIPASAPLAAASAPAVQALAPSAASAVVAQAAPKAAAPAAAAAPAPAPRPKPVHASYAKVLGVTPIKQTVSEPKQVCHQEQVAHQAPVQDNNRIAGSVIGGVVGGLLGNQVGGGNGKKAATVIGALAGGLAGNKVQEGMQQRDQVTSTQTICNTENVDKEKVVGYDVRYSLDGKTATVRMDEKPEGKTLPAKDGKLLM

SEQ ID NO: 8789 - protein, 456 aa, Chromobacterium substugae
MSETQTGLKRELKNRHIQLIALGGAVGTGLFLGSASVLKSAGPSMILGYAIAGFIAFLIMRQLGEMVAEEPVAGSFSHFAYRYWGKFAGFLSGWNYWVLYVLVGMAELTAVGEYVRYWWPNVPTWTTALVCFVAINGINLANVKSYGESEFWFALIKVAAVIAMIVFGGYLLLSGTGGPQASVSNLWNDGGFFPHGVNGLFMMMAVIMFSFGGLELIGMTAAEASDPQKTIPKAVNQVIYRILIFYIGSLVVLLSLYPWSKVAAGGSPFVMIFEQIGAGFTAHALNFVVLTAALSVYNSGVYATSRMLFSLAEQGNAPAGLKKLDKRGVPVNATLVSAIATFACVILNYLLPGQAFGILMSLVVAALVTNWAMISLTHLKFRRAKAGLALVFPSIWFPAANWLCLAFMIMILGILLFTPGMAVSVYVLPLWLGLLWLGFRLKKAGPADGRLVGENV

SEQ ID NO: 8790 - protein, 53 aa, Chromobacterium substugae
MNHHEADYFTPKPKLVVARLSRRARSVRIRFPGRRHGRPCCIQLFTPCGGKLF

SEQ ID NO: 8791 - protein, 437 aa, Chromobacterium substugae
MPRTQWGSRLGFILASAGATVGLGSIWKFPYVTAMNGGGAFLLVYLAFTFTMGLALLQAELALGRAAGCGAVGAFARLGSPRWKLLGYGGVLCCFLIFSFYSVVGGWTLGYLLRALDGRVMSDDVGALGALFGQYVGNPAEALLTHALFAGLTLLVVAGGVQKGIERMGKLLMPLLFLLMLGLIARALTLPGAMAGVEALFRPDFARLTPGMLVEALGLACFSLSVGAGCMLAYGSYLGPGTRLGNSALWVTGLTALTSVLAGLMIFPAIYAFGLNPQAGPGLTYMVMPVVFNHLPYGQLFATAFFALLLMAALTSAVSLLEVVAILPIDEFGVGRRQATLAVTALAFLAGVPAALSFGPLADCRLFGRNAFELMDYAASNVLLPLGCIGTALFAGRVAWPAVRDELRLSAPAALLMRVACRWLAPLLIGLVLAYNL

SEQ ID NO: 8792 - protein, 107 aa, Chromobacterium substugae
MNSWQHWAAIIGMLAATLAIRASFLVFGQRLAFPGWLNRALHYVPAAVLSALVAPMALAPAGTIDLSWHNAYLAGTIVAIAVAWKNGKTLLAIVVSFAVYGALRWLL

SEQ ID NO: 8793 - protein, 236 aa, Chromobacterium substugae
MPSLSDRRRWLLDGARDTIPMMVGAAPFGVIFGTLAIAAGLSPAATAAMSLLVFAGSSQFIAVSLVSAGAALPVIWLTTFVVNLRHALYSATLLPYARPWPLAWRWPLAFWLTDETFAVVEHRFRSLGADGGQWYWLGSSLSMYLNWQLWTLAGVALGRSVPGLDQLGLDFAMVATFAAIVAPQLKKRPTLAAALAAGAVALLARGLPYKLDLMLAALAGVAAGMLLERGQKREAA

SEQ ID NO: 8794 - protein, 277 aa, Chromobacterium substugae
MPASSAERSELFRADDLGALECLDAQYAERTFPPHFHEQFVVNTLTLGAQSYRHRGGLHRAGVGALVLINPGEVHTGETAHENGWAYRGFYPGVDMMGRLAADLNGKAGLPYFRDTVVVDPGLARRLDSLHLLLRDSRDALRRESALAAVFSEVLVKYMRLRPDEPASAPGPVETVRQMLADDPAANHSLQQLAAAVGLSPWQLCRLFKRETGLPPVAWRNQLRVARARKLLAAGMRPGAAALELGFADQPHLTRAFQQTLGVTPAAYQKAVGARPR

SEQ ID NO: 8795 - protein, 215 aa, Chromobacterium substugae
MFKTLSLQFLFGGLLSLITITNPLSKIPLFITLTREMSDAGRASQARRACVFAAAIMVVSLLAGNLIMAAFGISYGALRIAGGFVVAVLGYRMLFLSQDPGQTPKQSGEREDYAFFPLAMPGISGPGTIAVVIGISTEIAELTTLPAKALAFAMTFAAIGLTCAGMWLTLKSSQLISARLGRGGREVMTRLMGFLLICIGVQFVGSGIRTFMAGS

SEQ ID NO: 8796 - protein, 38 aa, Chromobacterium substugae
MIDGEGKTAPLYHGRARGRRGKMSQASARLPHPAMPLV

SEQ ID NO: 8797 - protein, 153 aa, Chromobacterium substugae
MKRFAAALFGLCLSGLAAAHSFQLGDIHIGHPWSRAMPATSPTGGVYLSLKNQGKTEDKLVSASTPRAEAAELHTHVNDNGVMRMRKVEGGVAIAPGQTVKFAPGSYHVMLMGLKQPLNKGDHFPLTLKFEKAGSVTVDVVVQDGGEGDSHSH

SEQ ID NO: 8798 - protein, 503 aa, Chromobacterium substugae
MLCFCPAIDFRHDHLRFLPASRRLAPGRHPLLHRLPLAAARRLAGAGAADHLERVDRSGAASRQRRRVPRRGGRRIAVGPQGGRRLSRAENPQAAAARPHRAGQGAGPQRPPILTSAAMNAPLRKIIHVDCDCFYAAIEMRDDPSLREVPLAVGGRPETRGVIATCNYIARRYGVHSAMSSARALRLCPELVILPPDMARYRLASQQIMAIYQRYTEVIEPLSLDEAYLDVTGQPHEQGSATLMAEAIRRQIREEVGITASAGIAPNKFLAKVASDWNKPDGQFLVRPRDIDAFVALLPVEKVHGVGRVTAERLHRLGIRSCGDLRRWTAADLFRHFGRFGEQLLAMAQGVDNRPVSTDRSRKSISVEETYAQDLPDLASCLGRLAELVDRLQARLARNGNPEFKGLSVKLKFDDFTQTTVEQPGYALGMAAFGQLLRTGFARGARPVRLVGVGVKLADEHDLPRQLRLFGRDGRPLPDTQPDGQAELSADAQPDGGGPASRA

SEQ ID NO: 8799 - protein, 365 aa, Chromobacterium substugae
MKTPLIKRIWLQIKEPLDGWMMLFLGLIFAVSMVLLYSANNQSFDKIDNKLAYTVLSLLVMWLIARMRPQSVMNFAPPIYVLGVLLLVAVHFKGITVNGSTRWLNLGVTRIQPSEILKIALPMMLAWFFQKYELSLRWWHYLIAALLIAIPSALVLKQPDLGTTLLIAAAGLFVLFFAGLPWKVILAGAVMFAASLPLVWNHLHDYQRKRVLTLIDPTTDPLGTGYHIIQSMIAIGSGGPWGKGWLNGTQTHLDYIPERTTDFIFAVYSEEFGLAGNVVLLALYLLILSRAMMITASAQTLYGRLMAASITMSFFVYAFVNMGMVSGILPVVGVPLPFMSYGGTATVTLFIGMGMLMGISNLRRL

SEQ ID NO: 8800 - protein, 646 aa, Chromobacterium substugae
MRRPARFKNPQTEEEEFQLRLIIAYGLIILMFLLLLARFVWLQVLQHDHFSTLAQNNRISLVPILPNRGLILDRNGIVLAQNYSAYTLELTPSKIPDLAATIDKLKKLADVSPRDEKLFKKLLAESKNFEAIPLKVKLTDEEAARVAANAWQFPGVEVKARLFRDYPYKEMTSHVLGYIGRINQKDQERLADEDKTTNYKGSNYIGKTGLEAVYEEDLHGQVGFEEMETDSGGRAVRSLRRTPPVNGNTLKLALDIRLQEMADKLFGERRGALVAIDPSTGGVLAFLSKPGFDPSLFIDGIDSQTWAALNSDWQKPLVNRALRGTYPPGSTFKPFMAMAALTTHSIGLHDIRPAPGYFTLPGSSHQFRDSKKGGNGMVNLQRAITVSSDTFFYKLAWDMGIDKIHPVVGSFGLGSKTGIDLDGEASGVLPSKEWKAKRFARYKPEVRRWYPADVVSIGIGQGFNAYTPLQMANATAIMANNGQVFKPHLVQQVVDSKTGQVRQIEPAPVRQLPYPQEYFDYIKEGMHNVMISGTGARVGVGLKYSMAGKTGTAQVVAIKQGAKYNAAALAEQYRDHSWFIAFAPVEKPKIAVAIIVENAGFGAAAAAPVARGLFDYYLLGKVPTDLAGLLKTVPMENGDTHEDTPD

SEQ ID NO: 8801 - protein, 167 aa, Chromobacterium substugae
MSLDRPKELLKPVKRRFILLTFVAAVLVELVPLPHGSTRWLPDFIGLLILYWVINQPRRVNIGIAFMMGIIADVSTAGLFGQHALAYSVTAFLALSRQRQLVMFNLGQQALVVLGLMLTNQIIMVVVRMLTGSAFVGWSYFLPPLIGALLWPLLTKLMLIPYRHHSV

SEQ ID NO: 8802 - protein, 302 aa, Chromobacterium substugae
MDFANTPSFFRSGPPPAARLAMSAVASIALLIGDSHYGLMEQAREALSLALYPVQRAVNLPAQAVRHAGDYLTSQTELKQENTELRTRQLQMSAQLSRLQTLERELNELRALNAIRAQRDDSAQIAETLYTGRDPFSYKIIIDKGDDAKLQAGQPVVDPRGLLGQVTRVQPLTAEVTLVIDKNQMVPVMIARTGERAILYGYGGGVELRYLPQSSDVKENDQVVTSGLDGLFPEGIPVAVVSKVERNPGAAFTRVSTVPLAGVQQTRYVLVLQARETRARPAEAPAIVEKKTRGGRKAAAEE

SEQ ID NO: 8803 - protein, 347 aa, Chromobacterium substugae
MFRSLTGYFSNDLAIDLGTANTLIYMRSKGIVLDEPSVVAIHNDAPTNKKSILAVGLEAKRMLGRTPGSIQAIRPMKDGVIADFTVTEQMLKQFIKKVNPNRFFAASPRIVICVPCGSTQVERKAIRDSALAAGARRVELIEEPMAAAIGAGLPVEEPTGSMVVDIGGGTTEVGVISLGGVVYSNSVRVGGDKFDEAIINYIRRNYGMLIGETTAEEIKKTIGSAFPGAEVREMEVKGRNLAEGIPRAFTVSSNEILEALTEPLNQIVSAVKIALEQTPPELGADIAEKGMVLTGGGALLKDIDRLLAEETGLPVFVAEEPLTCVVRGSGKALEKMDKIGTIFTNVP

SEQ ID NO: 8804 - protein, 95 aa, Chromobacterium substugae
MSLTHQDVARIAKLARIDVNEAEIAATADKLNDIFSLIEKMQAVDTSGIEPMAHPQDVSLRLRDDAVTETNRREAFQAVAPQVEKGLFLVPKVIE

SEQ ID NO: 8805 - protein, 483 aa, Chromobacterium substugae
MTQATLKQLSQQLAAKEVSSVELAGQYLDRIEALNPALNAVITVDRDKTLAEARAADARIAAGDAHPLAGVPLLHKDLFCQQGWKTSCGSKMLDNFVSPYSAHVVEQCAAAGMVTLGRANMDEFAMGSSNENSFYGAVKNPWDLNAIPGGSSGGSAAAVAARLAPVATATDTGGSIRQPASHCGVTGIKPTYGVVSRYGMVAFASSLDQGGPIAQTAEDCALMLNVMAGFDARDSTSLERAREDYSRDLNQSLAGLKVGLPKEYFAAGLDGEVARAVDNAVAELKKLGAEAVEVSLPNTELSIPAYYVIAPAEASTNLSRYDGVRYGHRAKDYKDLVEMYEKTRAEGFGDEVKRRILVGSYVLSHGYYDAYYLQAQKIRRLIANDFKAAFDQCDVILGPVAPTAAFDLGQMSSDPVEMYLSDIYTLSVNLAGLPGMSVPAGFAANGRPIGLQIIGNYFAEAKMLNVAHQFQQATDWHAKAPAL

SEQ ID NO: 8806 - protein, 482 aa, Chromobacterium substugae
MNKDFPTMKWEVVIGIEVHVQLNTVSKIFSGASTAFGAEPNTQASAVELALPGVLPVLNRAVVDKAIRLGLALDANINQKNVFARKNYFYPDLPKGYQISQMDLPIVEGGKLKILVGDQEKVIGVTRAHMEEDAGKSLHEDFQGLSGIDLNRAGTPLLEVVSEPDMRSVDEALAYVKALYTLVTWLGICDGNMQEGSFRMDVNVSVRPEGQKEFGTRREIKNLNSFRFLEQAAKYEIQWQIDTLEDGGKVQQATVLFDPDSGETRMMRSKEDAHDYRYFPDPDLLPVRISDEQIARIRGEMPELPAAMQARFVESYGVSAYDAALLTSSLAQAEYFEAVAKASGQGKLAANWINGEIAARLNRDGKDIADCPISVARLSGLIVRIADNTLSSKLAKQVFEALWDSELSADDIIERDGLKQVSDVGAIEKMVEEAIAANPKAVEEFRAGKEKALNALAGQVMKASKGKANPAQVQDILRQKLG

SEQ ID NO: 8807 - protein, 133 aa, Chromobacterium substugae
MAIPAKHRETLLSAFGHKLIVTLESQDHLLLYPEPNWRPVEARLLALPTGNPTLKRYQRLVLGHAETLEMDSAGRVLLPARLRELTALDKDVALVGMGNRFELWNAEEWDSQTADALAIDQADLAQHLGDFTL

SEQ ID NO: 8808 - protein, 320 aa, Chromobacterium substugae
MSTPTFVHRTVLLTEAVDALAIRPDGVYVDCTFGRGGHSRLILSKLGPNGRLIAFDKDPEAIAVADRLAAEDSRFNIVHNGFETLSSELARLGVAGVDGVLMDLGVSSPQIDDGSRGFSFRFDAPLDMRMDTTRGVTAAEWLATADEADISEVIKTYGEERFARKIAAAIVAQRGEHPITTTRELALLVGQNVRTREPGQDPATRTFQAIRIFVNRELDELKSVLPQAARLLGERGRLAVISFHSLEDRIVKQYLRDVSSEEKLPAWAMVRAADMAKPPIALVGKAIRAGDEEVHENPRARSAIMRVAERTAAPWREADA

SEQ ID NO: 8809 - protein, 90 aa, Chromobacterium substugae
MNKLNAMLLAMTVFSAWSVVTSTHVSRKLYSDLQKETKSGQQLEVEYGQLQLEQSTWGAHAVIEKAASTRLDMHTPDPRQIQVISPGGKI

SEQ ID NO: 8810 - protein, 583 aa, Chromobacterium substugae
MRAGSNYSVRQRPMSASPSLRMTSTRVRCVLLMLALLFFALVCRAMYLQVVQQDFLQNQGEARFRRALTLEANRGVITDRNGEPLAISTPVQTIWASPADMEPVPPAKLRELAALLDLSPEELSAKLSDRKKEFVYIKRQISPEQADKVMALGIPGIAKQQEFRRFYPAGEIVSHIIGFTGVDGKGQEGVELAREKMLAGKDGRRVVLKDRRGHIIEDVAAIEPPRDGQKLALAIDHRIQYLAYREIKAAVETNKAKAGSVVVLDAHTGELLALANYPSFNPNNRVGVTPEMMRNRGVIDLFEPGSTMKPLSIALALEHGKANLNTVLDTHSYMIGPATIRDVSPQASLGILGIIQKSSNVGTSKLALMNSPEEFWKHYDALGFGRAPNTGFPGEASGRLRDWHHWRPIEQATMSFGYGVSVSLIQMARAYTIFANDGVMLPIALYKTSNPMPGKRVIDVKTAHEMRDLLIANSQPGGGAVGGRIIGYSIGAKSGTARKLEGRTYVANKHRALFMGFAPGHAPKVIVAVMIDEPSAGKYYGGAVSAPVFSQVAGGALRVLNVPPDEPSNNTLLPESTPVPADF

SEQ ID NO: 8811 - protein, 493 aa, Chromobacterium substugae
MKSRLIALPDWDPAALNQLGLTIKRVEADSRRVLPGDVFLACRGEFADGRDFIAAALEKGAAAVLWDDADGFAWNPAWQVPNLAVPNLRERAGIVAAHVLGEPARDLTVVGITGTNGKTSISHWLAQAFSLLGRKAALIGTVGNGFYGQLTETTHTTPDPVTVQQKLAEYRRQGAHVVTMEVSSHGLDQFRVNGVAFATAVFTNLTRDHLDYHGSMQAYGESKKKLFFWEGLKQAVINADDAFGRQLAAEIDPKITQVVTYGLEQGDVRPLALAATLEGLQMTVTTPWGVTDVRTGLVGRFNAANLLACLATLCVNGVSLQDAAAVMARIQPARGRMQSIGGTHEPLVVIDYAHTPDALEKALATLGEIRPAGGRLFCVFGCGGDRDPGKRPMMGAIAEKHADVAVLTSDNPRSEDPQAIIRDVLAGMDAARAHVEADREAAIHWAVSQAKVGDVVLIAGKGHEEYQDVAGAKRPFSDFRVAEEALTAWGQQA

SEQ ID NO: 8812 - protein, 454 aa, Chromobacterium substugae
MMTLSQAADFAKGRLIGADGEVLRVITDSRLAQPGDLFVALKGERFDAHDFVAEVTAKGAAALVRDGFELAGASLIQAGDDTRLALGRLAAGWRASQPAVCVGVTGSNGKTTVKEMLAAILRAHAGADAVLATAGNFNNDIGLPLTLLQLKPQHRYAVIEMGMNHHGELRYLTGLARPRVALVNNAMRAHFGHFGSTAEVARAKAEIFEGLEDGGVAVVNADDANLPLFRAAAGPHRQLSFGLGADAQIGARALRMDALQSRFTLVSPLGEIDIALPAPGEHNVRNALAAAAVALALEVPLAAIAAGLAAFGGAKGRLQIKQGPRGLTVIDDSYNANPDSMKAGLDVLASQPGPRCFVMGDIGELGEAAPALHAEVGEHARLRGIEQLFALGELSRGAVAAFGAGAQHFDSIDELLECLDSRLASGTAVLVKGSRFMRMERVVEHLMHANTEGV

SEQ ID NO: 8813 - protein, 361 aa, Chromobacterium substugae
MLLWLADLLGSHIRAFNVFNYITLRAVMAALTSLAISLLLGPWVIRKLTELKVGQAVRNDGPQTHLVKAGTPTMGGSLILLAITITTLLWADLSNKYVWLLLAVMLGTGALGFYDDWRKVVYKDPKGVSAKFKMAWQSAIAIGAGVFLIATAKLPASTEFIVPFFKTVAYPLGAVGFCVLTYLVIVGTSNSVNLTDGLDGLAALPTVMVSAGLSIFAYAAGHAVFSKYLGVPFIPGAHEVVVFCAAMCGACLGFLWFNAYPAQVFMGDVGALALGAALGTVAVIVRQEVVLFIMGGLFVVEALSVMIQVGSFKLTGKRVFRMAPLHHHFELKGWKETQVVVRFWIITMMLVLAGLSTLKLR

SEQ ID NO: 8814 - protein, 453 aa, Chromobacterium substugae
MDYANRQVMVVGLGGSGLAAARYLAAHGARVSAVDANPSAERLAELERWLPGTPVSRGEFTAATFAGMELLVVSPGVPLVNPAIAAFRRAGGEVVGDIELLARAIQGDGSKVIAISGSNGKSTVTSLVGHLCEAAGLDTVVAGNIGLAVLEAQLAREQSGKRPDVWVLELSSFQLESTFSLRADAATVLNISEDHLDRYADLLDYAHAKTAVFNGDGLQVLNRDDPLVRAMVRPGHEVKWFSLQGEADYALSRGDGYRLSVAGEAVFDCADMQLQGLHNAANALAALALCQGIGLPLNTLLDGLKTFRGLAHRVELVDEFDGVAFIDDSKGTNVGATEAALDGMTRPVVLIAGGDGKGQDFAPLQAACRRAARAALLIGRDAGRIEAALEGSGVAVERFDTLEAATRRAAALARPGDVVLLSPACASLDMFRNYAHRAQVFIDTVAALKAERR

SEQ ID NO: 8815 - protein, 385 aa, Chromobacterium substugae
MNRNPARHYVAITPLDEALAWALALLLSISLVMVYSASIAYAEADAATQNRYFYLIRHVVFMVIGLAAAYMAFQIPTGFWQKYSGKIFLIGLVMLVLVLIPGIGKVVNGSRRWINLLVLNLQPSEVMKFAVVLYAADYTVRKSHLLHSIKEGFLPMFMAMVVVAFLLLREPDFGALMVVMSIAMGLLFLGGINMRIFSGLAVMAVGAIVVLIISSPYRLKRVLGFMDPWDDPYGKGYQLSHSLIAIGRGEWFGVGLGGSIEKLFYLPEAHTDFIMAVIAEEFGFAGICVVVGLYAWIVRRAFHIGVESKKLERYYQALVAQGIGIWLGIQVFFNIGVNMGLLPTKGLTLPLMSFGGSAMLMNLIAVAVLLRVDYENRRIMRGYKV

SEQ ID NO: 8816 - protein, 363 aa, Chromobacterium substugae
MVMAAGTGGHIVPGLAVAKELQQRGWKVVWLGTSRGMENKLVPPSGIPLEKLNFHGVRGKGLLGSLTGAAQLAAAFVRSLALMLRHRPDAVLGMGGYVCLPGGAAAALLWKPLVLVNADAGLLLSNKALLPFASKLACGFDGSAARQAKALVTGNPVRGEIENIAPPAERFAGRSGPLKVLVVGGSLGAKILNETLPQAMAKLPADKRPQLTHQTGEANFAAVEAAYQAAGLREQVELLPFVDDMPKRLAECDLVICRAGAITVSELCAAGVPSVLVPLVVSTTGHQRDNAEWMAEAGAAWHLPQKELNADGLAGLLASLDRDQLLEKAGRARALARSGAAGRVADLCQQLAGDRPDAVEASQ

SEQ ID NO: 8817 - protein, 463 aa, Chromobacterium substugae
MKHRVKHIHFVGIGGVGMCGIAEVLHGLGYTVSGSDMADGATTKRLAAEGVRVFFGHDATYIEGADVVVTSTAVKADNPEVLAARDKRIPVIPRAMMLAELMRFKQGIAIAGTHGKTTTTSLTASVLGAAGLDPTFVIGGKLTAAGTNAKLGLGEFLVAEADESDASFLHLSPVMAVVTNIDADHMDTYDHSFDKLKQAFVDFLQRMPFYGRAVLCVDDPNVREIKERITKPVTTYGLDDSADIYAENVRAAAGQMHFDVVVKNGTITRFPLVLNLPGRHNVLNALSAIAIGLECGASIEAIQQGLAEFAGVGRRFQRYGEVKAKDGGSFTLVDDYGHHPVEMAATLAAVRGAFPGRRLLLAFQPHRYTRTRDLFEDFVKVLSGVDALLLGEVYAAGEAPIVAADGRALARAVRVGGKVEPLFVESIAELPQAIVDAARDGDVVVTMGAGSVGAVPGKVLALV

SEQ ID NO: 8818 - protein, 303 aa, Chromobacterium substugae
MKQYGKVAVLMGGRSSEREVSLMSGAGVLSALLAKGVDAHGFDPAEKPLAALKEEGFACVFNILHGPFGEDGTLQGALEALGMPYTGCGVMASAIAMDKWRTKLLWKGAGLPIPAFELLDEDSDFDAIEKRLGLPIFVKPSSEGSSIGVTKVKQPGELRAAFAEARKYDAVVIAEQFIGGGEYTCAVIGDVAYPTIKIEPATEYYDYQAKYFRDDTVYRCPSGLAPEVEAKARELALKAFKVLGCRGWSRVDFLMDEAGEIYLLEANTSPGMTSHSLVPMAARAEGIAYEDLCLKVLDTVHVG

SEQ ID NO: 8819 - protein, 241 aa, Chromobacterium substugae
MWDNHRLLRSLANLMLGAAALMLLYAGGFWLTHAPVFPVKKIRIQGDMNRVTAEQLKFIAEHELAGTFFTLDIDKTRAAFGKLPWVRDAQVRRRWPDALDITVEEHVALARWGENGLVNTRGERFDAASDAKLPVFYGPAGAEKDMTAMLTQMRQSLQPSGLAPRELWLSSRRAWKVVLDNQLQLELGRNDVVARAERFATYWKSELARLPYHIEYVDLRYPNGFAVRMPDYKAPPVKGNK

SEQ ID NO: 8820 - protein, 414 aa, Chromobacterium substugae
MSKPKESKNMLVGLDIGTSKIVAIVAEVLEDGQLNIVGMGHTPSRGLKRGMVVNIESTVQAIQRALEEAELMADCKIHEVFVGIAGSHIKSVNSHGMVAIKDREVTKMDIDRVIETARAVTIPPDHQVLHILTQEYSIDGQEGVREPLGMSGVRLEAKVHIVTGAVSAAQNVTKCVRRCGLEVSDLVLQPMASAIAVLSEDEKDLGVCLIDIGGGTTDIAVYVGGAIRHTAVIPIAGDQITNDIAMALRTPTKEAEDIKIQHGVSLVAMADPAQMIEVPGVGERGPRQMSRATLAEVIEPRVEELFQLVQQELRRSGFEELLSSGMVLTGGASLMPGMVELAEEVFHLPVRVGVPKYVGGLAEVVKTPRFSTGVGLLLYGKDQIQGYAGPHSKAESAGVGQLFGKMKAWFAGNF

SEQ ID NO: 8821 - protein, 392 aa, Chromobacterium substugae
MVFEVMQETATTAVIKVIGVGGGGCNAIDNMITGNVHGVEFICANTDAQSLQRNRAPQKLQLGTNLTRGLGAGANPEVGRSAALEDRERIAEMLRGSNMVFVTAGMGGGTGTGAAPVVAEVAKEMGILTVGVVTRPFEHEGKRMKVAQNGIEDLKKHVDSLIVIPNEKLMEVLGEDVTMREAFRAADDVLKGAVAGIAEVITCPGLINVDFADVRTVMCEMGLAMMGSAYASGIDRARVAAEQAVASPLLDNITLEGARGVLVNISTAPGCLKMSEYREIMGIVRQYADEEAQIKFGTAEVEDMPEDTIRVTLIATGLGQKKSARNEERPEYIKIVKTGTDDRAVEMVNYEDLDAPAIMRTGRRRSSPSLDFSNPEVSESYDIPAFLRKQAD

SEQ ID NO: 8822 - protein, 304 aa, Chromobacterium substugae
MILQRTLKQAISATGVGLHSGERVKLTLLPAPPDTGIVFRRTDLPEPVDVKVDPSLVNDTRLSSTLVTDTGVRVGTIEHLMSAFAGFGIDNLVVEVTAAEMPIMDGSAAPFLYLLQTAGVVDQPKKKRFIRVKQSVMVEEGDVWVRLDPHEGFKAKLAIVFNHPAFNRAPQTVEVDFARHSYLDEISRARTFGFMHELEYMRNHGLGRGGSLDNAIVIDDEYVLNPEGLRFPDEFVRHKLLDAIGDLYIVGHPLIAAFSGHKSGHAMNNKLLRKLLATPEAWEYVSFDDPLDAPSSFHLLPPQE

SEQ ID NO: 8823 - protein, 60 aa, Chromobacterium substugae
MFGFWRLWLLATILAIGWALLCFALTHDRRHLRRVLAIVRWSAGLLIIVSCFWLIFCLLR

SEQ ID NO: 8824 - protein, 159 aa, Chromobacterium substugae
MTRLTHFDDGGQAHMVDVGAKAATARRAVAEGVIRMLPATFALVKGGGHKKGDVLGIARVAAIMAAKKTWDLIPLCHPIALTRLAVDFALLDAESAVRIEVTAECNGQTGVEMEALTAVNVGLLTIYDMCKAVDRGMEIGGVRLLEKDGGKSGSWRAPD

SEQ ID NO: 8825 - protein, 178 aa, Chromobacterium substugae
MHPLELKSLKTPAPDVGVRLPDGRLLAIEVTEVLAGEHVRRTAKKKEAHLARQAAVGIYSMFALPANASDVACRIEAKVGKDYHVPPGHQLQLLLAASTFEHGAVAATLLLYVSVQELNQLTHDMLARSRYQHVYLHLQSGRGLYEWNRRQRWHEIHPPVFDAGGAPGPQELDPQTGK

SEQ ID NO: 8826 - protein, 168 aa, Chromobacterium substugae
MKAFLTLPAALALCLSLPALADNDRIKKNITFEDEKAWEEQAYALPDYPQAADWVEVKPDWLQSNRFFVDGKTLSVGQDGVVRYISKVLSPNGVENLSVEGILCKDARYRAYGFGDSVNHRWIEPMRPIWQDIVYGDKLRRELRELLCPSHSAPRDAAEALKSLRKGS

SEQ ID NO: 8827 - protein, 254 aa, Chromobacterium substugae
MCIIAFAYKTPGMGQLALLANRDEYYARPSAPLDWWPEYPHTLGGRDLQSGGSWMMVDGRNRFAAITNFRDGFPAKAERSRGELVERFVSGDDDAFAFADWLRAEHHRYAPFNLLFGHTSDLFFFHSRTAQIARVTPGIHTLSNATLDTPWFKSQRLAEYLREFQRVPNEDQAYAALSDPTPAGPGQLPNTRIGLALEKTLSPIFIQGRDYGTRASMLLTVSSRGDIAFSELSWGLAGRETGRRHYNLRAGTAR

SEQ ID NO: 8828 - protein, 76 aa, Chromobacterium substugae
MTPDKQIDLSGLNCPLPILRAKKALADMASGAVLEVIATDPGAPKDFEAFCRQTGNGLLESTTTGEGKFRMVLKRK

SEQ ID NO: 8829 - protein, 344 aa, Chromobacterium substugae
MQTLTLIRPDDWHLHLRDDAALAAVLPDTCRQMGRAIVMPNLKPPVTTVAAAAAYRERILAARPAGSAFEPLMTLYLTDKTSADEIRKAKACGFVHGVKLYPAGATTNSDHGVTDIAQAMPALQAMAEVGMPLLVHGEVTDADIDVFDREAVFIERVMKPLLAKLPNLKVVFEHITTREAAEFVAAAPANVAATITAHHLLMNRNALFVGGIRPHHYCLPVLKREQHRQALVKAATSGSAKFFLGTDSAPHAKGAKEAACGCAGMYTANAAIELYAEAFEAAGALDKLEAFASLNGPAFYGLPANGGRITLARESWTVPAELPYPGDALVPLRAGEQIGWRLLD

SEQ ID NO: 8830 - protein, 40 aa, Chromobacterium substugae
MLVSHLLLSLFCLRPVYRKTADFFHSIVSRVGPQIMRRGF

SEQ ID NO: 8831 - protein, 537 aa, Chromobacterium substugae
MTDKQSLKAIAAAVALAMASGSVLAAKVPAGVKLAAKQEFTRNTGAEPETLDPVVAESVPANTITADLFEGLTTLDVYGKVLPGVAESWKEVEANTWVFHLRKNAKWSDGTPVTAGDFVYGWQRFVDPKTASPYASTYGMFIVNGKEIAEGKKPASTLGVKAVDKYTLEVKTPYPVLFLPSLVANTQLAPLPKATIDKYGKDWTKPGKMVSNGPFLLKDWQVNSKIVTAKNPNYWDAKNVQLTKITYLPIEDSNADVKLFESGQNDFVYQLPPGTFDKYKAQYPKEIRNTEFLALRYYSFNNKDPLLKDVRVRKALSMVIDRDILAKKITADGQTPAYSVMVRGISGADASTYDWVKWPMAKRVDEAKKLLAEAGVKPGTKVTFTYNTNDYHKKMAIFAASEWKSKLGLNTELESLEFKVLLKKRHDGDYQIARNGWNADYNDATTFLALVQCNNDQNENKNCNPKAEELIKQGSQSLDPAKRKQLFTQATKMIMDDYPMLPLLQYTAPRLVKSYVGGYGKSPLDRYQGKDLYIIAH

SEQ ID NO: 8832 - protein, 306 aa, Chromobacterium substugae
MWSYTFRRILATIPTLLAVITVCYLLLHLTPGGPFDGERKVSAAVLANLQAKYHLDLPPWQQYLYYLNSLLHGDLGASFRYADWSVNDLVSKALPVSATIGGGAILISLVLGVLLGTIAALRQNSVVDYLVMLFGNIGGAFPSFVLGPVLVMIFAIWLPLLPAGGWDNFKLKFMILPISLLVFINVSTIGRVMRGSLIEVLNSNFIRTARAKGLPLRAIVLRHALKPALMPVVSVIGPLAISSITSAVVTETVFGLPGLGKLIVNGASNRDYTLVLGLVVLVTVITVVFNLLVDLAYALLDPKIRY

SEQ ID NO: 8833 - protein, 304 aa, Chromobacterium substugae
MMKSKQAAAAVALENGLSEAAVEGRSLWRDARIRFLRNKAAVVSLVVLSLITLACIFGPMLLANGYADTDWDAMSEAPTLHNMHWFGTDALGRDLLVRCLVGGRISLMVGLLATIASVILGIVWGATAGFLGGKIDSLMMRIVDMMYAVPYLLIAILMVTLLGREFYLVVLTITVFSWMDMARVVRGQALAIKSKEYVEAAHAIGVSTPVIIFRHIVPNLLGIVVIYTTVTVPGVILTESVLSFLGLGVQEPMTSWGVLIQDGAGVMDSTPWILLFPAGMLSLTLYCANYIGDGLRDALDPKDR

SEQ ID NO: 8834 - protein, 333 aa, Chromobacterium substugae
MSILKVTNLGVQFQTNDGVVNAVNGVNFELKKGQTLGIVGESGSGKSQTVLAMMGLLAKNGKTSGEALYHGQNLLAMGAKDLNKIRGDRISMIFQDPMTSLNPYLTVERQMSEVLELHKGLSRRDAKKRAIELLDAVRIPEAARRINMYPHEFSGGMRQRVMIAMALLCEPEVLIADEPTTALDVTVQAQILTLLKDLQRDFGTSIIMITHDLGVVAGLCENVLVMYGGRAMEYGRADDIFYHPSHPYTIGLLGALPRLDHDGSELVSIPGNPPNMANMPKGCPFSERCVHSSERCVGELPPLAASSLNPQILRACHKPAEELVKAAEEVTHV

SEQ ID NO: 8835 - protein, 330 aa, Chromobacterium substugae
MSETAKQPILSVRNVKVHFQVKGGDAWPWSPKKTLKAVDGVSFDLFAGETLGVVGESGCGKSTLSRAILNLIPATEGEIVWMGKDLRQGSAKDWLSVRKDIQMIFQDPLASLNPRMTIAQIIGEPLRVHKPELSADEVMKRVKAIMKRVGLREQMINRYPHEFSGGQCQRIGIARALILEPKLIICDEPVSALDVSIQAQIINLLKELQREMGLALIFIAHDLAVVKHISDRILVMYLGREMELAQKHALYDVPSHPYTRALLSAIPIPDPRQEKNKVIQILQGDLPSPINPPSGCVFRTRCPQAVERCAQEVPKLRKLSSETQSSCLLA

SEQ ID NO: 8836 - protein, 120 aa, Chromobacterium substugae
MLQQTEGAGELKRASIVNALSGSLEGQGWLEYQLLYPADEGGEVSFIGYERVVARWGERQGSLVLRHDGVYSAAAGVSGSLRVMPGSGSGDFAGLSGDGRIVARAGEHGGEYLLTLQYRD

SEQ ID NO: 8837 - protein, 236 aa, Chromobacterium substugae
MYQGQQEYDIGLEWGLPGVRRLDGQAALCVIVDVLSFSTCVDIGCGCGAALLPFRPDDEGAAAFAAERKAQLAGKRSRNKLSLSPVSMRALSAGSRLVLPSPNGAALSLECAAGEVVAGCLRNAAAVAAYAGSQGAPVRLIAAGERAPDGELRFAFEDFIGAGAIIHRLTGSKSPEAQAAEAAFLLARHDLLSHLRQCTSSLELIERGFADDIELAAQLDVSTCVPRLQAGEYRAL

SEQ ID NO: 8838 - protein, 116 aa, Chromobacterium substugae
MLPAKMVSTTFDLPGYRVVANLGVVRGITVRSRSVVGNFLGGLQSLFGGNITIYTSLCEQARSETYALMCEHAAALGANAVIGMRYDATDVMAGLTEVLCYGTAVRVEPLDAARPS

SEQ ID NO: 8839 - protein, 306 aa, Chromobacterium substugae
MSARHPAAAWARDYQAGDAAAVSALFRAVYGDHYVYPDVYLPSQIEQRNASGQWHSAVALLDGRLAGHATLWLDPARPGQAELALNVVHPDARGRGVASLLGRHLRAAAGSLGCGLLTIKQVCSHPQSQYLAQTLGFHTSALMLDYVDSPFGKPEPESIVLGCLPLRPRPLPELAWPAEWEEWLRPLRQAFGPGAPAAAPTRLPGLSLARHGQRLEVVVPQPSAARLAEIAALPAGQLIYLKLAPSADALALRPRLAEAGFRFGGLLPDAGGGWLLLFLRGQRGDAIRFCDAGAEQLYRLDLQPAA

SEQ ID NO: 8840 - protein, 434 aa, Chromobacterium substugae
MRRPSADAGAEAAIMNPKLKSLVDHARRHSPFYRQLYRALPAEGWRLSDLPPADPDHYWRGSQTLRDWPVLTAPLDDGHVFKTGGSTSEGKLSVFSRAEWQAFVQAFGGGVARQLRAGDRVANLFFAGDLYTSLLFIHGALSRAPLPLVEFPFTCHVDDAVLADAIRRYEINALTGVPAQLLRFAHHLAHAGQTLAGVDTVLYGGESLFGEQLALLKQAFPQARIASVGCASVDAGLIGYAEPGCRHGEHRVFDDDSLVEILDEASGEPISETGRCGVLTLTNLQRRLMPVIRYPTGDLACWREPPGPARKFALQGRSGQGHRVRVGTLSLFPAQLAPLLERHAELLAWQLAIERRDGRDALSLLLASRRQLDCAALRQDLLAAQPAIAALCAAGQLRLDIVQTSPERMRTHPRSGKLMRVVDLRDYQAEEAQP

SEQ ID NO: 8841 - protein, 800 aa, Chromobacterium substugae
MYLIDGELRAQLTADDALAALRARLADTLAAEPDVEAVLSCAERFADALARAGGHPLLDEAGRLALARFCRREALQAKLERELDERPFSLRRHDYREARFEAWRPLGLVLHITPSNAALLPFMAALEGLLAGNVNWLRPSASDQGLSARLLAEFLRHDHSGRLARRVAVLPIASDRLAPLLAEADAVSAWGGDAALAAIRAQLPPGCRWIDWGHRVSFAYLDPAAGDAQLDALADDVCRHDQQACSSPQCLLVDCDDAETLRGVAARMAAALARRAPQWPALRPDLQEAAEISSQMAFLRLDQAFAGLDGEVLDGEGWRLAWNARHELAPSPLFRTLQLRPAPRAELSAILRPWRTRLQSCGLIAPAARLPELSRALLAAGVSRVAPAGRMHDGYDGEPHDGVYALQRLSRRVSATLDAAALPGHAHLDAPPAEPEGLAALPVMDKADFQRQGANAKAQLFFRSGGSSGAPKLAGFSYRDYHRQMRAAADGLFAAGLDPAADRVMNLLYGGKLYGGMLSFFTILDHMGVAQYPMGGPSDDDFSEIARFIVEQNINTLVGMPGTLHRLFECENKLLRGYGGVRKVFFGGEHISDGQRAYIGSFGVELIRSALYGSVDAGPLGHGCPGSADGEFHLLAETQWLEVLEQDSDRPAAAGEIGRLVFTSREREAQRVRRYDLGDLGRWLPGRCACGLATPRFQLTGRHGALLRVGTIFVNPAELSRQIGLPLQWLVDQADSGCDRIRLLADGEPNRIRAQLLQDPMLSEVVGGGLLKLEISPTPAAEFRRHPHSGKTPLVLDLRR

SEQ ID NO: 8842 - protein, 376 aa, Chromobacterium substugae
MTSLKHVEALCHLDDPYRADAECDCLFDAAMRELVDYHCERSPGYRQWLEQNGFTPARLAGLADWSQLPPIFANYFKRRLLLSASGEDALELTSSGTTGQKSRMRYDERSIGAAQRMVDRIFDHYGWHTPDQPANYLLLSYEPAGAITLGTAYTDQFLCKYAPVNRAVYALRHTGKGNEFDPFGAMRALQEFAAEGLPVRILGFPAFLWFTLERMRDMGLPPLALHPQSLVFLGGGWKTHADQAIPKLELYRRLGEQLGLPDERCRDGYGSVEHPVPYVECPNHRFHVPSWARAWARDTATLARLPYGEPGFLHLVSPYITSSPAHSLALSDLAALHPAASCGCGLATDWFELLGRAGTSKSRSCAMAASELIKES

SEQ ID NO: 8843 - protein, 418 aa, Chromobacterium substugae
MPAEKFRPLLAISRRQALCFCLLLTAFELLTYLASDMVMPAMLQVTRDLDADSRHVPTALNAFLLGGIALQWLIGPLSDRFGRRPLLLAGVLGFAAACAAAAGAQQIESFNLLRFAQGTALGFVIVVSYPALQETFAEEDAVRLMALLANIALLSPLAGPLLGGLLLKLLSWRQLFAALAAAALLVALGLWRLMPETVGAPRRDGPALPPTPLRLKAALANYLGLLRHRTVLCGSLALGLITLPLIAWIGLSPLLLIRQLGYSNLEYGLWQLPVFGGVIAGNLALNRLAGRQSLARLLRLSLAPMACGLLLTGILTPLHPTLPTLAAGLAIYAFGLGLGNATLYRLTLYASDSAKGSVAAVLGMLSTATLGAGAALLAWLNAGDSPQSFAVGATAAALLAAPPLWLLLRAPQPQASAA

SEQ ID NO: 8844 - protein, 246 aa, Chromobacterium substugae
MLRAALCGLLLAGAACYAMADGDALWRIVGEQCLPNQQSQGKPDPCVEVGQAVAVLKDRYGALQYLLIPTSRVSGIESPQLLRDGAPAYWREAWRARRYMALKRGGPVPRQAVALAINSQYGRSQNQLHIHISCIDPTVRQQVDDLDDSLPRRWRPLPVELKGHAYWARRVDADRDGNPQGDPFRLLADELPGAAEQMGRYGLALLPASFADGDGFVLLAGRADLLSANRGSAEELQDHDCKVLDR

SEQ ID NO: 8845 - protein, 130 aa, Chromobacterium substugae
MQQSLGLVSLVVRDYDEAIDFYVNTLGFELTEDSYQPEQDKRWVVVTPPGSQAGLLLARASNEGQAAFIGNQAGGRVWLFLNTDDFWRDYRRYQAAGVEFVRPPQEQDYGTVAVFRDLYGNLWDLLQRKG

SEQ ID NO: 8846 - protein, 258 aa, Chromobacterium substugae
MDHSADLARRFGGIARLYGDDALARFQNAHVCVVGVGGVGSWAVEALARSAIGKLTLIDLDNVAESNTNRQLPALDPLYGMAKVTALAERARAINPACEVIEIEDFVTEENMDAMLGQGYDYLVDCIDSLKVKTAMAAWCARHRQRFIVSGGAGGQMDPSKIKLADLSEVTQDPLLSKLRYNLRRHHGFARDGKKMCVPCVYSTEQLVYPQAQACDADDARGPQGLSCAGFGAGMVVTASFGLFAASRVLTDLAKAKK

SEQ ID NO: 8847 - protein, 74 aa, Chromobacterium substugae
MKQQRFDIDLDKHYNATVVIACEECGRETRQHLRTIVPDHPLQCSCGADISMAAPDIQKAERQADAIRQSYRIH

SEQ ID NO: 8848 - protein, 111 aa, Chromobacterium substugae
MQQTYAFFALLRVHPNWLRLSRPERRRFEAETLRPIYERYPAVRMRWFDAEAFTGRCSDIALFETESIREFYYLIDALRDSKIATEPYFEFLDIIPAVEDGFREYDAQLAN

SEQ ID NO: 8849 - protein, 198 aa, Chromobacterium substugae
MPAIPQARKQPRQARSRHAVAAILEAAARILARDGYAGLTTNKTAELAGVGIGSLYQYFPNKDALVAALHRRHGEETLAAVQDALRRGAGWPPRRQLAELVAAVLALHLRELGLHRVLEREWPAFDEPPAVNPQDAALRDCVAAWLAGIGADAGRAEVLLRMADGLIHGLLLDAEPPPDAARLITDALAACLGLPAET

SEQ ID NO: 8850 - protein, 343 aa, Chromobacterium substugae
MMKWIDLRSDTVTQPTPAMRQAMLDAELGDDVYGDDPTVIRLEALAADKLGKEAALLVPSGTFGNQLALFTHCRRGEEVIVEDNSHIVWHEAGGAAVIAGAQLRTIEGRDGVMATADIERRIRVGDDIHEPRTGLICLENAHGNGKVLPLAAMADTAALARAHGVPIHLDGARVFNAAAYLGCDVREITRHVDSVMACLSKGLAAPIGSVLAGSADFIAAARRKRKLLGGGMRQAGVIAAPGILALTEMAARLPEDHANARYLAERLAGLPCIDIRPDDIHINLVWFRFNADIDSAELMAALEEAGFLANPPHQGMMRLVTHWQVGRDDLDRLVEAMRRVLCD

SEQ ID NO: 8851 - protein, 240 aa, Chromobacterium substugae
MWRRLLSGALLAAGLCNAWSQPARAAGLDAVRIYTDDDPPYVMVGADGKVAGGTTVEKVTRVMRKLGLPFSALEAVPWARAYQEAKTRPYAMVFPIAKTRERLKYLDFTFKIIDAEVYFYWLKTRSDIQLASLEDAKKHSVCVVRNDYRQEYLESEGFLRLDVAGDTTDNVKKLLSGRCDLIVSTETGMVSKLKALNADRALLTRGMRLDKLDSALYAAFNKGTPPDVIARFRAAAAEVE

SEQ ID NO: 8852 - protein, 258 aa, Chromobacterium substugae
MIRRLLCLACMCLAAWSARAEQLASVQSRPGVIVRFLLLEPAGPARANLILFSGGEGLLKLSDAGELGAGKGNFLVRTRQGWADMGFRVAVVDAPSDMPRGLLGDFRASAEHARDVAAVADYLRRGAALPLWLVGTSRGTTSAVALGLQLPERVHGLVLTSSLDSGRGSLADFELERLRMPVLMIQHRRDDCRASRAYNLGTIIDRLRSEQPRQLMLMDGGKNEGDPCQPWAWHGYNGIEGRVLKLAGAWMLSHGGAP

SEQ ID NO: 8853 - protein, 676 aa, Chromobacterium substugae
MNPSHDPHLWLESLDSKAAADWVAAQNARTEAALDADPRFAGLRADILGHLRDTRQIPYFAEHAGWLYNFHQDEAHPRGIYRRTTLDAYRAGSQDWQTVLDIDALADADERDWYLDGVSHCTVKPERALVHLTDGGGDASVAREYDIEARRWVEHGFSFPEGKNHIAWRDPDSAFACPGWKGAPLTRAGYPREVWLVTRGEDGQHGWTQLFAAPEDAMMVAAWRFLDSDGSALDLIEASDGFYRKTYHLLDGALETHALPLPAKAEIEAYIAGDFIVKLAEDWDWRGQRYLNGSLLAVSLAGLLGEGAAPQLLQAPEPRLAVAAVETTRSRLLVNLLDNVKSRMLCFAKQDGAWTPQPLALPEDGVIEIADQPWQSDILYYTYSDFLTPSGLYRLDAASGEGECLRRQPEAFDPAPYVAEQWQATAPDGEQIPYFVVRRRDAPFDGTTPTLLYGYGGFEVPMLPYYIENFGPHWLAKGGAFVLACIRGGGEFGPHWHQAAQGARRQVSFDDFLAVAEDLIARKLTAPARLGIEGGSNGGLLVGAALAQRPELFGAVVCEVPLLDMLRYTELLAGASWIDEYGDPDDAAERAALAAYSPYHHLRADARYPLALFTTSGSDDRVHPGHARKMAARLLELGHDALFYETDGGGHAGNAGQEETASELARVLVYLYQRLM

SEQ ID NO: 8854 - protein, 657 aa, Chromobacterium substugae
MWTFDHPPIAQVKQRYGVELTPAWLDNLRQAAVDFGASASFVSPDGLLLTNHHVALGCLNQLSSAQRDLVAKGYLARERRQELKCPNGTARVLESWQDVTAGIQAASPASLPPEQQASRRKTAIAAAEQACDKASGLKCEVVSLYNGAVYQLYRYREWKDVRLAFAPEYQAAFFGGDADNFVYPRHALDMALLRVYQNGKPYRPPHYLKLSRQGVAEGEAVFVAGHPGRTSRLETLAQLQLRRDVTLPLQLADARMQQALLHRYAARSPEAARQANDALFGAENWLKSMSGEYKALRQPELEAAKRQEETELQAAYRQAGLAGDPWQSVEQAVDYQRGHFLESYFVGYGHRTLLSRAGALVELAAERQLPEGERLNGYSDSDLPDQERWIRADTPIYPELEVARLTGQLEQMRAKLGAAHPAVRILLGQEEPAAAARRLIGGSKLNLAGERQKLLDGGAAAIAASADPLIAAARQLYPLRRQLERGDEAHVHTPLRQAAAQLGQARFKLYGDSLPPDATGTLRLSYGKVAGYDADGVATPWKTVIGGVYARASAFDQRPPFQLADALAKQRRAINPDLPFNFVNTADIIGGNSGSPVVNAKGELVGLIFDSNLEGLAGGHIYSDAKARAIAVDSRAILHLLDKAYHAQNLLKELSPA

SEQ ID NO: 8855 - protein, 673 aa, Chromobacterium substugae
MKRLLPLSLLVCLQAAWAGPAEELNYGAYGIDLKGIDHSVRIQDNISLYANGAWMRRAQIPAERSSTGIAEYLYDLNQQRVREIIEHAAGDASSPEAGKIAALYQSFMDEAAIAKLGLAPLRAQLDEIAGLSSAGQAVAYMAKLQGQPVDTPFRFYVQQDPKNSSAYLAGISQSGLGMDRDYYLGKSADFAAARKAYQRYLAKLLTLAGEKRADSRAKAVFALEDKLARMQWSNVENRDIQKTYNKVAVADLGKRLPGYDWPGIFAAAQLSAAKDVNLDQPSYLAKLSGALSHAPVAVLKDYLTLRTLDAYAAYLDKPWVAAHFDFYGKVLDGRSADRPRWKKAVSLVNEGMGEAVGKLYVAKYFTPEAKRQADELVRNLLKAYDQSIDTLSWMEPATKREAHAKLAKYTPKIGYPDKWRDYGALEIKADDLAGNVARISQFNYQRDAKRLNEPVDRAEWGMTPQTVNAYYNPANNEIVFPAAILQSPYFDPKFDLAVNYGSIGATIGHEISHGFDDQGHQFDGDGNMRNWWTPADEKHFKEVTAKLVKQYSAFEPVKGHHVNGELTLGENIADNAGLEIAYKAYKIALGGKEAPVIDGMSGDQRFFLAFAQSWRSKSRDAATVKQIVSDPHTPDLYRPIGTVSNLDPFYQAFGVKPGDKMYLPPAQRFHLWW

SEQ ID NO: 8856 - protein, 177 aa, Chromobacterium substugae
MKKHLAFALALTSLAGGAHAADYIFGAGNGTQQLTRTSDGFGIGLNLDYLRHDHKGSAGGAGLEFALPLGPLTVAAGGKLMALSPDSGSATAAMIGGRASFDVAPKVKVFGQAYYAPSSFASGSVDRVSDYAAGVRWNVAGPFSVEAGYRYFDIRRDDASRSRRLADGAYLGAGLSF

SEQ ID NO: 8857 - protein, 210 aa, Chromobacterium substugae
MDTHQLDPIEVRVLGALVEKQALTPDAYPMTLNGLASACNQLTSREPVLQLSDADISAALDALIAKRLVGERLPAGSRVAKYEHRLNYEWNIDGARLAALTLLMLRGPQTGAEIRTRAGRIYGFAGVDEVETALAALADKYPPLAMKLERQPGEREARWCHLLSGEPQQAEAAAPCEIIDVGLTGRVAALEAEVAALKARLLSLEQHLAG

SEQ ID NO: 8858 - protein, 510 aa, Chromobacterium substugae
MVLRLSLLFTVLFALWGALAPEHMAAATGQWLSFTISRFGWFYLLSVFGFLVFALYLAFGRFGHIRLGKEDEEPEFSRLSWFAMLFSAGMGIGLVFWGVAEPISHFAAPASAGTAPQSADAARAAMRHVFFHWGLHPWAVYSLTALVLAYFKFNRGQPGLISAAFRPLLGDRVNGPIGIAIDVLAVLATVFGVATTLGFGTLQIESGLQMLFGVQPSDWLTVAIVVIATALFLLSSLTGLSRGIKWLSNLNICLAILLFLAVVVLGPTGFIFDTFTTTLGDYLGNLTSTSLRMSPFTQGTWMANWTLFYWAWWVTWAPFVGMFIARVSRGRTIREFIVGVLLVPALASFVWFSAFGGAALDLQLFGGADLVSAVKSDVSTALYVMFEQLPGGHALSLLAMALVIIFFVTSADSATFVLGMFTSGGNLNPSHRVKLVWGVLLAAVALILLQSGGLKGLQAVLIVSALPFMLIMIGMAVSLYRALDEEERDGRKREIRRLRQLEALERRETR

SEQ ID NO: 8859 - protein, 248 aa, Chromobacterium substugae
MIRIDILLVEQGLAASRTAAQNLIAAGRVSHQGAVVAKASQKFPPHAEFAVVADAADRYVSRGGLKMQGALAQAGIAVDGWCALDVGQSTGGFSDCLLQYGARRVVGVDVGHDQLHQRLRDDARVRYFEGVNARALDHAALLAANDGDGFDLMVCDVSFISLSLVLPSALPLLKPGGRLLSLVKPQFEVGREGLSKGGIVRDASLYPLVQDKINRVLAEQNMKTLAWFDSPIKGGDGNHEFFVHAARR

SEQ ID NO: 8860 - protein, 158 aa, Chromobacterium substugae
MYRHIIAAIDGSNNSDKALHEAIRVAKFSDARLTLVHIASLRELAVDSLGVYAGDPGYDLALQQGQEALARAQQLAREAGLHNVLSHLEKSWEGGHDLADLLIGYARSQQADLVVLGTHGRSGLAHLFMGSFAQDVLRRSHCPLLIVRSTDDDDIRVE

SEQ ID NO: 8861 - protein, 449 aa, Chromobacterium substugae
MSDARMPAGRIEWLQHSKARDVELAFADVHGFARGKTLPASAFIQGQQLRIARAVPLQSCVGEFPDYSLYGEHDPDVTLTPDYDTLRLVPWAKTPRALVICDCVDHDGGLSPLAPRSILKQLLARYAAHGWTPIVAPELEFYLFAAHGDPAQPFQPPQLPCGRRETGFDAFGFSALGELEAFFDELYQACETLGIATDTCVHEMGPSQFEINLKHGDALKLADDTFLFKTALKEIAHRHGLSAVCMAKPLPGQPGSSMHIHQSLVDRRGRNVFSGDGGEASPAFFGFIAGLQRFLPELMPLFCPNPNSYRRFVKGMAAPVNLSWGLDNRSVGLRVPVSGPEARRVENRLPGCDANPYLALAASLGAGLAGIEQKLTPDEAAHGNVFKQQAASLPTTLDAACAAMAAAEIGEKLFGADFCRAYLAVKEVELTDYHRQVTTWERQYLGFLV

SEQ ID NO: 8862 - protein, 536 aa, Chromobacterium substugae
MQLNTRLIIIIAASMIALLGISTVALFSTRATLHQEKREQIVHLLKMAENSLSHFQQLETQGMPRPEAQKQAIAALSALKVGDIYFFGRNRDNLVLFHPSKDRVGKVDMGSKLPDGRTTVQAYEDAMQQDHYGVLTIQTKRAGSGAEEFPKLNGVFRFDPWGWTIGTGIFIDDIDQLFWSEARTLLLVAVLCIVVLGALVGWMSRSILQSLGGEPAYAAEVVKAIADGDLSLAIQVKGGAGSLLGAMQDMQGKLRRMIEEIGHATQSINHSCRQLSSDMDKVHEVSGIASSSTTSAAAAIEQLSVSIDHVSASTRDTESGARDTAQLASEGKTLAGNAADGIRQVADQIHSASDMVGQLAERSRSISSIAETIRDIANQTNLLALNAAIEAARAGEMGRGFAVVADEVRKLAERTASATDEISTIVQAVISETGNVSSQMDEIRPAVQAGVEQVQQAAQTLDSISRQASSALENVHNVVVAMGEQSQAGTNIAGNVEQVAGVVEETQNSVSNAVEAVRDIDQQAANLHQTVGRFRL

SEQ ID NO: 8863 - protein, 466 aa, Chromobacterium substugae
MPAVSHPMYDQHYADGKARRQNCPRASQAECRLAADRDVVALVESTSQGRVPALAPLRYARMHASPFAFFRGMAMIQAADLAAGPDSGLRLQICGDAHLMNFGFFASPERQLVFDINDFDETHPGPWEWDVKRLAVSLVLASRSRGFGAGDARDTVLQLAATYRRRLLAFSQMSQLDLWYCRVGFEELLSHAPDPAMRQQLQKVADKARSQTQERLLPKMTESEDGALRLRDNPPVIFHLDEAGGPLAACDDWLGADSLSKVQGMLEHYIATLKEDRRELLRRFRLVDAAFKVVGVGSVGTRCLALLLQDDYDQPLFLQLKEARPSVLEAFTQDCVHGNQGKRVVFGQRLMQATSDLFLGWTHSADGRHFYMRQLRDMKGAPTLETFAAAEELASYGQACAWTLARAHAKSGGCAAEIAGYLGDSDKFDQALADYAQAYADQVEADYRLFDAAIQSGRLPCAAAAR

SEQ ID NO: 8864 - protein, 122 aa, Chromobacterium substugae
MPKFRLLLSLALSLPLLACTTPLRAAPAGGPALDSSRPPAQLTDCLQQGLQKLHIPDDFIERRDERDGSHSLAMRNPASDASGTRVEILPQADGSRLQVELNGLPLSPAWKKLIHSCSGKRL

SEQ ID NO: 8865 - protein, 158 aa, Chromobacterium substugae
MKTLTNPDLAAMSAKAACAPRLRAHHNLHEQLDDAIQRLAIAMEPDTYVRPHRHPGSPELLIVLAGALDWIEFDAAGETVVARHRLGEGGARVFEMPANTWHSVVSLEPGSVVFEVKRGPYLPLDSADQAAWAPAEGDARVADMLAFLRGCQAGERFA

SEQ ID NO: 8866 - protein, 312 aa, Chromobacterium substugae
MNANKKVALALLAGSFGFGSPAQSAPSGADSSPTPFSVPLAKQANGFVAVKARLNGVDGRFLLDSGASMTCVDRKQAARFGLENQGTTRTSHGSAGATEIKRVADKRLEWGGRLAADKLAVYLTDFDAINQGLAEEGVAAVDGVIGMDVLAEQYAVLDYGQQQLRLGKGATPAAAFDRLPLTSLGGSQLMLEGVINGVKGRFIIDTAAGGTFVTDDAHAARFHLVRQPGANQVHGVGGSVESHFYLLDSLQLGPRFTLRQQKVETMDLAGVNASLKAKGLEEVDGLLGANVLNQGAAVFDIGQQVLQLKPLI

SEQ ID NO: 8867 - protein, 419 aa, Chromobacterium substugae
MNIKEYMQQLGKAARKASRLLARADTQQKNAALLAIADAIVRDQDLLLAANRRDLDAARRAGLDAAMLDRLTLSAHGALAMADGLRQIAALPDPVGEISEMSYRPSGIQLGKMRVPLGVVGIIYEARPNVTADAAGLCLKSGNATILRGGSEAFHSNQAIAACVHEGLRLAGLPAEAVQVLETTDRAAVGELISMPEYVDVIVPRGGKGLIARISAEARVPVIKHLDGNCHVYIDDTANPDKAFNIALNAKTHRYGTCNTMETLLVHGAFAEFMLPRLADAYWEKGVELRGCERTRVILGDKVVPASEDDWATEYLAPVLAVKVVKDIDEAIEHINHWGSHHTDAIVSEDYGRARRFLREVDSASVMVNASTRFADGFEYGLGAEIGISTDKIHARGPVGLNGLTSQKWIVLGDGQIRQ

SEQ ID NO: 8868 - protein, 530 aa, Chromobacterium substugae
MPLLRLLLLLALCLPALAAEPRANPSPADSARTLVLDNRPIFLFLAPQARLSPEQRLRRTLERIRELTPDDLSQPVQAAPLADSSLRGIALSIHGKPLFTLLADDLDPGDQLTLEQAAARVRDRLNEQRLAALEQRSPEQMAKAALLALLASAAFAVLLALILRLRAASRRRLQRQPLGRLPWLGGKFDLRHFLRAAECQLVDVTALLCALFAGYVWLSYALGLFPYTRPLGRKLGDSFYQLLATLADDILSALPGLATVAMIFLLTRLLGRGLTLLCGAVERGQLALPGLHAETVGATRRLAGVALWLFALIVAYPYLPGAGSDAFKGVSVFFGLMVTLGSAGLMNHAMSGLVLIYARALRRGDYVRVGEVEGTVIELSALSTKLATSQGYEITLPNAVAVGGRISNFSRHGEGGGAMIASRVTIGYDTPWRQVTALLELAARRSPGADPAYAPQVRKLALQDFYIEYELQLRLLPDADPPGARDALHGEILDAFNEFGVQIMSPHFVEQPEKPVTVPAQRWREPPAGQ

SEQ ID NO: 8869 - protein, 395 aa, Chromobacterium substugae
MSPGTTRSSLALACAIILAGLNLRPCLAAIGPLLEPIRHATGIRFSDAALLTTLPIAAMGGGAFAGGRLEAWLGARGGVLLALALILLSCALRLPPPGYPALLATALLAGCGIALAQALLPGLIKQHFPDKVSLLMGLYVTAIMGGASLAAAGAPWLAQASGQWHLGLAVWALPAALGCWLWWRHAPTAAGHASHSHSAASPGRLPRAWLLAGYFGLGTAVYTCSLAWLPPFFVQLGWSGQQGGLMLSYMTGMEVLAGLTLPALSARGPDLRGWLALALCFTLAGLLGMVALPQDRLMLLWVGLLGLGVGGLFPLSMILTLSHLDDSRAAGRLTAFVQGIGYLIAACAPFAAGWLRDVTASFQLAWLALSGAVVLLLLLTARFAPQRYRLAMRLA

SEQ ID NO: 8870 - protein, 266 aa, Chromobacterium substugae
MAYYTHRNRRLYYLAHGDGPAALLLHGICNSGRAWLPQLEALAAAGYRVIAPDFAGHGASPRLDASYGVANLAADCVALLDQLDLAQAHIVGLSLGGMAAQQLALDAPSRVRSLTVACSFPSTATDEARQMLAGWAQTLREPDGPLKRLEQSWPRNLNAAFRASPAGQALYWQWQAQAAQADGASQAHVCEGLADYHLAENLSAIAAPALYLAGECDEVSPPALSQWMAAQVPGARFATLPGAAHVANVDSAAAFNAALLAFLRQH

SEQ ID NO: 8871 - protein, 171 aa, Chromobacterium substugae
MCHDAFMDKLDSILEQWRQARPDVDCSAMAVVGRLGRLLIHLQNRLADNFAAFGLKDGEFDVLATLRRAGGADGLCPTDLYTSLMLTSGAVSKRLDRLEAAGWVTRQPNPDDRRALRILLTPAGLERVDRALEGHVAAMEDALSPLAPEQRAQLAGLLKLWLQGFPGESPG

SEQ ID NO: 8872 - protein, 135 aa, Chromobacterium substugae
MKTHARLCAALSLALLSSSALACGDEAALYSRAYDQCMDAAVSTVAMQDCIAAEHGKQDKTLNDNYRKLMAALAKPRQPQLLAAQRLWLQYRDANCRLYADPDGGTAAALAAADCALAATAARAAELAKLLPEQH

SEQ ID NO: 8873 - protein, 550 aa, Chromobacterium substugae
MSDHDPLHPPTDAAPQDPSRRRLFEGLAAIGAAAALPAAISESAAAAPAVHGPLDAKLRHHVKNVVVIYLENRSFNNLYGNFPGVKHPLAQAPAETCIQLDRDGSKLKNLPKIWGGMVQRGQTIAGKYYLIDENAIQNLPNGPFPLKDADGQPLPEAVITRDLWHLFYQNQMQINGGKNDQFVAWADSGALVMGHYSETAKNLNQWKIAQQYTLCDNFFMAAFGGSYLNHQFLISARTPEYFNAKDTAAAKKIAVLDDGPQGYQLKVKQATSAMDGPPQFVNNGAITPDGYAVNTMAPPFQPSYIKPAQGGDQRYADPADANTLPPQTYDTIGDLLSRQGVSWAWYGGSWQAALEGKGGPDTPNFQYHHQPFNYFKNFAPGTQARAEHLRDGGLGDSPISNRFIADAVAGKLPAVAFYKPQGNLNMHAGYSDVESGDRHVANVLQHLMSGPQWKNMVVIITHDENGGWWDHVAPPKGDRWGPGSRIPAIIVSPFAKKGHVDHTFYDTTSIIRFISRLHGLPELEGVKVRNQAFHQRGAQPPGDLTGALQL

SEQ ID NO: 8874 - protein, 294 aa, Chromobacterium substugae
MPALQHFQPDHSPADIIAALERDGGVVIDRLLEPAALARFRQQLNPLLDASPDCQGDFYGYATRRLSGLIARVPACRELAIHPLILQVMDAFLLKGCREYQLNLTQAIRIGPGEPRQFLHSDGLMFPVKVPGSESMINCMYALDDFTEDNGATNVAPGSHLWPEGREAQEDEIVRAAMQAGSVLIYLGSVIHAGGANRSAAPRTGVVLSYNLGWLRQAENHYLAVPRELASELPERLQRLLGYFVHAPNLGSVDGRDPIELLRGPAQGQARFTEFLPEEIRGPLAEARAAMQKG

SEQ ID NO: 8875 - protein, 142 aa, Chromobacterium substugae
MSGRPLQDITRQDSHLARLTAAANELMALDRAFKKLIPEAMAEACRAVRIRDDELVLYADNGIVAARLRMSAPGLLPQLARQGYPAAKVKVKVMLKLARRKKTKTLAISENALDGMEQAAESIDNPVVRQALARLIAHQRRG

SEQ ID NO: 8876 - protein, 437 aa, Chromobacterium substugae
MTHDTTTPGQEIFKLKNVCRGFAKGSDEIQVLDDVNLTLHEGEIVGLLGRSGSGKSTLLRIIAGLIQQSSGEVNYRGKPLTGPAEGVAMVFQTFALFPWLTVLQNVEAGLEALGVEPKERRKRALAAIDLIGLDGFENAYPRELSGGMRQRVGFARGLVVNPTLLLMDEPFSALDVLTAETLRTDMLDLWSDKQLPIKSVLIVTHNIEEAVFMCDRILVLSSNPGRVVAEIKVPFPHRRNRLDPAFRKMVDDIYALMTARRSAHTLHKLPLEIGSHLGEVSTNLMAGLIEEVAQAPYFGKADMPEIAEKLRLEVDDLFPVAEILEHLGFVELKDGDILLTAAGKLFADYGTQERKVQFAEHLLRHVPMAAHIRKVLQERPGQRAPRLRFAQELEDSLSDQAAEETLDTVISWGRYAEIFSYNDHTETFSLEDVEGGQ

SEQ ID NO: 8877 - protein, 579 aa, Chromobacterium substugae
MTTAVRHFMPATARRLIPNRWDLIAFPLILGFLLLATSGIRETWAPITALQTVPITLDPGNLPEYALRTTLRMLAAMAAALVFTLIYGTLAAKSRRAGLLLVPILDILQSVPVLGYISFTVTFFLALFPGRVLGAECAAIFAIFTSQAWNMTFSFYQSLRTVPRDLEEVSVNLRLSPWQKFWKLEVPFSMPGMIWNMMMSMSGGWFFVVASEAITVGDKTVTLPGVGSYLAMAIQDKNLAAVGWVILTMTVVILVYDQFLFRPMVAWADKFRLEDTASQSAPESWVLNLIQRTHFIQQLLKPFGKLIKTIARLRLNVSLPKGIHSEAHTPVSRGIDVVWWFGVAMLAIYSANILVHFIAREVGVAEVLRVLGLGLITLVRVSLLIVLASVVWVPLGVLIGLRPALAEKIQPLAQFLAAFPANLLFPVFVVFIVHFKLNPDIWLSPLIVLGTQWYILFNVIAGASAFPNDFREAAANFRIRGWQWWRKVMLPGIFPYYVTGAITASGGAWNASIVSEFVSWGNDKVVAHGLGAYIAQTTAAGDYPKILLGIVTMSLFVVLFNRLLWRPMYAIAENKLRLN

SEQ ID NO: 8878 - protein, 681 aa, Chromobacterium substugae
MDRRQFLKWGSFLTVSAASAGLSGCIGDDSGSSAGGRNLNAAGKRFDLGVASGDPRPDSVVLWTRVDGGDGSNPLAVTVQLSDKADFSNLLVNQSLSADPGWDYTVRHKVTGLSAATFYYYRFLTGSVVSAAGRTKTAPAAGSSPAQLKFAYITCQDWSVNHWGAFDEIAQLDLDFVMHVGDYIYETVGAGFQTGGNETRHPPLTLPNGTRRADGAIYATTLADYRYLYKSYRADPRIQAVHANFPVISIWDDHEFSDDCWQDRQVYYPGEDDTPNTPRRRSANQAWFEYTPADVSIDLANPSFQNIQIYRSFDFGKLATLVMTDQRLYRADHIISEDSVPNTGLANIGSRYFVPQALLSATEAAKIAAAGGDLQPVSILGDSQRAWWQQQMQGAAGAWKLWGNEVSLLRMGVDGTQAVAGMLAQGLAPALAQNFALNLSAPQLQQLAGALYLDLKAADVSGATPALTYANTQPLLAGFSAAISAPVFAAALKPALDAALPPSMLLNQYILNADQWDGYNAERKALMAFLKTNNIGNVVGITGDIHAFFAGQVMDDFDAASPTPVMVDLVTAGISSNSFFSYFKNVVDTVPAFAKAKPLIYQTANGQTVNTFTATLQTFNPWLKYADSDAQGYAVVTLTPAKLSCAFHKMAKLVGGVAPSPATASVQTVEVLAGAPVVNVL

SEQ ID NO: 8879 - protein, 945 aa, Chromobacterium substugae
MFVTLLLMWRMDAPITLSANVLHFSAFFADTLSGPLVSGFDYMISSLLKKVFGSRNDRLLKQFRQTVVRINALEQGLQALSDEALAAKTDEFRARLSKGETLDDLLPEAFAVCREASRRVMGMRHFDVQLIGGMALHYGKIPEMKTGEGKTLVATLAVYLNALSGDGVHVVTVNDYLVSRDAGIMAPLYNFLGLSVGVNLSQMAHDDKQAAYACDITYGTNNEFGFDYLRDNMVFSVEEKVQRKLAFAVVDEVDSILIDEARTPLIISGPADDNIDMYQRMNAVPPLLKRQETEEGEGDYWVDEKAHSLLLSEAGHEHSEDILTRMGLLKEGDSLYSATNITLMHHLMAALRAHALFHLDQHYVVQDGEVVIVDEFTGRLMAGRRWSDGLHQAVEAKEGVEINRENQTLASITFQNYFRLYGKLSGMTGTADTEAYEFQSIYNLETVVIPTNKPMVRKDAQDKVYRSAKEKYDAILADIKDCHERGQPVLVGTTSIENSELVSELLHKAKLPHNVLNAKEHAREADIVVQAGRPGMITVATNMAGRGTDIVLGGNPEPEIKAVRADDSLSDAEKNAKVEAIRADWKQRHAAVLEAGGLHIVGTERHESRRIDNQLRGRSGRQGDPGSSRFYLCLEDPLLRIFASERVAAIMDRLKMPEGEAIEHPWVTRSIENAQRKVEGRNFDIRKQLLEYDDVANDQRKVIYQQRSEILVEEDVSDVVVNMREGVISDLVDLHLPPESLEEQWDLAGLEKTLAADFLLEAPVAAWMQAETTLDIEHIRQRIIDLAAAAYQAKVEQAGDGVMRQFERSLVLQMLDNHWREHLAAMDHLRQGIHLRGYAQKNPKQEYKREAFELFADMLERIKRSVVQVLMTVQIRGQEDVEAVEPHALPEFEMQHAEPGSALGDDEDNPLSPEALASQGLRINRNDLCPCGSGKKYKQCHGRLA

SEQ ID NO: 8880 - protein, 383 aa, Chromobacterium substugae
MLLILFSALFTSFILAILVVRYNYLHSKYSADSDMAGIQKFHACPVPRIGGIPIFLGFSVGLTVAGVLHASVEALYFMLASLPAFAFGLTEDLTKRIGPLPRLLATFVSAALVFYLLHGSINRVEIPWLDHLLANYAPLAFLFTIFAAGGVAHAFNIIDGYNGLSGTVAILTLLALAYVAFKVNDSFLIALCFAMIGAISGFLLLNFPRGLIFAGDGGAYLTGFAVAEISILLIARHPNVSPWFPLLVVIYPVFETVFTIYRRKFLQKRSIGHPDALHLHQIIYKRVVLWMVASKEAKHLTQRNSMTSPYLWALSSSSVLPAMLFWNQKYVLMAFAALFVLSYTYLYKSIVRFRTPRWIMINEQIKQQSPVGASTAANPQRSS

SEQ ID NO: 8881 - protein, 159 aa, Chromobacterium substugae
MKSKRLFAALLIAALPLAAHAAPTLEQSRFTDLNAKPATTAAYKGKVTVLNFWATWCGPCREEMPMLNGLRKKLAPKGVEVVGVALDSKEQVEPFVKQLKIGYPILLGNDDTLDLMRSLGNKTGGLPYTLVLDRSGKVAAALTGKLDEKRLETAIKPYL

SEQ ID NO: 8882 - protein, 314 aa, Chromobacterium substugae
MSILVCGALAYDTLFSFHGRFDSQILPDQLHKISTTFLAPTMRREFGGMAGNIAYSLCLLGEKPIVMGVVGEDFEPYRQHLKRVGVDDRFIRLIRKQYTPQCFGIADKDGNQLMAFHPGAMDFATENHVSDIPDPIELAILSPGGYTAFIQHSRELAAAGIPFIFDPGQELPLLSRDEIHEIVDLASYVAINDYESELMRERAGLTVDDLRKKVKALIVTRGSKGAEIYVDDTVHLIPRVQMPIKPVDPMGCGDAFRAGLLWGISRGVDWKITGRLANVIGAIKVTTHGCQNHFFDWDSLKDLYLQAYGDEWPL

SEQ ID NO: 8883 - protein, 410 aa, Chromobacterium substugae
MESRILAAQPQIEHWFRSQWHAHATPFYGSVDLRNSGFKLAPVDMNLFPGGHNNLNPEFLPLAVQAAQSAVDKVCPEARSILLIPENHTRNTFYLQNVATLVHIFEQAGLKVRLGSLNPEITEITELVSANGDKLTLEPLERRGNRLVLSDGFNPCVVLLNNDLSAGIPDLLQNLEQTLLPPLHAGWAVRRKTHHFEAYNKVCDDFARLISIDPWTINPYFSSCGGLDFHARTGEEQLAETVSQMLDKIRRKYREYGIDNDPFVIVKADAGTYGMGVMSVKSPDEVIGLNRKARNKMSVVKEGLEVSEVIVQEGVYTFETVNEAVAEPVVYMMDRYVIGGFYRVHTGRGIDENLNAPGMHFVPLSFETPCLPDRKGLPDCAPNRFYAYGVISRLALLAASLELEATDPDA

SEQ ID NO: 8884 - protein, 160 aa, Chromobacterium substugae
MKKLVFAGLMALANVCLADGVVVKVSPVAQYGDPVRISSNIRNECALPEAQAAASLKGLEEAGISAEAAPEDQLKQSGYYLKLRLENVVSMGNAFIGHHKSVSMIAKLYKNGKLVDTFTGSRDSMGGIMGGFKGSCSVLERCTQTLGKDLAAWVKGKLDA

SEQ ID NO: 8885 - protein, 314 aa, Chromobacterium substugae
MRILFIADPLEHFKIYKDTTFAMMEEAHRRGHAISFAEAHQLSVEGERILVDAHDLAVTDERPNWYKLGQVQRQPLTGFSAVVMRKDPPFDMEYLYASQLFTLAESHGVKVFTSGQALRDFNEKLAILNFPELISPTLISGEAHRLRAFVKQHQDVILKPLDSMGGDSIFRVKPDDPNLSVIIETITWRGKRTIMAQRYIPEIRDGDKRILVIDGVPVDHCLARIPAAGETRGNLAAGGRGEARPLSERDRQIAETVGPELKKRGILLAGLDVIGNYLTEVNVTSPTCFREIMDQTGINVAGLYIDALERHCQH

SEQ ID NO: 8886 - protein, 126 aa, Chromobacterium substugae
MGKTQESPFKGKTGLARLINAFGYSLDGLRAAFRHEDAFRQLVLLAVILIPMAFSVHAAPLARALLVASSLATLIIELLNSAIEAAVDHTSLERHPLAKRAKDMGSAAQLLGLINLAVVWGLVLFG

SEQ ID NO: 8887 - protein, 121 aa, Chromobacterium substugae
MVSPQQAGAEEAVANLVLWLKLAVEAGGALVIAAGALLLAMRYFTQRLAGGPPDYNRLRLGFARMLALALELQLAADILSTAVAPSWDQIGKLGAIAVLRTALNYFLAREIREAEAGRAAG

SEQ ID NO: 8888 - protein, 125 aa, Chromobacterium substugae
MKISSHFLFTGSTILTLFGLADQQYLILPVAFLIAFIGLSAADREQLADMTLHATAMLIPASQRPLLPLDAFRGQGLMFYRAGSPVYRMLIARDSRWQFLGEQGEVAEEPGCIRVYPGYLYRRLP

SEQ ID NO: 8889 - protein, 769 aa, Chromobacterium substugae
MPTSLLIVESPSKAKTLKKYLGPDFEVLASYGHVRDLVPKNGAVDPEKDFAMKYQLIARNSKHVDAIVDAVAKVDHVYLATDPDREGEAISWHLVEILNKKKLLKDKAAQRVVFHEITKNAVLEAIQNPREIAQDLVDAQQTRRALDYLVGFNLSPLLWKKIRRGLSAGRVQSPALRLICERENEIKAFVQQEYWSVHLDSHKSRTKFSAKLTTLAGVKLDQFAIPNEAEQASVLARLAGKPAQVGAIEKKKKTRSPAAPFTTSTLQQEAVRKLGMTTDRAMRTAQQLYEGMDIGQGTVGLITYMRTDSVALANEAVEEIRGYIGLKWDADFLPKNPAVYKSKAKNAQEAHEAIRPTSILRTPEMVKPFLTTDQFKLYDMIWKRTLACQMAPAKFDTTSVDILVGEGVFRASGQVQTFAGFLAVYEEDVDDAEDEDNAKLPLLAEGEELPVDKLYGDQHFTQPPPRFSEASLVKALEEFGIGRPSTYASIISTLKDREYVILDKKRFLPTDTGDIVNKFLTEHFAQYVDYNFTAKLENQLDEIASGNRQWVPVMDSFWKGFKKQIDEKESISRAEVTTESLDEACPKCSKPLSIKFGKRGRFIACTGYPECDYTRNLGETAEQAAEEAEAPTVIEGRSCPDCGGELHIKKGRYGKFIGCANYPKCKHIEPLEKPRDTGVECPECKTGSLIERKSRYGKLFYSCNTYPKCKYATWNPPIAEKCPQCGWPILTIKVTKRRGTEKVCPQKECGYAEQIAPPEGKEAAPAEEA

SEQ ID NO: 8890 - protein, 152 aa, Chromobacterium substugae
MFDVLTYLFEQYSDPAAFGDRNALTRQLNAVGFDDDDIGEALDWLDSVGETSVEAYAGADEGSGLRVYADSELEHLPADVRGLIQFLEDNGALTPSQREMVIDRLLELDGEDLDVANAKLLVLMVLWAQQAELPILLGEALLEAVHGEPTMQ

SEQ ID NO: 8891 - protein, 356 aa, Chromobacterium substugae
MSAPWLKLALTPGIGPVGFLKLIDAFGSAEHAAAARAAQTEKLIGREAADALQQDLAAPMVEAAQVWSEGEGCHLLTLLDPDYPPQLAEAASPPPLLFARGRRELLARPMLAVVGSRAATPQGKRNAEDFAAGLAAHGYTIVSGLASGIDAAAHQGALAHPASTIAVVGTGIDRVYPAGNRALAHRIAAEGLLLSEFPLGMGPLPGHFPRRNRIIAGLARGCLVVEAGTASGSLISARLAMESNRDVMAIPGSIHNPQARGCHQLIKDGARLVESVDDVLDEVGRLSARQVEQAAPDGGKAAPLLDAMGWEPALAENLADALGLTAGEVYAMLLELELDGQVASLAGGRFQRLART

SEQ ID NO: 8892 - protein, 345 aa, Chromobacterium substugae
MRNRIISLALALGLALPAFSDELTVKPDAPARYTVARGDTLWGISARYLKSPWQWPELWRMNRADIKNPHWIYPGDVLTLDYVDGRPRLSLAGDSLREVKLSPQARPEQQDQAIASIPAEAIEPFLARPLVVDPAQFATAPRLVAGPDERISISQGDKVYASGVGETGTWQAYRLGKPLLDPDSQAVLGVEAAYSGDLVADKLGRDVQTLRVRRVAGEILIGDHLVRAPREQFVNYVPHSPPPGLRGKIISTYQGIDGAAQYSTVAVNLGSQAGMEPGLVFGIYKKGGDIMIDGPDGKPRRTQLPTEQAGKLFVYRVFDKVSYALVLDSTSAIYVGDGIAAPEAE

SEQ ID NO: 8893 - protein, 52 aa, Chromobacterium substugae
MQNVQQRHWYLFTPSCRIAAPAPIIQPSDAAFVPSPLRAPGLPAPRLGFIHA

SEQ ID NO: 8894 - protein, 167 aa, Chromobacterium substugae
MALLNILHYPDDRLHTVAKPVEVFDAALQQQIDDMFETMYEAKGIGLAATQVDYHRRLVVMDISEERDERRVFINPEIVEKNGETVYEEGCLSVPGIYDKVTRAEHVKVKALDRDGKPFELEADGLLAICIQHEIDHLNGVVFVERLSQMKQTRIKTKLKKREKQNM

SEQ ID NO: 8895 - protein, 307 aa, Chromobacterium substugae
MKLIFAGTPEFAAAALRELIAAGHEIALVLTQPDRPAGRGMKLKPSPVKEVALAHGLRVEQPEKLRGNLEAQQMLRDIGAELMVVAAYGLILPRDVLEIPARGCLNIHASLLPRWRGAAPIQRAILAGDGETGITIMQMDVGLDTGDMLSIHPLAIAADETAASLHDKLAACGAQAIVETLGRLDAIAPQKQPEDGVTYAQKLAKAEAEVDWTLPAEDVARAIRAYNPAPGAFTTLGGEPLKLWMAVAEAGAAEPGAVVSADADGVLVGAGQGLVRLTVLQAAGGKRLAARDFVAGKSLPAGTRLGV

SEQ ID NO: 8896 - protein, 285 aa, Chromobacterium substugae
MNDNWLKTTVLMAAIMALFALIGGMIGGKAGMLLALLFGGGMNLFAWWNSDRMVLSMYNAQEVDANSAPEFYGMVAELAQRAGLPMPRVYVIHEEQPNAFATGRNPENAAVAATSGIMRMLDYRELRGVMAHELAHVKHRDTLISTISATMAGAISALANFAMFFGGRDENGQPVGLLPRLAMAFLAPVAASLIQMAISRAREFEADRGGAEISGDPLALASALQKIEYYAQGIAMPTAEAHPETAQMMIINPLSGGGGLGDLFRTHPHTAERIERLNALARGAY

SEQ ID NO: 8897 - protein, 416 aa, Chromobacterium substugae
MHHIQQLAADILGRVEAGTTLTEALAAAHRQAPNLSAAERGALQDLSYGSLRHLGALRHHLRQLVPKPLPEPQLERVLVIAFYQLQHTRAASYAVVNEAVTLAGTLAKGNFKGLVNGVLRNFLRRRDELVQLAERDPVANCNHPSWWLQRVQAAYPEQWRQVMAAANSHPPLTLRVNRRDGAAADYLARLRAAGMEAEALGGEAVRLAKPVAVRELPGFADGAVSVQDEGAQRAAHWLDLQPGQRVLDACAAPGGKTGHMLELADIELTALDIDAARLARVADNLERLGLTAQLREADAARPDSWWDGQLFDRILADVPCSASGVVRRHPDIKWLRRPGDFAALGRQQAAMADALWPLLASGGKMLYATCSIFPEENQQQLESFLQRHPDAACPRQEQLLPCERHDGFYYALLEKH

SEQ ID NO: 8898 - protein, 190 aa, Chromobacterium substugae
MRNISLLLGLLCCLIPAAQADAIAPRRAEAEVMADGTLSVSTRFLTKLTPSLSEALQQGVSLGFRLEFQLIKPRTTAYYLSLREWFDPHAQLSFKLSYQSLTGRYRVSIGSLSNYYPSLREALAAIGAIQGWRVLNPGTLDPRKPGQVAGQVRLLLDIGDLPKPFQMNALGSDDWSLDSDWVKLDIKDGG

SEQ ID NO: 8899 - protein, 703 aa, Chromobacterium substugae
MRYATIAMATLGAILLYLLAVATGNASKLNDYYWWVFGLNSLLLLALLSVVGRQLWRLRQRVKNRVFGAKLTQRLALMFAGVALVPGLLVFTVSAQFLTRSIESWFDVRVEAALDRGLVLGRSALNYVLDDVGRKSRLVLDEVEPLPDSQLPARLERLREQLGLREVAIFNRGSGQMLAFASASARPQGPAPTREALRAVKLRSPQQSIENDGNSGLMLRVLLAYRMPDEQVRVLQLQQAAPADISRDAEQIESARSEYRQLLLARHGLRTFYMLTLALVVLLALTAALAFALFLSERLSAPLSELAAGTRAVAQGDFSKRHPVYRRDELGMLTTLFNRMTQQLDEARQVADKSRGELEGGKLYLESILANLSAGVIAFGRDWQIRAANTSASRILGVEFNHLAEHRFPEWGEVMPAVEPLVATVMEHTDSDVESDWQTQLNYETSQGERTLLVRGARLPEHSSDGYVLVFDDITELARAQRDAAWGEVAKRLAHEIRNPLTPIQLSAERLAMKLADKLEGNDADMLKRATDTIIKQVGALKSMVDAFRDYARAPRIKLVKLDLNQVIREVMTLYESNPAVKIALDEVPPMIMGDAALLRQVLHNLMQNAQDAVLDVGIPMIQISSRQEEGNVLVCVEDNGAGFSPDILRRAFEPYVTSKAKGTGLGLAVVKKIMEEHHGQVILGNAEQQGARVLLSLPLLEA

SEQ ID NO: 8900 - protein, 422 aa, Chromobacterium substugae
MRSSDILIVDDEIGIRELLSEILQDEGYTVALAENAEVARQLRNQTRPALVLLDIWMPDCDGVTLLKEWAKSGLLNMPVVMMSGHASIDTAVEATRIGAFDFLEKPIALQKLLTTVQRALKYGDMQANTSLNLDKLGRSEPIQELKRQLERVAKVKSPVLLTGESGSGFELVARFFHQGNTPWVTPAKLEQLADAPLELLQKANNGVLYLPEIGQYSRRVQQGLLFLLSKLDRFNVRLLCSCSRPLQELLVDPECDNRLLTALSSVIVPIPPLREHSEDITFIAEQILVELVESKQVPARKLTTAALNAMRQYDWPGNLEQLRSIIKSLALTAESDEVDAGEVNKVLAQFRHEKPVEESGFDFNIPLRELREQLERRYFEYHISLENGNMSRVAQKVGLERTHLYRKLKQLGIKFARKVAEE

SEQ ID NO: 8901 - protein, 253 aa, Chromobacterium substugae
MEYPRELDDEALLRYGRHILLPEIDIEGQRRLLAARALIVGAGGLGSPAALYLASAGVGRITIADDDAVELSNLQRQIAHDTASLKQGKAESAARRMLALNPSIEVRPLAERLSGERLIEEVAAHDLVLDCSDNFATRHAVNRACVAARVPLVSGAAVRFAGQLAVFDSRDAASPCYHCLFPEEGEASDGPCATFGVLSPLVGVIGSLQAAEAVKLLAGIAPSLGRLTLYDALRGDFRQIRVPRDLACAVCGE

SEQ ID NO: 8902 - protein, 161 aa, Chromobacterium substugae
MKKGLIAALALLAIAGIAYSLLFSRNPAPEVKLTSLAGVSTSTAALKGKVVLVNFWATSCPGCVEEMPEIKKLHQQYAGKGLNVVAVAMSYDPPNYVQSFVAHNQLPFFVALDPQGEVAKAFGDIQLAPTTFLIDKQGNIIKRYVGVMNFPEVRQLIEQQL

SEQ ID NO: 8903 - protein, 137 aa, Chromobacterium substugae
MAHHTRIKVRGYHLDLFGHVNNARYLEFLEEARWNQFEDEGNLALFLESGLALVVVNINIDYRHPATMGDQLLVETGVQSIGKRSAVIHQRVLLEGSDTVVAEADVTFVVFDAKQNKAVALEGPLQEQLQKMMAQPA

SEQ ID NO: 8904 - protein, 125 aa, Chromobacterium substugae
MFEVNRSVALLRPQAPFLAWLKSLPGGLDHNLSLEQLSANCNALLIPPVDDYDDARAFVLAQYRQLFEAELADWCEDDSLWPQNLSPNLFQQWFKLEIHGVLTDLVDQPLEREAFVPLNLDGDAE

SEQ ID NO: 8905 - protein, 285 aa, Chromobacterium substugae
MADHLYRTRLSAPNSRLLWLMAALSLLLHLLLLSLAGLPSGASAPAPESAPQISIRLQSTPAPAPPDITRVAENDHQGAGNTAEAGHLLSRSAMPARAAEAQAAPPPPSAPAAKPAPIVKPETAPAKLTAAPAASARPPSAGSLLAQVGELARSGGDNAVADSDLESGQAGADIGAAARGYPWARYQADWRLKVERIGNLNYPAEARRLGLHGAVTLEVTIGADGSLQAQRVTRSSGSPVLDEAARRIVELASPFPPFPAALSRGPALRISQRFVFTRDNLLSSH

SEQ ID NO: 8906 - protein, 154 aa, Chromobacterium substugae
MDIGINEQDRQDIAHGLSRLLADSYTLYLKTHNFHWNVTGPMFNTLHLMFEAQYNEMALAVDLVAERIRALGHYAPGSYADYARLTSIPEANGVPKADDMIRQLVEGHETLCRTARGIFAVVEKAGDEPTADLLTQRLQVHEKTAWMLRSLLEK

SEQ ID NO: 8907 - protein, 98 aa, Chromobacterium substugae
MKTWLRCDEGRVRLTLHVQPGARKTEAAGEHGDCLKIRLAAPPVDGKANAALLAWLAERFGVARREVALLSGDKSRRKVVEIGCALDAAAVLSLFGVH

SEQ ID NO: 8908 - protein, 147 aa, Chromobacterium substugae
MRALLLLLLIYPFAEIAVLVALADHIGGLAVFLLVLLSSMLGLWMLRNQKLGALLTLGSVMRQGEKVSLYSLLWPLRYALAGLLFLLPGLLSDALAVLLLLPIKGPDIQIPTGGPRPTHGPDAGAGDVIEGEYSRVDDKPRPGRHLQ

SEQ ID NO: 8909 - protein, 115 aa, Chromobacterium substugae
MNTFPSSDCLLVVCNVPDPQLAGQIAATLVAERLAACVNILPPCQSVYRWQEAVERAEETPLLIKTVRAAYPRLERRLAELHPYQVPEIVALPLERGLPSYLTWVSSSVVSSGDV

SEQ ID NO: 8910 - protein, 50 aa, Chromobacterium substugae
MKSFRSVKPFCEKYFQRMPGGGNEIRRQTVAIQPNQTSPLETTLEDTHVR

SEQ ID NO: 8911 - protein, 210 aa, Chromobacterium substugae
MNTIIDTTRTQDLKARTHATHDQLDQRIMAKQPFASRDNYARFLDAQYRFLRDADALYDNPELAELFPDLAERRRYHSIAADLADLQRPLPQLRDAPISETLDVATAMGWLYVVEGSKLGAAILYKLAGKLGLDENCGARHLAGHPDGRARHWRAFTAALDGLNLDEAAEARVTAGAVAAFACMNAHLDQVYATKPAIPPCAGCIWRAVA

SEQ ID NO: 8912 - protein, 601 aa, Chromobacterium substugae
MPTYSLLQLGLFLLALLALIKPAGHYMFLAMAGKPPLLAGPGRWLETRLYRLAAVEPEREMGWKNYAINLLLFQLVGVLFLYLLQRCQAWLPLNPQSFRAVAPDSAFNTAVSFVSNTSWQGYAGETTLSHLSQMLGINAQSFLSAASGMAALLALLRGLTRQSSATLGNVWVDLTRCTLYILLPLSFILALIFVQQGVPQTLAAGRTVATLEASHYRVPLQDARGNALKDADGRPLLQQLSARQQYLALGPVASQEPIKIMSGDGGGFFNANSAHPFENPTPLTNFLQLLTLLILPAGLCHAFGLMAGDTRQGWTIVAAMSLMMALGAAACMRSEIAGNPLLSPALVDQSHGARQSGGNMEGKETRFGAAGSALYAAVTTSSGDGAVNAMHDSFTPIGGMVPMVMMQTGEVVFGGPGAGLYSIVIHAILVVFVVGLMIGRAPEYLGKKIEAFETKMMAAVLLLAPALILLQSAISVSVPAGLAGLGNPGAHGLSEVLYAYTSAANNNGSAFAGLSANTPFYNLMLGIAMWFGRYGVIVPVLALAGSLAAKPRRAPGAGTLPSHGPLFALLLIAAILLATALTYLPALALGPVAEHITLAVP

SEQ ID NO: 8913 - protein, 109 aa, Chromobacterium substugae
MRIDKAGALLAAALASGAAWAQTADEQLLASQMAFQQAQSQQTQADARLKAAQDAKTLAEQRLAGAQAALDKANADLATAAAAQNSAQQVLQGATQGLNQAWQRKDSGQ

SEQ ID NO: 8914 - protein, 198 aa, Chromobacterium substugae
MTRLAGLFTLLSCAAAFAGGALYKWVDDAGRVHYSDSPPLQSQSGGVAELNQQGSVRKPAESDAQRKAREASAAAALLLQQRQQDAARHDQALIQSYPSLADLKADRERQLSVLQSAYHALELRAQGLLLQQRDLQKDLDLSAKLRQPPHPSTTHNLQALRHEQLDLDALIRAKRGELDAFRRKMQQDIQRYQQLNAR

SEQ ID NO: 8915 - protein, 214 aa, Chromobacterium substugae
MSDFRQDFIRFALDKQVLKFGEFITKAGRKSPYFFNAGLFNDGASTLSLSRFYAKSITESGIAFDMLFGPAYKGIILAAAAGMALAEQGRNVPFAYNRKEAKDHGEGGTLVGAPLKGKVLIIDDVISAGTSVRESVELIRAAGAEPAGVAIALDRMERGLGELSAVQEVAQQHGLPVVAIATLKDLLGFLEHSPELAAHLDAVRAYRAQYGVND

SEQ ID NO: 8916 - protein, 258 aa, Chromobacterium substugae
MLRIVSANLNGIRSADKKGFFDWLATIDADFVCVQELKAQAADLSERMRAPDGLTGYFHYAEKKGYSGVGVYARRQPDAVVEGLGVDWIDAEGRFLQLDFGNLSVVSLYLPSGSSSDERQQVKFDFLDVFMPHLEQLRAAGRDIVICGDWNIAHNEIDLKNWKGNLKNSGFLPEERAWMTDLLGRVGWRDAWRNLYPDAPGYTWWSNRGQAYAKDVGWRIDYHIVTPSLMEQAESASIYKDEKFSDHAPLIVDYRREL

SEQ ID NO: 8917 - protein, 198 aa, Chromobacterium substugae
MWDDDDVTLLTAPGWGNSGDAHWQSRWELTYPLARRAEQRDWLYPSRDEWVAGLAAAVAAAPGKLVIAAHSLGCHAAAAWLLQASLLEQRRLKGMLLVAPPALPIGADIARASGELPAGAPLPDFAGFAAADERRLPVPVIVAASQDDPFCDFAVAKRMAADWGAELFDAGRCGHMGSHAGLGSWPAGQRLLQRLILG

SEQ ID NO: 8918 - protein, 279 aa, Chromobacterium substugae
MYTTLISPAQLAGLPAERLVVLDCRFQLDQPDYGHAAYSAAHIPGAHYLHLDYHLSGSKNGHNGRHPLPDGQRLAVDLGAIGVDEDTQVVAYDDGAGQYAARAWWLLRWLGHEKVAVLDGGFAAWQAGGGAVDAETPQRRSCRFAIRPPLQQAVDAGAVQANLASRDFTVVDARSAERFRGVGETIDPVAGHIPGAANRFFMNNLDAGQRYKPAAQLRAEWEALLGAGFDPAAIVHQCGSGVTACQNLLAMEIAGFAGSRLYPGSWSEWCSDPARPVER

SEQ ID NO: 8919 - protein, 549 aa, Chromobacterium substugae
MFSAFTIGQRILLLACSLLLALCLVGGGGWWSLNGIGRELTVLFGEKIAFRHHLDSMQRSMLRVRQDEKNIFISIGNPANTDQSIQTNKQLLDKEIALFKELAGQAKTMPMAAEHQAEFDSMVQGIDGYQQGMESLYQRIAKGEITAANAGDAAIIPFKPKLYAARDALNKLTDLADQTSKESEEQMAATMARTIQAMLALVVFALLLGGGLAWLISRSITRPLAAMQERMRHAAANNDLTVEIDQTGRDEVSETGRALAQLLGNLRAFIERTREDSAQVTSTARSLSQVSQRIADASRVQTDASSSTAASVEEMTVSINLVADHSNEMAGEAQSSMREAVSGSQVAGEAAREMQEIARVIGESEAVIDTLNQRSDEIGNIVEVIHDIAEQTNLLALNAAIEAARAGEMGRGFAVVADEVRKLAERTAQATGEISSKIQAVQGDTTTAVASMREAAQRVGSGVALSAQVSERLAQIRELSSRLLEKTSEIAAAMREQSTASNDAAKSVERIASMGAENGQSVEASSDMAQQLSQLAHGLDQAISRFRTA

SEQ ID NO: 8920 - protein, 132 aa, Chromobacterium substugae
MHCELCEQAKGELLHQDDALRVMLVDEPGYPGFCRVIWRGHVAEMTDLSPTERNHLMDWVYRVEAALRAVMRPAKINLASLGNMVPHLHWHVIPRFEDDAHFPSPIWAAPRRDGADHGQANLAGLLRAALAR

SEQ ID NO: 8921 - protein, 438 aa, Chromobacterium substugae
MSFANSLFVIALLIAASAFFSVSEISLAAARKIKLRQLADEGVASAERVLELQQQPGHFFTVVQIGLNAVAILAGILGEAAFTPYFATLLHMVTPAQWVEHLSFILSFVTVTSLFVLFADLMPKRLGMVAPERIALLVVGPMLFCVRLCSPLVWLFNGLANVFFRLFGVPTGRPDDLTSADIVAMMDAGAEAGVLQQREHHLIENVFELESRTVPSSMTARESIIYFTLHEDEASIKQKIAEHPHTKFLVCDGVIDSVIGYVDSKDILMRLINQQSLSMKRELTIRNVLIIPDSLTLSELLERFKASREDFAVVMNEYALVVGVITLNDVMSTVMGDLVSQFQEEQIVQRDERSWLVDGATPVEDVLRALDIEAFPDDENYETIAGFMMYMLRKIPKRTDSVEFEGYKFEVVDIDNYRIDQLLVTLIPPAPAEIESAR

SEQ ID NO: 8922 - protein, 80 aa, Chromobacterium substugae
MKKLTALLLAATLGLASVATYAADASAPAAKAAAPAHHKHHHKKHHAKKASSAPAAQKAQAAKKHGHHHHHHKKHHRHVK

SEQ ID NO: 8923 - protein, 51 aa, Chromobacterium substugae
MDNGRGLALATAITDMSASCGITLVFRIEISAEKYKRKFKHLSFSTGFDNP

SEQ ID NO: 8924 - protein, 538 aa, Chromobacterium substugae
MLHFPLSRVLLAVGTALALTQAAYAAPSCSPWASGQVYNAGDYATYGGKTWRASWWTQGETPGSSQWGAWQERPASECTPGDPSQPGQPGNGVPPEPKPTVGRNVGSYFTQWGIYDRNYKVSNLVQAGGDKQLTFLNYAFGNVYANGQCGMVTKAESGNGDGGDAWADYQRSFAANESVDGKADNWNDPLRGNFNQLRKLKLANPSLKVLISLGGWTWSKNFGTFAATDAGRKAMVSSCIDLYIKGNLPVGESAGGQGAALGVFDGFDIDWEYPGGGGLPTNSVDPNDKQNYTLLMAEFRNQLNALSTANKRRYYLTAAIGSGVDKIRNTEPAAYSAYLDWINVMTYDFHGGWEAKGPTNFQSNLYRDPAAPVTGDQVYYTVDDAVKTLVNAGVPRAKINVGLPFYGRGWTGVAAGAKGDGLYQVATGPAKGTYEQGIEDYRVLVNRSTKQFNSPIAKQLWTYDGNEFWSYDDPATIRGKLDYVRSQQLGGVFSWSLDGDDAQATLLKTSAEVRLDAATAAKRKAAAAAAKAKAAKKQ

SEQ ID NO: 8925 - protein, 174 aa, Chromobacterium substugae
MSDTALLIIDVQVGVVEGELRAARLDSVLDKLNLAIAKARQRGMPVIFVQHEEDDLPRGSDAWQLHPALARQDGDPIVYKRYGDSFCETDLVQLLSAHGASKLWIGGAATDFCVDSTLRNAVSRGYQATVIADGHTTVSAFALSGEQVVDHFTAAWRATSATPQPLLVKPAAEL

SEQ ID NO: 8926 - protein, 338 aa, Chromobacterium substugae
MTLGYNADFYRMPAAMTAISLLVADDYQLASRQIAALHQNPSYPCRALADLARDPQADALLAQAQGLLLIRERTVVDAALLARMPKLKLVSQTGKLARNIDIAACSAAGVAVVEGSGSPYAPAELAWLLIMAARRRLAENLDSLRAGHWQGPIGRAVRGQTLGILGFGKIGKLVAGYGQAFGMDVLVWGSERARAEALELGYRAAACRADFFAAADVVSLHQRLVPATAGGVTQADLAAMKPDALLVNTSRAELIAPGALEAALDAGRPGFAALDVFEQEPIYDPGHPLLLRPNVLCSPHLGYAEQASYRQYLEIAHRNAVRFFEGDASHVLNPEALA

SEQ ID NO: 8927 - protein, 495 aa, Chromobacterium substugae
MSGPLARYRLVIIVTLLLLGGIVVNACLYYRQSSDEIRRSIVEQGLPLTGDTIFSQIDQGILRPLSVAALMAHDTFLADWMQNGEISPERASRYLSAINGGNGISGSFLVSERSRRYYYAGGIHKIVSAANPHDAWYFRCRGMRQDHEINLDRDMTNGGQATMFINHRMLDDQGRLLGVIGVGLPLDQLARQLAAHEQRFRRRIYFIDRAGRVMLSSSRAFPSGKRLQELPGLSALSPAILSGREAPQRLEYSLDGNRYLLTSRFLPELGWHLLVEQNASRALQPLRASLLANLAINSAILLLVVMAVLATLQRHQRKLRQLATTDQLTGCLNRLAFLDLLPGWLRHCQRIGAIPQLLMLDIDHFKQANDRYGHQVGDRLLQETAELLRSQLRGNDLLIRWGGEEFMVLVASHGLDDSLAERLRSIVARHLMQGAPDKLTITISVGIGLWQPPETLEAAIDRVDQALYAAKQAGRNRVCQAIPAPATGQAASAER

SEQ ID NO: 8928 - protein, 268 aa, Chromobacterium substugae
MLTIGQLARCHGLSTKTLRHYDGIGLFCPAFTGADNGYRYYLPAQVEELGLIVRLRRLGLSLEDIRRLCQEGGLRDGGALREQLRAHAARLQQQIEEKRGQIAQIARYLNQADWSLPAMQTPDIVTLPAFRVIGLAWSPQDEYGIPELWGRFLLREHEIADARPGSSYGICQPLADGQWRYLAALQTAPDAPVPDGMDAVDVPAQRYARFQHRGPVAGLPDTFRAIHGSWLPAAGLEAMDGIEFEYMDQRFLAPDHPDSLTELYIPIR

SEQ ID NO: 8929 - protein, 1284 aa, Chromobacterium substugae
MTAITSEQRLREIPYNYTSYSDREIVIRLLGEPMWKLLDALRGERKTGRSARMLFEVLGDIWVVDRNPYLVDDLLDNPKRLSALVEAMRHRLNEVEKRRDGNGRVGEMIASARQAVEQFARQFDETRELRARVLKKLTRLTRRDNILFDGLSRVAHVTDATDWRVEYPFVVLSPDSEAEMAPLVRACIELGLTIIPRGGGTGYTGGAVPLDRMSAVINTEKLDRHLGIEHIELPGLSGPQATIQCGAGVVTARVSEAAAAAGLVFAVDPTSAEASCIGGNIAMNAGGKKAVLWGTTLDNLASWKMVDPDGHWLLVERIGHNYGKIHDVAEARFRVSRLADDGRTAVSSRELAIPGQAFRKVGLGKDVTDKFLAGLPGVQKEGCDGIITSARFVLHKMPQHTRTVCLEFFGTVAEATPAIVEITDLFQPGGACLAAGVRLAGLEHLDWRYVRAVGYATKAKSRGRPKMVLIADIVSDDENAAAEAASQVVRIANARHGEGFIAVTPEARKTFWLDRSRTAAIARHTNAFKVNEDVVIPLPRLGDYSDGIERINIELSIANKIELLDTLTEYFHGRLPVDKMDTNLPSEELIGDRRAAALSLLAISRDRWQWLLDHMDAPYPDYAARWPDAPREDSAAQPDTVFHALRDFVLRVSWKREVLAELEQLFSGTAAAGIRAAIGELQQHVLRGRVFVALHMHAGDGNVHTNIPVNSDNYEMLQTAHRAVVRIMALARELGGVISGEHGIGITKLEFLTEAEIQPFRDYKAQVDPNGHFNRGKLLPGADLALAYTPSFSLLGAESLILEQSDIGAINDSIKDCLRCGKCKPVCSTHVPRANLLYSPRNKILGVGLLTEAFLYEEQTRRGVSLKHFEELSDVADHCTVCHRCVKPCPVKIDFGDVSVAMRNFLRKSGNKTFNPGTALGMAFLTAKDPATIKTIRAGLVGVGYKAQRLGNAVGKRLGLIGGQKKQPPSTVGPAPVKQQVIHFINRPMPGGLPKKTARALLDVEDANIVPVIRNPRLAEDAEAVFYFPGCGSERLFSQVGLATQAMLWHVGVQTVLPPGYLCCGYPQTSAGYQDKGDAITTENRVLFHRVANTLNYLDIKTVVVSCGTCFDQLAHYRFEDIFPGCRVIDIHEFLMEKGVKLDGISGQQYLYHDPCHTPMKTHQPLKVVNELMGGGVPLSDRCCGEAGTFAASRPDIATQVRARKEEEINKNLQALTGGQPPALPVKILTSCPSCLQGLSRYNDDTGTEADYIVVEIAKHLLGQNWLPEYVARARDGGIERVLL

SEQ ID NO: 8930 - protein, 325 aa, Chromobacterium substugae
MPTARPILAVTAGEPAGIGPDLALQLRRLLPERRCVVIADRGLLAQRAGLLGLDVSLADYRAGQIGPAGALEVLHVPLAAPAAPGRLDPANGRYVLDTLDAAIDGCLAGEFAAMVTAPVHKGVINEAGVPFSGHTEYLAERTGTKKVVMMLAGGGMRVALATTHLPLRAVADAITAPLLFEVIRILHADLKRKFGIAAPRILVAGLNPHAGESGHMGREEIDVIEPALHALRAEGIELIGPLPADTLFNPDKLAQADAVLAMYHDQGLPVLKHASFGAGINITLGLPIIRTSVDHGTALDLAGSGLANPGSLVEAVQLAAQLAAR

SEQ ID NO: 8931 - protein, 429 aa, Chromobacterium substugae
MKKTLLALLFASAMQAALAAPATPVREVDRIVAVVNKNVITWQELKARVDEAIKQLEAQKVAPPARDVLEHQVLEQMITEEVQLQYAASGGLRIDDAAVDQAVANLAKQNKLSEAGMKAQLAKDGITMDRLRGDIRRELTISRLRDSEVGSRVMVSDSEVDQVLKSAQSANRTEYHLASILVGVPERADAKQIDALSQKVHKALADLDAGQPFAKVSAAYSDAPNALKGGDMGWRSATSLPVEFVQILEQLKTGAHTDVIRTQQGFFIFQLQEKRAGGAPMLIEQYHARHILIRTNEAVSEADAKARIDQVRDRIMRGAKFADMAKLYSEDGSNAKGGDLGWVSLGDLVPDFEKAMVALPVGQVSQPVRSPFGWHLILVEGKRNQDVSSDHEKMAIKQQIRARKMEQAYADWVRQLRDSAFVEEHLDDK

SEQ ID NO: 8932 - protein, 757 aa, Chromobacterium substugae
MHRQKLTPLALAVATAFALNAQTARADDDAPIALPAPPKQQGQTVVTADQLDGEMNVILHAKGNVVVTRDDQKVESDWLDYYQAKNRVKAGDRFHMTRGSDVIDGSTLDYNVDDYTGTGMDPVFSMSRQNPPAAKTPGGQPAKPVTMRGNGSQVDFQGQNQYKIYGSRMTTCDPGDDAWYLRAASTDLDYTSGVGVAHNAWMQFYGVPILYTPWLDFPLNGNRKSGLLTPTFKTGSSGTELSVPYYWNIAPNLDATITPHFNDKHGNMLAGEFRYLEPDYNGSIYTEQLPNDKVTNTSRYAWSARHQQNFGHGLTFGLDYNQVSDNNYFTDFGDQVAIASNINLNREAWLNYALGWQGGGGNVTLRTQHYQNLTINPQPTDIPYARMPQLTFNANQSLPSGFSANLVTDLTRFDHPTLQTGDRFVAYPSVTWSFDRSWGFIRPKFGVNYTEYNLNAYQGNAQGTLSRTLPIFSTDAGLYFDRDTTFMGRDHLMTLEPRLFYVNIPNKDQSKLPNFDTSVNDFNFAQLFTENRFSGYDRINGANEITTALTSRFIDQSNGLERLRIAIGKRYYFSQQSIVLDGTPPQVTNTGNDWMLSAGGDLTKTFRLDSSYEYNPTINATQRYNVQLRYNPEPGKVASIRYRYGIYELQDDNGTYGPLRQVDVAAQWPIAKRWYAIGRYNYSLIQQRPIEQLAGFEYNDGCWSARLYSQRYATDLTTTKNAVFFQLELKGLGALGSGSLQSALRLAIPGYTKTNEQ

SEQ ID NO: 8933 - protein, 344 aa, Chromobacterium substugae
MQRLEQLKKWLAQQYPGVEIQVEFAAADADFRRYFRAIWPDGASRIVMDAPPDRMNTDAYVMVRDVFAMVRVPQILLRDREQGFMLLEDLGKITYLAALQHDERPQVHQHLLLEALDTLVDIQKASQPGVLPEYDEALLLRELNLFPEWYCAKELQKPLNFAQRQLWDAGVKALLPALLAQPKVYVHRDFIVRNLMLSAGAPGVLDFQDAVYGPISYDLVSLLRDAFIEWEEPVVLDIAIRYWEKARAAGLPVPEAFDDFYRAFEWMGVQRHLKVAGIFARLYHRDGKDKYRAEIPRFIKYLKRACRRYHELAPFYQLLVQLVGQDETDAELQSSYPVLGVKGG

SEQ ID NO: 8934 - protein, 220 aa, Chromobacterium substugae
MRALGAGLLLMSGLAGAAGLQARVCLPSQDLKICLYQDARLAGERNGGIGSGGGEGGDWSPPLAPAELRVYTRGGAQLSRLRVGRLADIRRSALADAGKPVFLLDEDHSAGFGSYSGVETRPFTVSARGLRFAQPPGGDPAKPFILAQALKSGWKESRDGFLLVSCAPDFPAKGKWDGETFRVRYARLTLRDGQWRLSERSERGFWENEGAFPAERLFPK

SEQ ID NO: 8935 - protein, 237 aa, Chromobacterium substugae
MSEKNMKAMILAAGRGERMRPLTDHTPKPLLTAGGKPLIQWHVERLARAGVTELVINHAWLGAQIEDALGDGSRFGVSIAYSPEGEALETAGGIATALPLLGDAPFIVLNGDVLSDFPVQRLVEAAGRLDGESMLAHLTLTPKAGYKTGRDLTLRADGRVAACGDGDTPYTFCGLAAYHPAFFRGVAPGVASPLLPWLLAAMEQGRVRGEVQSGLWLDVGTPERLAEADRIAAGWTA

SEQ ID NO: 8936 - protein, 176 aa, Chromobacterium substugae
MSRRILGIDPGSLITGFGVIDVVGNQRHYVASGAIRNKSGSTLAERVKVLVDGIHQVVDTYQPTEAALERVFVNVNPAATLMLGQARGACMAALVLKDLPVAEYTALQVKQSVVGQGKAPKEQVQYMVVRMLNLSGTPQADAADALAVALTHANHSGGAIGKLALSGLKVKGGRLV

SEQ ID NO: 8937 - protein, 197 aa, Chromobacterium substugae
MIGRLTGKLIEKLPPQVVVDVGGVGYEVDVPMTTFYQLPALGQNTTLFTHLVVREDAHLLFGFASKEERQTFRQLIKVTGIGAKIALAVLSGMTADELAVAVASEDIKRLSSVPGIGKKTAERLVLELRGKLATGGNLTVPGGLPFAATPDEKSDIVNALLALGYNDKEAAAATKSLPADVTVSEGVRLALKSLMKA

SEQ ID NO: 8938 - protein, 110 aa, Chromobacterium substugae
MRKTLILASLIPALYAGASFAEQSQPASAPAAERHAAAAPADAELGRQVNEVLAKAAQLGAKVEAQVSNGDVVLSGTAPSQEAISRIAEEVSRVPGVKSVRSQVSLLPAG

SEQ ID NO: 8939 - protein, 446 aa, Chromobacterium substugae
MNAPARIVLVDDDPDLLCLVRLRLEAAGHEVEALSSAEAALTALAARRADLLLTDWRLPGMDGLQLFETARRRYPTLPVILFTAHGTVPDAVEAVSRGVFCYLEKPFDGQLLLDKVAQGLTLSAGDGAAGDAWRAGIVSRGPAMEELLSEARMVAATDASVLLQGESGSGKEVLARAIHQASRRAGRPFVAVNCGAIPENLLESELFGHEKGAFTGAAVRHEGLIRQADGGTLFLDEVGDMPLPLQVKLLRVLQDREVRPVGGARPLPVDIRLLSATHRDLPARIADGQFREDLYYRLNVVALTLPPLAERREDIPLLAQHFLQQVSARYGKTVTGFAPDALAFLAAARWPGNIRQLANVVEQCCVLATGPLLTLAQVEKAVAGEAQAIPTLADARREFERDYLERLLRLTGGNVSDAARLADRNRTEFYRLLQKHELNAAAFQDD

SEQ ID NO: 8940 - protein, 161 aa, Chromobacterium substugae
MTPPVFPRRWLPLLWLPLLSACALRPPAAPVRYCPGGDALLIALDWPDEALRQRWQAYEACDSYRLLRILRANRAEPGRLASELDKLLADKSLSPASAALARLQLRQAQTQFRLQDQNERQQQQLRDQQKRIDDQAAKLDALRRLELDLPKPNGLSEGSKR

SEQ ID NO: 8941 - protein, 463 aa, Chromobacterium substugae
MLRFLSFRGLLLAGFLGVALIPAAALMQLRHELGQAADSAQRQQRQTQRWQDIARLSQEQALQYERASRQAAILRDRKLDETASQARAELQSAQRTLRQDAPAEALPGIDAALALCAQTPAHSQQREARFRQLRRVLEQQQQILVQAGEKRQASWRGDIERMRLQANRLAWLALAAAVLLALIVTLLIHAPLRGLQRRIARLAGGARQLNWRQAGPADLQRLGRELEQLDRRLVELEQQQTRFFRQASHELKTPLASIHEAAALLREQVAGPLNPQQRRIVDILGNNALALRQRVEALLKRDAGPWLSTTLNVSAFSLRRLLEARLASCQPLCQAKGLIVALDGMPGEVHGDPSKVETIVDNLLLNAIRHSPPGGRLTLRCGRERGQVWLEMADQGPGVAKACRDKIFEPFWSGPAPDGERPGSGLGLTMARGYAQLMGGELSLLDHGPGARFRLHWPEPEPI

SEQ ID NO: 8942 - protein, 236 aa, Chromobacterium substugae
MFSGITQAIARIIAVQDGDGSRRLTLAFPPGFCDGLRQGASVAVNGACLTVAAPPQADNAEFDLILPTLVTSTLARCQAGDAVNAERALADGAENGGHALSGHVDYQATIAQREACGDNLRLRLSVPPGALRYLFAKGYAALDGVSLTIADIDKREGWFEVWLIPETRQATTLGGKQAGDRINLEIERQTQVLVDTMREALEDKFAALAPLLAARLDDLAPALLPAARRQPALAAR

SEQ ID NO: 8943 - protein, 210 aa, Chromobacterium substugae
MNAHTDILSLRVHAALDALRRGLPVIVADDADRENEADLILAADMLTVPEMARMIRDGSGIVCLCITPERAAQLALPPMAADNGSRYGTAFTVAIEAAEGVTTGVSAADRVTTMRAAIAPDAKPGDLVRPGHVYPIVARAGGVRERRGHTEASVELARLAGFSPAGVLCELMNPDGSMMRGPQLDAYAARHGLPQLTVAELAEWLQRQDA

SEQ ID NO: 8944 - protein, 345 aa, Chromobacterium substugae
MIETDKLFGAAPERRIVTAQRASEQEEALERALRPKQLDDYVGQKKAREQLEIFIEAAKRRGEALDHVLLFGPPGLGKTTLAHIVAREMGVNLRQTSGPVLERAGDLAALLTNLEPHDVLFIDEIHRLSPVVEEILYPALEDYQIDIMIGEGPAARSVKLDLPPFTLVGATTRAGMLTNPLRDRFGIVARLEFYTADELTRIVSRSAGLLNVQLSDDGAFEVAKRSRGTPRIANRLLRRVRDYAEVKSDGVVTMAVADAALAMLDVDPAGLDVMDRKLLSAILEKFSGGPVGLDNVAAAIGESTDTIEDVIEPFLIQQGYLQRTPRGRMATSQAYLHFGLPAKDA

SEQ ID NO: 8945 - protein, 139 aa, Chromobacterium substugae
MFYVLFATILIVVVAAAVAAARFFDPAVAKILGRTLGQELADAWRKYVFFAIVVSGVSGGVRPWSLERYLAPLPGKGSSQLQLGGERWMLELYTAGIETLRSIAWVVLLFFLCAMLAYVIMRAVEFRRLEAEERRSHPE

SEQ ID NO: 8946 - protein, 190 aa, Chromobacterium substugae
MLEERLRGLVRASPWLMEALRAARALHLADWCIGAGALRSLVWDALHGFASQPSALSDIDLAHFDASDLSPGRDAALQARLQASHPGLPWEVTNQAAVHLWFADYFGYAVEPLSSLEDAVATWPEYATAVGVALNADDSLRLIAPYGLDDLFAMRVRRNPARASVEIYRQRLAQKRYAERWPRVRVVESA

SEQ ID NO: 8947 - protein, 357 aa, Chromobacterium substugae
MNKLALAALMTLAWGSASAADVLHVYNWNNALSPDTAKRFEQACRCQLVQDYYGDNEEMLAKLAAGAKGYDMVFPTAFAVNALLKQGKLQALDRAKLPNWKNLNPGYLRLNQPFDPGNRYAAPTVVSLTLLGYNASQLKKAGLADKANSWALVFDPALLAKIKGKVTVLDSQRELMAAALMYLGRDANSVNPADWKAAADVIRKAKPYWAAFNNQSYIKELTVGNIWVALGYSNDLYQAQQDVKAAKRPFELAYQPQKEGNVLAIDNMTILKDAPRPDLAYQFINFMLDGKNAAEISNQIGATNPVKAAEAFFKPQIKANPVIMLDPAKGRYVALKDLDAKSRRELNRLWTQVKIGR

SEQ ID NO: 8948 - protein, 372 aa, Chromobacterium substugae
MDSVIHASDRIVVKVGSSLVTNDGKGLDLAALARWAAEIAELKRRGKQVVLVSSGAIAEGCQRLGWTVRPKGVHELQAAAAVGQMGLCQAYESAFRAFGLQTAQILLTHEDLADRTRYLNARSTLVSLLNLNVVPIINENDTVVTSEIRFGDNDTLGALVTNLIEADALVILTDQQGLYSADPRKHPDAEFIRLAEAGDPRLEEMAGGAGSSVGTGGMITKILAAKRAARSGAATVIACGREAQVLSRLADGEAIGTQLVAATSRMAARKQWLADHLKLSGRLLLDDGAALAIRERGTSLLPVGVSAVEGDFLRGEAVACVDAAGNEVARGLVNYSSDEARQIMRKSTREIEGALGYIVEPELIHRDNMVAL

SEQ ID NO: 8949 - protein, 509 aa, Chromobacterium substugae
MPPLALPKKDMDPQLVDTQPASVAAWLERLPYTDLPECGRLLSQALYQLARTPLEPTQRFKLLLLYLKALDRYYPLLEAESQHNDILSSPKTRLLAVLSVKLFANLYIAFKQTLNEKLGRHALLEREQPKIELLLYTMMAARQYLNVSQQNYCPLPAGFWLDCHQLYALARERGWQDKALSGDDSLAVIYRQILLLGLTSTNRLSVVDMHLARQLIYDLARQVSLLPVAGLNDNRHGYLLDPLEDNPPRHLLITPGSLHGHCSMLELSGAVDTMRRSLEQLQSASGNAAAQLGDVVQLLSGLVEEWQHPRRRKHGREDSQAVVEVVSTLSSIWHLANHGSWQLAGAGSEEENARLRSPPSSCLLTLVNRSESGYLLRGLPREQTLRAGEALLLHPPDQPEAAQLCAVRWVLMQPTGKEVECGVEILGGLPQPVLAMPSITHSGDSFLRGLRLPAAAGRPDLLLLPGRQFSQLREFRLRDDAGEKLIRAAKLLQQSPHFQLIEYRPSEYF

SEQ ID NO: 8950 - protein, 449 aa, Chromobacterium substugae
MSNQAWLERSFAAVWHPCTQMKRHESLPIVPIASADGVWLTDFDGKRYLDGVSSWWVNLFGHGEPRIKQAIKRQLDSLEHVMLAGFTHQPVVELSERLAALSGLGRAFYGSDGASATEIALKMSFHYWKNRGQPGKTRFVSLENSYHGETVGALAVTDVPLFSSTYADLLKPGLRAPSPDARQAAPGETAADPARRAAVALENLLAKRAGEIAAVIVEPLVQGAAGMAMHDPAYLAELRRLCDRHQVHLIADEIAVGFGRTGTFFAYQQAGILPDFLCLSKGITGGFLPLSCVLTRDEIYQAFYHDDVARGFLHSHSYTGNALACSAALAVLDIFEADDVLAANREKAAEFTRRMRPLSSRPDIRHFRHTGMIWAFDVATERADFALAFFSAMLKRGCLLRPIGKTVYFMPPYTLNNEEMDWLVESSCSALDEVLAGGSQTAGAETPLP

SEQ ID NO: 8951 - protein, 158 aa, Chromobacterium substugae
MKRQQIQQGFTLIELMIVVAIVGILAAIAIPAYQDYTKRARVTEGLALADSAKTAVTEYYASNNAFVASGTAPYNTSYGLATTITGSSVGSLSVLASGVIQVAYNSTVSSGALLDLVPTVTSGSVSWVCTYTGTGGGTTAIAAANQLSANWVPSTCRQ

SEQ ID NO: 8952 - protein, 156 aa, Chromobacterium substugae
MRNRTTQRGFTLIELMIVVAIVGILAAIAIPAYQDYAKRSRVAEGLALADAAKTAVAEYYASKSAFASSTPYNSAYGLSTASSITGNAVSSVSVLASGVIQLTYNNTVSSGAQLDLVPSVTSGSVTWVCTYTGTGGGTTAIGTQLQANWVPTNCRQ

SEQ ID NO: 8953 - protein, 623 aa, Chromobacterium substugae
MAQMQGSSQLSDKTWWRDAALYLFFCGCFVFPFFNFARYTPLQDWWTNAGVVLCVGIAGLFALRRGQSGVRVPLAAAALAALLLLLSFSNGLLLENYQPAILILASLAAMLVLAVFLVNRLRPDLARVCVILASCLLLGSCIQIVLGSIQLLDLARYCRGLVTLNYLNPTEVMGNVGQRNQYAQYLSWGVAAACYLYGRGRLRAGFCAPLVLFQLLLITWCGARLPLAYSLGICGLCWFWHRRAPGDEALLRMLKALAAAIIVLALLQLFNEEIVWLLNRLGLPIHVQSGSERLLDAGFGARRRIEWTKAWMVFQQHPWLGVGLARYPAQSVWLEAFGGLPKYPEGVLFTQSHNLIFQLLAETGLSGALVAGLGLCGCLLPFFARGRQSPENLLLICIAMMLLTHSMFEFPLWYLPFLAMLVTVCALGPAPVWQVPTRTMLLRLACAGGGALMIAHIVSGVFIFWNLVAYSRPSLSAAENIRRVNYIEKVERNPLWIDAASMVMGNYLLPGRRQLAVVLPFYEQLARNQPYIAVLQRLSVCQALAGQPEAARRTLVMAIASYPDEVLKLDASLQPWQEPEVRALAELTSRVKAIYLRHGAYTDAARMAAVTAVASPVTRKPLF

SEQ ID NO: 8954 - protein, 610 aa, Chromobacterium substugae
MRYAAGFAVFDIWSAMTFQKISERLALLALCLIAIVPFASRVHFVPLPQWFGEINVIWLLVAAGALLLPGGKLFDAVPRAGWWCLLLAGVWALQPQLVSLMFPGMSYATALGWLALALLASITASLRGAFGEREFAVWLARAVIVGGLVQSLIGAAQLTGLAAPLGLFYDGSHPTTNIFGHIGQRNQYAHYLMWSVVSGVYLFAVGRLGRNWLVALVLWMALMLAWAGSRTTLLYLVAISALAALWHWRSRNEVSRRLMLAMWACSGAVLAGQFALPLFNHLISLLTHSDVENASGVARLAANGDDMGARRFAEMHKAWLTFKAHPLWGVGWSQYAAESVRLQPLPQFAAAGYNSGLFTNAHNLVLQLLAEMGGVATALVLGGFVWAVWPFFRRQAEPEGVLALACIAVTLTHSMLEYPLWYFYFLAMLVLFMAMAPRGESRSLPLPARLPLLAALAWVGWLSISTTPMFWELVNLYTPTGNAQKDAKRAERLIEIVKTKPLFAYHALYTLDDYLPITRDNLKQKLALEDRLTEFRPYPDVMLKRAQMEVLAGEQAKAEQTLRTTLASFPTYAGQFLETLGDANPEWEPLRKISREAYDKLPAKFRTLPE

SEQ ID NO: 8955 - protein, 260 aa, Chromobacterium substugae
MLSPEQETELATRFQQENDLEAARQMVLSHLRVVVSVSRGYAGYGLQQADLIQEGNIGLMKAVKRFEPGRGVRLFSFAIHWIKAEIHEFILRNWRLVRIATTKPQRKLFFNLRSMKSGFSALSEQEAKSIAADLGVKPEEVREMEIRMNGQDVSLLADSDDEDSYAPIDWLADSHSEPTRALERRAFDHLQSEGLEYALSTLDARSRRIVEARWLADDSGSTLHELAAEFGVSAERIRQIEAKALTKMKAALSEGVVLDN

SEQ ID NO: 8956 - protein, 302 aa, Chromobacterium substugae
MKHFLYLNWQSAKQALIKILRQPFGSLLTLLMLALALALPLCLYLSVSSVQDWVGRLTATPQITLFMEQSAEEADIAAVNSTLSHHPKVKSFTFISKSKALQDLEQRNGLSGLSDGLDGNPLPDAFVVTPISLEPREMEMLQKELSGLPMVEMAQFDAHWAKRLYGMVDMGKKLTWFLAAALGLALVLVTHNAIRMQILARQDEIEVSKLIGATDSFIRRPFLYHALWQGVFAALLAWGLSSWLAALANPAIREFAMLYGERVELRGLNLQELAALIGVAAFLAMLGARLAADHHLRKVEPK

SEQ ID NO: 8957 - protein, 217 aa, Chromobacterium substugae
MIQFDQVTKRYPGGNEALKNLSFTIETGEMVFLAGHSGAGKSTLLKLIAGIERATSGGVLVNGQNLSKLRGSQIPYVRQHLGMVFQDHKILFDRSVFDNVMLPLDIIGFDRRDAAKRVRAALDKVGLLSKEKMMPIRLSGGEQQRLCIARAVVHRPSILLADEPSANLDRAYALDIMELFKSFHQVGVTVLISAHDETLMEDYGRRIIRLREGQFAA

SEQ ID NO: 8958 - protein, 382 aa, Chromobacterium substugae
MFSFFKKKPKPVETPQTETPAAVVDAAPALIAEPASPAAAALEAPAPAPAPDAVGDLPAETAAAVAPPVPSEDAAPTPLKKMSWTERLKAGLAKTRDRLGKQLAGLFGGGKIDEELYEELETVLLTADMGMDATVHLLKDVRERVSLKGLKDSSELKGALKDSLQDLIGPLEVPLDVEGKKPFVIMMTGVNGAGKTTSIGKLAKYYQSQGKSVLLAAGDTFRAAAREQLIAWGERNDVTVIAQQGGDSAAVCYDAIQAAIARGIDIVLADTAGRLPTQLHLMEEIKKVKRVIQKALPDAPHEVVLVLDANIGQNTVNQVKAFDDALGLTGLILTKLDGTAKGGVIAAIAKQRPIPLRFIGVGESIDDLRPFDSRDYIDALFE

SEQ ID NO: 8959 - protein, 189 aa, Chromobacterium substugae
MSQSRNKVRIIGGEYRRRLLPFPDAEGLRPTPDRVRETLFNWLGQDLYGKNCLDLFAGSGALGFEAASRSARRVVMVEKSRKAHESLQANRQLLQAGALDVQCGDALLYLKNSREQFDVIFLDPPYDSDLLEQALPLLLPRLAEEGMVYLEARLWPEQLPEGLELVRRDKAGLVQYGLLRRVAAAPVLL

SEQ ID NO: 8960 - protein, 83 aa, Chromobacterium substugae
MSLIITDECINCDVCEPECPNNAISQGEEIYQIDPDLCTQCVGHYDEPQCQQVCPVDCIPLDPSHQESEEQLHAKYLKISGKA

SEQ ID NO: 8961 - protein, 6 aa, Artificial Sequence
  Description of Artificial Sequence: Synthetic 6xHis tag
HHHHHH
